United States Patent 10,233,495 (METHODS AND COMPOSITIONS FOR SCREENING AND TREATING DEVELOPMENTAL DISORDERS) - sequence listing, part 147

SEQ ID NO: 761 - DNA, 28548 bp, Homo sapiens
atttttccttgcatatctgaattacacggggtaaatttcaatcaactgctagttgtgagcctagaaatagggacgcaggtgagtcagggtccctgacctatgcttaagagccattgccaaagattgactcagggaaatgggtagttccgtgccccatcctcttccctactcacttccgcttgatactagaagtgagactcactcagtgtccactttccccacccttggagagctcacagggagtggagtgtatcactcacgtagccatgtgctgctctgcagctgggaaggagcactctggagaaagccgggcgtgtgtcctgatgctcttatcaccctccaaatccccagcttcccctagatagactgctattgacctttaccatccatttgtttccttttcttctcttcttccttctttcttctacaaaggcctcctgctttgaaaatgaggcatacccagggaaaacaggtttcaggtcagctctggttcaaagggtgggtcccttccactccgacaagtttgatcccctcattctgcctccctccctgcccctcctcatgtgtgcgccctctggtcttgccgactctgctctctcctccgccttgattcctgtagggtacatctctccaaacggccctgcagaaagcacagcgcagaaatgcccctccctggggagggaggacccaaagttctggcctcccctactcagtatcagctataaatgccacagacacgtttgcgaggaaaaaagaagaaaaataagaagccaaactgtggagcaatttgggggctccccccaaccatgccatctgcctacaaggcttaccctggcactggctggcctttgggtctttttgtgcaactttattttctatcaaggcccagggggtttgccccttgtctctctgcctctttgacctatccttcctttggaacccaggcatctaaatgacaacttctatgtgcatcatttagagatgagaagaggaaatatctctcctgctttctggttcctgtggctgcttctctttggacttctgggacccagtaagtgacttagcagttaaggagggagaggggcatggaggccacataagccctgaaggagatggggaatcccctgcccaggcatgactcttcttccagaaacaatgatgattcatttttttttttttttttttgcccatttctgcaaaagccagtactgatcccaattccactgaccatgattctgatgctgtcttagaagcaaatctgtattagtctcccccagctgtggttgtgagcacatgtggtggggcggtggggcggtgctggggaaatggaggggggtgagattttactttcctttgtatcttggataaaagtttttttttttaaccggaaaactctagttccaatagcattcttaattccaaattaaaaccaggatctcagtctaaagtcaagtaaaaatccttcaatccttctttgttttttttccataggttatttgggtacaggtgatatttggttatgtaagtgctttattggtgaattgtgagactttggtgcacccgtcaccaagcagtgtacaccgcacccaccctatctgtagtcttttatctctcgtgcctcccccgtccttcctccctagtgcccaaagtccactgtatcattctcatgcgtttgagtcctcacagcttagctcccacctatcagtgagaacatacgatgtttggttttccattcctgagtaacttcacttagaataatagtctacagtctcatccaggtcactgcaaatgccattaattcattcctttttatggctgagtagtattccatcgtatatatatgccagtttctttatccaccgttgattgatgggcatttgggttccatgactttgcaattgtgaattgtgctgctataaacatgtgtgtgcaagtgtcttttttgtataatgacttcttttcctctgggtagatacccagtagtgggattactggatcaaatggtagatctacttttagttctttaagaaatctccacactgttttccatagtgattgtactagtttacattcccactagcagtgtagaagtgttccctgatcactgcatctacgccaacatctactgttttttgattttttgcttcaacccttcttcggatgctgcctgattccaaatccatgtataatcccctgagaacttccctggtagaaacaaaccggagttcggccactgaggggttggctctgacattggatcagcaatggctgtgaaaggaaacagcccaggggagaagtgaattgggctccgtgtgactccaatgggctgtctgagatagtactgttcactccagtctttgatttcttacatcaacatatcttccctaattatgagacaccaggttaattggctcatccattccattgcctttactgtaggatggctcgtcaagaagtgggaggtgcggttgaaagagaaggtataggttggatgatgtggaggatttggagtgcttcccccttcttcctcagtatgcatctgtttcctgcaccccactctggattcgctccctcgcccgcttcagcacttccctcggcgttctttttcttctctttccccttgccttcaccctgaatgcttcaactgttctctacctacccatgccttccagatctgcccgtcgcctgtcctaatcctgaactccagtcctatctgtctgattttaaacaagagtccccttacctcagaagaaactgtcattcatgtagtcattcaacaaacatttatagagctcctcctctgggccaggcactgctgcgtgctaggccatggtgaggaatggagtgggaaatgccatggtcttgacccccatggaacacttggtctactgtaaaacatagacttaaataatatttcctaacaaaagggagcaagtgtgcaagggctgaaaggcccctcctcttttcctaccactagatctataaagtaaccaacagtgtctcctgtagccccattacagtggattagcaaggaccaactcctccatctgaatgctgggcgccgtctcaccctcctgccgtctcaggggctttgctcagtgcatttctccttcccctcccatctcactttacctttcttgggtcctttccatcagcatccaaacaagctcagttctgtatgcacaagtatcatccaaggagacgattaaaaacttgggtttccaggccctgacaccccaccaagcaagatcttgattcagtaagcttggtgggatggcgtgggttcttcagacagtgtgatcccagaggtccctggaccaaacactgaatgatgtccatcctaacgtccccgcatcactcctcagccaccacctctccctccactctcctcctcacccccattcttttttttttttttggagatggagtgtggctctgtcgcccaggctagagtgcagtgctgcaatctcggctcactgcaacctctgcctcccaggttcaagcgattctcctgcctcagcctcctgagtagctgggactacaggcgcacaccgccacgcccagctaattttttgtattttagtagagacggggtttcattgtgttgcccaggctggactcgaactcctgagctcagacaatctacccaccttggcctcccaaagtgctgggattacgggtgtgagctaccgggcctggcccctcacccccattcttgaaggacttccccacacttgctatgtcacttctcacctcccactcacttgtttattttattttattgtattaggtaatggatgtaagcagttctgaaaaagaaatacttgtagtcctacaaggcttctcataaaacttcagcccctgattcccttgccccaattgcttcttattctgagtcctgcttcccagggttcctgttggcatttacgttcatactgcatttatctatttatttagagacaagatctcactctgtcacccaggcgggaatgcagagacaccatcatagctcactgcagcctggtactcccgggctcaagggatcctctcacctcagctttccaaagcactgggattacaggcgtgagccattgcacccggccataaattctcttactaccattacttctttgttggttgaggttttttgggttttttttcctgctttgggcatgatttattgtcttccttctaatgaaaagaaagatttaggttagaccactccccctacacacttactgtctcacattcccgctcacaattctccccaaatgactgtatcaaatttttggtgttaaactagcatttagtgtttacattatgataactataaattttacctctagtaacatttataactgggtcatataattgcattgtgatgacattataataagtataaatgacctctagtaacatttataactgggtcatataattgcattgtgatgaccatccgttcttgtaatttttgtttttctagatattaataatagcctcatttttaaaatgtccatagttttcttcatatatgtaattaattcatcccaaaacctccaccagaagtatccctgtcttttccaaacacatgaggcaatctatcagtttcacttttttcccttgagcaatcccatttggaagcctctgtccaaccagagcaatcccatttagaagcctctgtccaaccagtactggttgcttgctagatctcttgtcctgcaatctgtattcagcaacattctggaaattcccttttttcccttgtaaattcttatcttttttctggctttatttttccatcttggagcatcactttctctagaagcttcctgagagagagagtttatggtgggaaattattttaaaaccttatgcactgttagggtaatgctaagctgctgtaacaaggagatcccgaaagtggctttgaaaaacaagtttatttttctcccttgtaccagtcctaaggtaagtattataggatggtgggagctctgctccatgcagtcattcagggatcctgggtgaatatggttcttccgtcttcaacatatggtttccagtgtcatcatcatttcagcccaaggagagggaagaaaaacagtattttgtattattttatgatacagtcagtcaaagtgcagccacaagaggagaggcttacaggccctagagacaggaggcatggcactgccatgcgggaccacctgagaaagacatcaaggtagtcaggaggcagaagacaggagtgaaggaaagatttatgtctttccttttattgggtttctgtgggaaaggcaaggaaaggcagggtgaacagtttaggattggctggtttgaataattcctgtgttctttgagctatatggctgattaccacctagttgcctagtacttgactttggaatgactaaggcagataaatattgtttcctggagtatatgggccagatagaggagctatggctctggaatggttagtctgcatatcagctcatgctcctggctggaccctttgctacttttaagaattggctagccctggaaggtcctgtctctccctagctagaaaagtttgttaagatgtcaaaacatgataatatacagaaattaaaaatatatatacaagcagaaatcaaggaataggtatttactcttaaagaaatgaagtggaaattaatatgtattccttcccttcaggggcctctgactagggcttagacatgtagccctacctagctacaagagaggttgacaaatgtaacttagccatgtgcccaggaagaagagaaaaatgggcccagctgtccatagaccttatacatctgaaaatgtcttattccaccctcacatttgactcatagtttagctggttatagaattctaggatggatatgatttttctcaggattttaaaggcgttgatccactattcctagattctagattgtgaagtctgatatttagattactgacctcttgtaaaagacccattctttttattctggaggatttcagatttttaaaactactgttctaaaatctcatgatatggtgtcatagtatggattctttcattgtgttaggaatttgcacagtagaaagttgtatcagtcagttctgggaaattttattgcatttttttctttgataattgcctctcgtccattttctctgttctgtctttctgaaaaaatcttataatttggatgtttgacctcctgggctgacactctaattttcttatatttcttcttctgtcttccaactctgtcgttttatttttcttctggggagatttcctcagcttctaaagtcttcaaatccttctagtgaattttgaggtttttttttttcaaagagatcttttttttctctacaaccatttttaagatggcatctcttacttttttttttttttgtgggtgctatactttctcttatattgctgaggacatttgaagttggttttgctgtttgcattgtctcagttctctctggctttgcttcatagggatatttgttttggtctctatatttcaagctagagatttttctcaaatatctggtaatcccagaatgtcctttgcatttgagtgaggcactaatatgatgcctggaagctctgtgagcaggggtagggcctgtcaactggtggacttagctttagggtaatttagcagagacgtggcagtttagattgggaagatcctcaaaatgtcagtatctagtgttggctaatttctttccacaagaagaattctccagatcctgtctagagcatactagcatagctgctgaagtgctggaagctgagcaagggaataggtaatgtgggttttacatttcagggtgtaagcatttccttaattgcatagtttcagtaaaaccttttgagaggtgacagggtgctggcagccctcgctcagtctcggagcctcctcggcctcgccacccattctggctgcgcttgaggggcccttcagccccccgctgcactgtgggagaccctctctgggctggccgaggccggagccagctccctcagctttcagggaggtgtggagggagaggcacgggcgggaacccgggctgcctgcggcacttgcgggccagcactagttccaggtgggcgtggcctcggggggccccacactctgagcctcgggctggcgtggccagcacagctggccccaggcagtgaggaacttagcacccgggccagcagctgcggagggtgcgccaggttccccagcagtgccagcgggtgctgcgctccaattctcgccggacctcagctgcctccctgaggggcacggcttgggacctgcagcccgccatgcctgagcctcccccacgccgccatgggctcctgtgcagccagaacctcccagacgagcgctgccccttgctttgcggcacccggtcccatagactgcccaagggctgaggagtactggcgcacggcgtgggactgacgggcagctccatctgcggcccaggtgcgggatccactaggtgaggccagctgggctcctgagtgtagtggggacttggagaacctttatgtctagctaagggattgtaaatacaccaatcagcactctgtgtctagctcaaggtttgcaaatgcaccaatcagcaccctgtgtctagctaatctggtggggactcggagaatctttatgtctagctaagggattgtaaatacaccaatcagcactctgtgtctagctcaaggtttgtaaacacaccagtaagcaccctgtgtctagctaatctggtggggacttggagaatctttatgtctagctaagggattgtaaatacaccaatcagcaccctgtgtctcgctcaaggtttgtaaacataccaatcagcaccctgtgtatagctcaaggtttgtaaatgcaccaatcagtgctctgtggggacttggagaacttttgtgtctagctcagggattgtaaacacaccaatcagcaccttgtcaaaacagaccaatcagctctctgtaaaaccaatcggcgctctgtaaaatggaccaatcagtaggatgtgggtgccaccagataagggaataaaagcaggctgccctgagccagcagtggcaatccgcttgggtactcttctatagtgtggaaactttgttctttcactctttgtgataaatattgctgctgctcactctttgagtccacactgcgtttatgagttgtaacactcactgcgaaaatctgcagtttcactcctgaggccagtgagatcacgaacccaccagaagaaacgccgaacacatctgaacatcagaaggaacaaactcaggacacaccacttgtaagaactgtgacactcacggcgagagtccacggcttcattgttgaagtcagaccaagaacccaccaattctggatacactttcactcctgccttcagcagtgcctgggattactgatctagagtttctttggtttcagtatctccagagataaaaccctaagctgttaaaaggaagagaggtgtattcatccaagtgcttgagtggaaggagtgatctggagctgagagacagttcctagctacattgtatttcaactatccttcctgtatttagtcacatgccacacccaaatctttagaggaacccagttgcaattcccgaatctttccaggattccacagaattaataatctaccagtagttgacttactctcacccccaatggaggcctgtatgttgaagctttctctgttgtgttggagagttaccactcatctgcctattaccttcaaaaaaacaaaaatatctcctctgctgttatctctccatcgtttgtccttgtggaggtatgtgttttgttatttctctactttttattcttctatgaaatccgtaagcctccatatatacttattcttttattcattccaattggggtctaccccatcatgcaaatctgttttcaataaactaaactcacttccatattgtctctgaatccaatggacatggcccaggccatatcttacttgatctctctgcaaaaatcaattcagttaactgccatatttttctagagcctctctattctcttgacttccttgattcactttttagagttttctttctgccttagtggatgctccttctcagtctcattcatttgcgtctcctcctctatctgagtgatgcagtggccagagcttggtccagcgccctattctccaacatactctcccagacaagcgatctcagtcagcttcatggctttaaatacaatgtatatttaaatgacttccagtttcacgtcttttgatctgatttctcctctaagaactaagtgcaggtttccaactgccaacagtctcctggatatctaatgggcacaaaaagttcaaagtctaatatttccaacttccacttcatccctattcattcagataaatagaactaatttccaactctgcgtaagccccaaagctagaagttgttcttgacttcttttcgtgtcatccaccacatgcagcctttcaacacttcctattggttctacttttctaatttcaaaacatagcttgtattcatccactgaaaggtatctcccctgctaccatcctagttcaagcaataattactgctcttaattttttcactcttgccctcctacatgcccgttttcacacagcatcttttaaaaacataaatcaattttgttttctactttctcttcccttcctgaatgattaagccccagatcattaggtgaggcagagcaaagcagatatcagggttggacaggaggggagacagcagtggcccagagaaggatataagaaactgaactgggccgggtgcggtggctcacgcctgtaatcctagcactttgggaggctgaggtgggcagatcacctgaggtcaggagttcgagggcagcctggccaacatggcaaaactctgtttctactagaaatacaaaaattagctgggtgtggtagcgcatgtctgtatttccagctactcaggaggctgaggcaggagaatcccttgaacccgggaggtggaagttgcaatgagccgagatagcaccactgcactccagcctgggtgacagagcaagaaactaaattggatgaagtggacttctccacagagtggcagcctggcatgttttgtcagaatcttgtgagggtgagagggagtatggggtggagggagtatgggctgaaaatgaatgaatagaataccagtgattttgtgagacaatgttttgtctgcaatatgtattattgaagttccagaaaaaaagggaaccgaaaacatgtttaaagaaatagtagctgaaaaaattaaatttgatgaaaactataaactcacagatcccaagaactcaacaaatatcaagcaaaataaactttaaaaaatcataccaaagtacaacgtaatcaaataactaaaaatcagtgataaaagggaaatcctagaatgagctagaaaagacacattgtatagagaggagcaaagacaagcataacagacttcctgtgaaaaaccatgacaaccagaagataaagaagcaacatcattaaaatactgaaagaaaaaaatactttatcaacctagaattacacggagtaagaatattttcaatatgaagatgaaatgaaggcttttctagacaagcaaaaactggaagaccttgcctcctggaaattgactttttttttttttttttttgatacggagtttcgctcttgttgccccaggctggagcgtaatggcacgatcttggctcactgcaacctctgcctcccggtgagaggtgacagcgtgctggcagtcctcagagccctcgcttgctctcagcacctcctctgcctgggctcccactttggcggcacttgaggagcccttcagcccaccgctgcactgtgggagtccctttctgggctggccgaggccagagccggctccctcagcttgcagggaggtgtggagggagaggtgcgagcgggaaccgggactgtgcgcggcgcttgcgggccagctgcagttccaggtaggcgtgggcttggcggccccgcactcgaagcagccagcgggccctgcaggccccgggcagtgaggggcttagcacccgggccagtggctgcggagggtgtactaggtcccccagcagtgccggcccactggcgctgcactggatttctcactgggccttagctgtcttcccatggggcagggctggggacctgcagcccgccatgcctgagcctcccaccccctccatgggcttctgtgcggccggagcctccccgatgagcgccgccccctgctccagggcgcccagtcccaccgaccgcccacgggctgaggactgtgagcgcatggcgtaggactggcaggcagctccacctgcggccccggggcgggatccactgggtgaagccagctgggctcctgagtctggtgaggacgtggagagtctttatgtctagcttagggattgtaaatacaccaatcagcaccctgtgtgtagctcaggatttgtgagtacaccaatggacactctgtatctagctgctctggtagggccttggagaacctttatgtctagctcagggattgtaaatacaccaatcggcactctgtatctagctcaaggtttgtaaacacaccaatcagcaccctgtgtctagctcagggtttgtgagtgcaccaatcaacactctgtatctagctgctctcgtggggccttggagaacctttatgtctagctcagggattgtaaatacaccaatcggcactctgtatctagctcaaggtttgtaaacacaccaatcagcaccctgtgtttagctcaaagtttgtgagtgcaccaatcgacactctgtatctagctgctctggaggggccttggaggacctctgtgtccatattctgtatctaactaatctgatggggacgtggagaacctttgtatgtagctcagggattgtaaacgcaccaatcagcaccctgtcaaaacagaccactcggctctaccaatcagcaggatgtgggtggggccagataagagaataaaagcaggctgcccgagccagcagtggcaacctgcttgggtcgttttccacactgtggaaactttgttcttttgctctttgcaatagattttgctactgctcactttttgggtctacactgtttttatgatctgtaacactcaccgtaaaggtctgcagcttcactcctgaagccagcgagcccacgagcccactgagaggaaggaacaattccacacgcatgggcttaagagttgctaacactcactgtgaaggtttgcagcttcactcatgagccagcgagagcacaaacccaccagaaggaagaaactccgaacacatctgaacatcagaaggagcaaactccagacatgccaccttaagagctgtaacactcactgtgagggtctgtggcttcattcttgaagtcagtgagaccaagaacccaccaattccagacacactgggttcaagcgattttcctgcctcagcttctcgagtagctgggattacaggcatgtaattagccacaccatgcctggctaattttgtatttttagtacagatgggggttctcaattttggttaggctggtatcgaactcctggtgatctgcctgcctctgcttcccaaaatgctgggattacaggcgtgaatcgacaggcaagactgacatttttttttaaatgtaaaagttcttcaggaagaaaaaatttagatctatgcaaaaaagaatgaagtgtgctggaaatgataaatatatgggtaaaaataaaatttttttcatttaaattttaaaagataatatacttgagtaataatgaattatgaggcttatatgtagacataaaatgtatgacaacagtggtacaagggatagaaaaaggaaatggaagtgtactgtgttgagactctcatgcctttacaggaagaggaatgagctcactgggaggtagacagtgataaaggtgtatatcgtaaatcctagagcaaaggcacacaaataagaatgatatttaataagctaatggtggaaataaaatggggtcaaaaatgactcaggtcatggtgcagcggtttatgcctgtaatcctagccctttgggaggctgaggcaggtggatcacttgaggccaggagttagagaccagcctgggcaacgtggtgaaaccctgtctctactaaaaatacaaaaattagctgggcgtggtggcgcatgcctgtggttccagctactcaggaggccgaggcaggagaatcacttgaacctgggaagtggaattggcagtgagctgagatcccatcactgcactccagcctgagtgacagatcaagacgctcaaaaaacaaaacaaaacaaaaaacaaaatactgggttaattaaaaaaaaaaaaggcgaaaaatggaggaaaaggtaagaagatcagacgagaaaaatagaaaacaaatatgaagactattaaattcagggccagctacagtggttcacacttgtaattccagcactttttggggctgaggcaggaagattacttgagcccaggagttcgagacaagcccaggcaacatagggagaccccatctttacaagaaataaaaattaaaaagtaattagccaggcatcatgactcgtgcctgtgatcctagatagttcggaggctgaggcaggaggatttcttgagcttagaaagtcaaggctgcagtcagccgtgattgtgccactgcattatagcctgagtgacagagcaagactctgtctctaaaaaagaatcagacccaacgtatttataattacattaaatgtatatggtccagacaccacaattaaaaggcagagattgacacattggttaaaaaagaaagccccaaataaataatattcaaccaagaaatacattttaactaactataactacaaatagggtaaacaataggataaaaataagaggaagaaagatacggccatactgtatgttagccatgctaacatcaatttagaaaaaaattgagtgactatttcaaaatcagacaaaataggcttaagaagaggtatattattagggataaagagagacatttcataattataatcacaacacaatatttactaactacaaagggagaaaaaccagcctggatacaccttcttaatcaagtaatccaagagaacatcatcaatgatgggacacattgatattatctgtcacctgatagtatgcaaagagaagaatacagcatcacttcagtggttttcctggcaaagattaataacatgagcctaatcatgatgaaacattacaaaaactcagtttaaggaaaattctataaaataattgacctgtaatcttcaaaggttaaaagttatgaagatcaaaggaagactgaagaactgcaccagactgaagaagactaaagagacagaacaacgaaaaacaacacacgattctgaattgaactggtttactattaaagacattattagaacaactaacaaaacttgaaagggatctaaggatcaggtggcagcaatatattcatgtgaatttcttgatcttgatggctgtattatggttgcgtatgagaatatataaagtattgaaggataatgagacagattcagggaaaagggttctttgtgttatacttgttacaaaagaatttgtgattttttttttcaaaataaaaacaaagagaaattaaccagagtatgttattccagtgggtcttcattgtatttgagatgaaatttaacctttctaccatggtattttgctaaactctgagtatacccctgtcagcaaaagaaatgtgggcttatgttcttgtaaagaagagtttagaatataaagaatgtaaatacacctttgggttatgtgttgttaaaaaggcaggggtcctgcttcagagattatggttagaaaaggtctctctaccgcctcgttttctccttcagtaactacattccagccaccctggtctcctatttattcatgaatcacatcgagctcattaacaactcagggtatttgtacttatgctatcaatctgtgatgtccttctcctggcctttcaaattgctgccttcttttttttttttttttttaagatggagttttgcccttgttggccaggctggagtgcagtggtgcaatcttggctcactgcaacctccgccttccggttcaagtgattctcctgcctcagcctcctgaatagctgggattataggcatgcgccaccatgcctggctaattttgtatttttagtagagatggggtttctccatattggtcaggctggtcttgaactcccggcctcaggtgatccgcctgggattacaggcttgagccactgcgcccagcccaaatggctgccttcttatccttcagatctcagttcatatgtcagttcctcagagagaccttttctgactccagtatctaaagcagcaccactgctttctttaacagcacttaagccaatgtgtatttatattttatgttgtagctctcttctttactaaattataagcccatatcccttttgctgacaggagtatgcccagagtttagtaaaataccaggtacatgttaagccctcaataactgaataaataaatgaataagaagtactgagtatatgtgaaagtaacactatactaaacctgcaaattcatctttaacccattcccaccaccttatttgttctccacctcaggctctgagaataccacagccttcacaaaaggctccgacaccaccacagcctccatcacaggctctgagaccaccatggcctccaccatggcctctacttcggccttaactacaggctctaagatcaccacagactctaccacaggctctgagacaacctcagcctccaccatggcttctactgcagccttcaccacaggctctgagaccaacacggcctccaccacagactcagggactactatagcctccactaggaccttcaccacaggctctgacacaaccacaggctccactgcaggctctgaaactatcgtggcctccaccacagtctctgggaccacaacaacctttactatagcctccactacagtccctgagactaccatggcctccagcacaacctccactgcaggctctgagaaaacgatggcctcctccataatttctgagaccaccatggcctccaccacaggctctgagactgccacagtctctaccacaggctctgagaccaccaccacctccactgcaagctctgaggccactaaagtctctaccacaggctctgaaaccaccacagcatctactgcaggttctgagaccaccactacctccacctccatggcaggctctgaggccaccacaacctcaactgcagactccaaggtgatcacggcatccagcatgagctctgagaccactgtggcccccgctgcaggctctaacaccaccacagcctctaccacaggctctgagaccactacaatcctgattaaagcctctgagaccaccacagcctctacagcaggttctgagaccaccaccccctcccccacaggctctcagaccaccatagtctctatttcaggttctgagatcaccaccacctctacggcaggatccgagaacaccacagtctctagtgcaggctctgggaccaccacagcttctatggcaggctctgagaccaccgtctccactgcaggctctgagaccactacagtctctatcacaggcactgagaccaccatggtctctgccatgggctcagagaccaccacaaactctactacaagctctgagaccaccgtcacctctactgcaggctctgagaccaccacagtctccaccgtgggctctgagaccaccacagcctatactgcagattctgagaccactgcagcctctaccacaggctctgagatgaccacagtcttcactgcaggctcggaaaccatcacaccctctactgcaggctcagagaccaccacagtctctactgcaggctctgagaccactacagtctccaccacaggctctgagaccacaacagcctctactgcacattctgagacgactgcagcctccaccatgggctctgagaccaccaaagtctcaactgcaggctctgagaccacagtctccactgcaggctctgagaccactgcagcctctactgaagattctgaaaccaacacagcatttactgaagattctaagactaccacagcctctactacagggtttgagacaaccgcagcctctactacaggctctgagcctaccatggcatccaccatgggctctgagaccactatggcctctaccataggccctgagaccaccaaggtctccactgcaagctctgaggtgaccacagtctttgctgcaggctctgagacaatcagagcctctaccgtaggctctgagaccaccacagtctctaccacaggctctgagaccaccacagcctccatcatgggctctgagaccagcacagattctaccacaggctctgagaccaccacagcctctactgaaggctctgagaccaccacagcttccactgaaggctctgaggccactacagtctccaccacaggctctgagaccactacagtttctatcacagactcagagaccaccaccacctgtactgaaggctctgagatgactgcagtctccaccacagtctttgagaccactacagcctctactgaaggctctgagatcacaatagcctctacttcagactctgagaccaccacagcttctactgaaggttctgagaccactacagtcactaccgcaggctctgagaccaaaacagcctatactacaggctctgagaccaccacagcctctaatacaggcttggagaccaccacagtctttaccataggctctgacaccaccacagcctctactgaaggctctgagaccactgcagtctctgccacaggctctgagatgaccacagtctctactgaaggctctgagaacactacagtctccaccacaggctctgagaccactacagtttccaccacaggcttggagaccaccaccacttccactgaaggctctgagatgactacagtctccaccacaggtgctgagaccaccacagactctactgaaggctctgggaccactgcagcctccactgcaggctctgagaccaccacagtctctactgcagattctgagaacaccacagcatctactgcagattctgagaccacctcagcctctactacaggctctgagaccaccacagcctctactacaagctctgagaccaccacagcctctactgaaggctctgagaccactacagtctccaccacagactctgagaccaccatggtctctaccacaggctctgagaggaccatcacctctactgaaggctctgagaccactacagtatctgccacaggctctgagaccacagtctctactgaaggctctgggaccactacagtctccatcacaggctctgagaccactaaagtttctaccacaggttcagagaccaccaccacttctactgaaggctctgagattactacagcctccatcacaggctctgagaccaccacagcctctactgaaggctccgagaccaccacagcctctactgaaggctccgagaccacctcagcctctactacaggctctgagaccaccacagcctctactacaagctctgagaccaccatggcatccatcatgggctctgagaccactatggcctctaccataggctctgagaccaccaaggtctccactgcaagctctaaaatgaccacagtcttcactgaaaactctgagaccaccatagcctctaccacagcctctgagaccaccacagtctccactgcaggctctgagaccatcccagcctctacagcaggctctgagaccaccaccaccacctctactgaaggctctgagaccactacagcctctactgaaggctctgagaccaccacagcctctactgaaagctctgagaccactacagccactaccataggctctgagaccaccacagcctctactgaaggctctgagactaccaccacctctactgaaggctctgagaccaccacagcctctactgaaggctctgagatcactacagtttctaccacaggctctgagaccaccacagcctctactgaaggctctgagaccaccacagcctctactgaaggctctgagctcactacagtttctaccacaggctctgagaccatcacagtctctgctgaaggctctgagaccactacagtcactactatgggctctgagaccaccacggcctctactgcaggctcagagaccaccacagtctctactgcaggctctgagaccaccacagcctctattgaaggctctgagaccactacagtctcctccacaggctctgagaccaccacagtctctaccacaggcactgagactaccatcacctctactgaaggttcagagaccactacagtcactactgcaggttctgagaccacagcagtctataccacaggctctgagactaccaccacctctactgaaggctctgagacaaccacagtctctaccacgggctctgagaccaccacagcctctaccgcagatttggagaccaccacagtctccacctcaggctctgggaccaccacagcctctaccgcaggctctgagaccacaacagtctatatcacaggctctaagactaccaccgcctctactgaaggctctgaggccactacagtttctaccactagctctgagaccaccacagcctctaccacaggctctgagatgactacagtctttaccacagtctctgagaccaccacagtctctaccataggctctgaggccaccacatcctctgctgcaggctctgaggccaccaccacctctactgaaggctctgagaccaccacagcctccactgcaggctctgagaccaccacagcctccactgcaggctctgagaccaccacagcctccacttcaggctctgagaccaacacagcctgtaccacaggttctgagacctccacaccctccagtgcaggctctgagaccaacactgccttcatcataggctctgagagcaccatagcttccactgcaagcttggagcccactgcaacttccctcacaggctctgagaccaccacagtctctatcacagcttctggggccactgcagcctccaccactgtctcttccaccacgtttgtactcaccaaggccactgacgtttctatccagcccatcaccaacacacctatgtcaggtactaacccccatgtcttctttgagcccacacattttaactccagtggcaaccaccagctgttcacctgtttctatcatctctgccctggttcaagtcaagccagcacacagttagatataatttcctcttctaggctgggcgcggtggctcatgcctgtaatcccagcacattggaaggctgaggcgagcgaatcacgagatcaggagattgagaccatcctggctaacacggtgaaatccagtctctactaaaaatacaaaaaattagctgggcgtggtggcgggcacctgtagtcccagctactcggaaggctgaggcaggagaatgatgtgaatccgggaggtggagcttgcagtgagcagagatcgcgccattgcattccagcctgggcgacagagcgagactccgtctcaaaaaaaaaaaaaaaaatgtcctcttctggaatcctaattgcctctactctggtctcacctctttttttttaagtgcccaccacttccattgcaatcagaaccacaatatagtaaaccacaagtgcatcatatctgtcacatcttcctccagcaagcccgcctcaactctactggcccatcacagttttgtgaaatgctcccacttcggtgccaagtagattatctctattcaaccaaccatctgtgacactgccacctcctatcaatgtattgactctagaccagaggctggcagaccacatttcatgggtcaagtctcacctgttacctggttttgtaaagttttactggaacatagtcatgcccattcatttatggtttgtctccagctgcttttctgcttttccgtgtatttgcaacagagacagcctggcccaaaagcctaaattatttgctgtttggacctttacagaaaaaatttggcaacctttgctccagtctgagaccaaacaattttgttcattctctggcacttgccatcagcaagccggttacatctgattctatcctcttggttctaagcatactcacttctattctcatgactggtgctgtttgtgatcccattttaaccacttctgacctaggcacacccatcgctacctaagccgccaccaccgcctctgctgtgttgattcgtgctcacacctgtctgagcccaccctctcctatccctgtgagcagccttctccacttgggtcaggtcctcctacatctgcccaagcacactcacctcacctttgctgatcaccacagtgtggtagatgatgtcacctctgtcccagccacggccactggcatgcccatgagtgaatccaattctaccatctcctcctccagctccctccttacacccagtgatcacagtcacaaaagaagcagggcctgccgctttgtataccagcccacccacttatttgatctgctttgatttatttattttcaattttttccataagttattgggatgcaggtggtatttggttatatgaataagttctttagtggtgatttgtgagattttggtgcacccatcaccctagtagtatacactgcaccatatttgaagtcttttatccctcgccccctcccactcttcccccaaagtccccaaagtccattgcatcattcttatgtcttcgtatttccatagcttagctcccacatatcagtgagaacatacgatgttcggttttccattcctgagttacttcacttagaagaatagtctaaaatctcatccaggtcactgcaaatgctgttaattcattcatttttatcagcccaccctcttctatttgggtggccacttctgaagtcaaatagatcttccacttctgaacccatcgcgataacgtttcctcaaacttctgcctcctccatcaccaactccaccaggtgacacattctacctccttctctgtatgacacccacctgcattctggggacatggccacagcagaatcgctttctaccatctctcctcccccaccacacctctcctgagccacctccaccataggtttgttagattcaccctcctctggtctaagcacccccattcccctttaatcatctctgctacaaatgcatcatcttgtgtgacctgtttcataggcaccagaaccactggaaccagactcactgcctccagctctgtcaccatggcccctggaatggacttcacggcctctgctgccagccatactgtgccaggaatagtcttaaacacctctggcctgggtacatccactatgggagcatcatctaccacctcagcccacggcgtcaggaccaccacaggatccacccgtgagccaaccagcagcaccttccaggaaacaggcccggtgtccatgggcacaaacacagttagcatgagccacacacccacaaacgtgatcaaaccaagtggatatttacagccctgggctatcatcctcatttccctggctgcagttgtggctgctgttggattgtcagtaggactgagtttttgtctggtgagtacccagggtgggttcataggggagcctggcaagaaggcaggggggaatcatgtcagcagtgctttggaaaaatccagaatgagaaaggggagtaagttggtgcgctcagaaggaaagaatcacctagcctgatataaggaccagagagaatgcttaagtcagagaaagtgagaagcaaagtagaaaaagaggagggaaaagatggagttggggccaaagtgaagggaaatactgacagaacaagggaaatactgagagagaacaaggaggacataaacataaagaaagcaagaagcagctgggcgcagtggctcacccctgtaattccagcactttggaaggccaaggagggcggatcacttgagtccaggcatttgagaccagcctggccaacatggtgaaacttgtctttactaaaaatacaaaaattagtcgagagtggtagcatggacctgtagtcccagctactttggaggctgaggcacgagaattgcttgaacctgggagatggaggttgcagtgagcagagatcgtgccactgcactccagcctgagtgacagagcaagatcctgtctcgaaaggaaggaagaaagaaaagaaaggtaggaaggaaggaaggagagagagagagaaaaagagaaagaatgaggaagaaaggaagaaagcaagaaagagaaagaaaggaagaaagaaagaaagaaactgagagagaaagagaaagaaaaaagaaagaaggaaagaaagagagagagaaatagagaaaagaaagaagcataaaaatgttcagccatccaaaatgcgggcttccgattgtctcatgtatgacaaatttctggtcctcacagcaattccttgtgtggcctgtgactgttactctctgacctcccactccatctctgctctctggtcttgattgttctttgaatacatatttttcttacatcgatttcacatttattgatgttcttcctgttttcttgtgatcctgcgggtaagttaccatttgaggagtgaagcagagtataaatcagtggtgtgctggagctggctcatcctggcccacaagagattgtgcagttcttcccaattctgagctgagtgatgtgacactggtagcttaaaatatgctgggttggaaatacttacaccacagcaattgtcaaacactacaaatcagcacttttccctcggagagcctgttattaagtgttggacagcataccactggtaaaaatggacaaaatgaaaaatacggaagtcacaaaagatttggataatatagtcaatttgctgaggttctttgttttagaattctcagcctctctccgtatgtggactacataataaataccagcatctaagaattactccctaaattactttattatttcatttgcaagatcaagagagaataacgaaagtgaacattgagtttttactgcctgctaggctcaaggctgaatgtttaaaatgcataatgttatttaatctggcctacaatcccgtggccatattatattcatcttacaagtaagggatctggagcttcatgatcttagctatttgccccagcacatgtagtgagtggcagatataagactctaactcaggttagttggattctggagttcatgcctataatctcaaggctctgtgtagacagctttctagagctctcaattccacgtacctgttctgagctttcttagctgactaacaaagagaaagactgtctgtaaagtgagtctctgtgcctttcacataggggtatggatttacctttgtcttggaagtccaaaaacacataaccttatgatctgcagagctagggcctgagtacgcacataaagatgatatgttaataaggtaacaaggaagcttattttgtcagacggagaaagagtaaaagaacaaggaaaaagagagacagagacagagatcatagtaaggatggtggtaaagagaagagaacatgggcagtttggaaaagtgaaaatctgacattggtgaaacaggcatgtatggtgattagggagaggagacttaattttcatttatcaatgtatttatttttttcttttagagaaaccttttcttccccctgagatattgtggtatttattacccccatggccacagccacagccttggtctggacctgaacttgggcctgggctctgggacattccacagcctgggaaatgcactggttcatggaggagaacttgaaatgggacatggaggaacacacggctttggatatggagtgggccatggactgagccacatccatggagatggctacggagtgaatcatggcgggcattatggacatggaggaggccactgaggacaccatggagtggatcacagagggagccaccaaggaggccacggcaggacaagatggctgtggccatagattgggtatcaaaacatattatgggtgggagggggtcatggaggagaaaaaaataatgatcatgaaataattaaaatggagcataggaagcttcccaggatgtgatccatggagatggacatggactaggtcaagaaaagaaccagcaaaaggacctcagagactttgactggcttggaggggacttcaagtcaaagcttctgtgagtttttcctgagtctcagcctctgttgtggggagtcacgacaaccaccctcaggacatcttctctcccatttcccgccacatcagggtcaacgtttctcatccctgtgtttcctcatggtgctataaatattaccaagacatgtctaagaaacaaaagcacataatgaatgtattatcagggccacacacgtattcgttttcctgtttgttctttcaggttttgttttttttttttttttttgagtgcttattatgtaccaatcactatcccaggagcctttaaatacgtcatcatttggctgggtgtggtggctcacgcctgtaatcccagcactttgggaggccaatgcgggtggatcacttgaggtcaggagttcgagaccagcctggccaacatggtgaaaccccgtctctactaaataaatacaaaaatcagccaggcgtggtggcgagtgcctataatcccagctactcgggatgctgaggcaggagaatcggttgaatctgggaggtggaggttgcagtgaggcgagattgtgccactgcactccagcctgggcgacagaggaagactctgtctcaaaaaaaaaaaaaaggtcatcatttaatcctcagaaaatatcttggtgaccttgaggtaggcaaagatacttagatacttaagcaagacacaaaaagcactagctattaaaagaaagtgtgatgatttggacttcattaaagcctagtatcagcatatacctttaagaggtatattcttaactataaaaggaaagtcaaagatgggagaagatattgcaacacatatagctaacaaacgactcatatccagaatgcagaaagagctacaataagaaaaagatgatgcaattttaaattgggcaaaatatttgataaatagttagcaaaagaggatatcaaaacagccggtgaacatttgaaaaggtacccaatatcactgcttatcagaagtggaatgtaaaaccgcaatgagataccactacatacacacactgtaatgactagcatttgaaagactgccagtaccaagtattggaaaggacattgaacaactggaactctcacacattgttagtgggagtgtaaattgatacaattatcttgggaaaatgtttggcaatgctaaaattaaacacataccctatgactcggtacttccactcctgagagtaaatatccagcagaaatgaatacctgtgtccaccaaaagacatgtaccatgccagcttcattcataccactgcagggtggaaatttaaccccaaagtccactaacattagaacaggtaagtaaattgtgacatattcatgcagtggaatgctacccagtagtgaaaaaaaaaacctatgaaatcacacaataacattaatgaatctcatagtcagtgttgagtaaaagaagtcaaaacaaaagtgtacctactgtataattccattcacatgcagttcaaggccatgtgacattaacctgttgtaataaaggtcagagttgaggatgccttgggggaaaaggctgaccgggagaaggcatgagaaagccttcttgcaggggcagacaggggaagctgagaatgttctgtgtatgatctgggtggtgattacaagggtgtatagatatgtaaaacttcattaaaatgtgcacatgagatctgtgcactttatggtatgtaagttatgtctcaatttgaaaaatgaaaaagatattctgaggctattttctcagcatattatgatttccttggtcagagaatgtggttggagacacatgacgataaatgaggcatttggtaagcccaaagacagtggtgctgcaggaagcattgtgtgcaagggaggcaagcagctattttcaatgaggacaaatcacctctctctttaggttgaaataggtctgatataattaatctgccattctctctggagaatggtgccacataacggggccaacactgatctctgctgttagcagttgaggcactcagccatggattatctgtccagcttggccttggtgaggggaaggccagctcactgagccttgcatacgcttcatccctgccagcctgtctgctttgtccatgtccctgctgagcgagcactagagcagctggaaaaagagattggctgacgtctgcagaatggatcgcttggtcaacctcatcatggaagatttcctctgtagtgaacgcccattggtgaacagtcacatgggatgcacatactctcaccatctgtgcccttcccaagagactcgtccaccttcctctttcccagacttccttgtcatcaattcaccatgtctttcctcaccctgagttatctagccaaactgttagccactgcctattgatcagggttaactgtaactggtcatctctttgcccaggcaaagtaaacaaagcagatgcattctttacaattcggatcactgggagaattttccttccccactgtcctgcagggctgccgtgagtggggtggtaatgctgcagcagcctgctctctgtggtgttagaatagcatgcagaaccacccacacaccagaggaaaccaaatctttcctttctcagtcaactagacataggaaacccttcatgtgactgtgattatggagagagaggttaggaatgtagctggagatgccactggagttacagctgcctactcatgcctcttacttgtgccttgaggaactaactcagccaaattcgcaggcaccacttccattcaaggaggtgagcactgctaagtatgcccagtctagtgtggtggtgcagacaacacccagttcataaagggcagctcatgtttcatgaaccctcgcatgctgaggacccaagattaagtcagatgctaggatgtggaagagggcttgcttttgctccaaaactctggggacctgtgccgtggctcttctactagctacccagtgtctccacacagctttctgatgtaccacagacattttaggcaacattggatctagtcagcaatgtctcaagcagccttatggccttgctttggttcccacttga

SEQ ID NO: 762 - DNA, 11311 bp, Homo sapiens
aagattctgaaaccaacacagcatttactgaagattctaagactaccacagcctctactacagggtttgagacaaccgcagcctctactacaggctctgagcctaccatggcatccaccatgggctctgagaccactatggcctctaccataggccctgagaccaccaaggtctccactgcaagctctgaggtgaccacagtctttgctgcaggctctgagacaatcagagcctctaccgtaggctctgagaccaccacagtctctaccacaggctctgagaccaccacagcctccatcatgggctctgagaccagcacagattctaccacaggctctgagaccaccacagcctctactgaaggctctgagaccaccacagcttccactgaaggctctgaggccactacagtctccaccacaggctctgagaccactacagtttctatcacagactcagagaccaccaccacctgtactgaaggctctgagatgactgcagtctccaccacagtctttgagaccactacagcctctactgaaggctctgagatcacaatagcctctacttcagactctgagaccaccacagcttctactgaaggttctgagaccactacagtcactaccgcaggctctgagaccaaaacagcctatactacaggctctgagaccaccacagcctctaatacaggcttggagaccaccacagtctttaccataggctctgacaccaccacagcctctactgaaggctctgagaccactgcagtctctgccacaggctctgagatgaccacagtctctactgaaggctctgagaacactacagtctccaccacaggctctgagaccactacagtttccaccacaggcttggagaccaccaccacttccactgaaggctctgagatgactacagtctccaccacaggtgctgagaccaccacagactctactgaaggctctgggaccactgcagcctccactgcaggctctgagaccaccacagtctctactgcagattctgagaacaccacagcatctactgcagattctgagaccacctcagcctctactacaggctctgagaccaccacagcctctactacaagctctgagaccaccacagcctctactgaaggctctgagaccactacagtctccaccacagactctgagaccaccatggtctctaccacaggctctgagaggaccatcacctctactgaaggctctgagaccactacagtatctgccacaggctctgagaccacagtctctactgaaggctctgggaccactacagtctccatcacaggctctgagaccactaaagtttctaccacaggttcagagaccaccaccacttctactgaaggctctgagattactacagcctccatcacaggctctgagaccaccacagcctctactgaaggctccgagaccaccacagcctctactgaaggctccgagaccacctcagcctctactacaggctctgagaccaccacagcctctactacaagctctgagaccaccatggcatccatcatgggctctgagaccactatggcctctaccataggctctgagaccaccaaggtctccactgcaagctctaaaatgaccacagtcttcactgaaaactctgagaccaccatagcctctaccacagcctctgagaccaccacagtctccactgcaggctctgagaccatcccagcctctacagcaggctctgagaccaccaccaccacctctactgaaggctctgagaccactacagcctctactgaaggctctgagaccaccacagcctctactgaaagctctgagaccactacagccactaccataggctctgagaccaccacagcctctactgaaggctctgagactaccaccacctctactgaaggctctgagaccaccacagcctctactgaaggctctgagatcactacagtttctaccacaggctctgagaccaccacagcctctactgaaggctctgagaccaccacagcctctactgaaggctctgagctcactacagtttctaccacaggctctgagaccatcacagtctctgctgaaggctctgagaccactacagtcactactatgggctctgagaccaccacggcctctactgcaggctcagagaccaccacagtctctactgcaggctctgagaccaccacagcctctattgaaggctctgagaccactacagtctcctccacaggctctgagaccaccacagtctctaccacaggcactgagactaccatcacctctactgaaggttcagagaccactacagtcactactgcaggttctgagaccacagcagtctataccacaggctctgagactaccaccacctctactgaaggctctgagacaaccacagtctctaccacgggctctgagaccaccacagcctctaccgcagatttggagaccaccacagtctccacctcaggctctgggaccaccacagcctctaccgcaggctctgagaccacaacagtctatatcacaggctctaagactaccaccgcctctactgaaggctctgaggccactacagtttctaccactagctctgagaccaccacagcctctaccacaggctctgagatgactacagtctttaccacagtctctgagaccaccacagtctctaccataggctctgaggccaccacatcctctgctgcaggctctgaggccaccaccacctctactgaaggctctgagaccaccacagcctccactgcaggctctgagaccaccacagcctccactgcaggctctgagaccaccacagcctccacttcaggctctgagaccaacacagcctgtaccacaggttctgagacctccacaccctccagtgcaggctctgagaccaacactgccttcatcataggctctgagagcaccatagcttccactgcaagcttggagcccactgcaacttccctcacaggctctgagaccaccacagtctctatcacagcttctggggccactgcagcctccaccactgtctcttccaccacgtttgtactcaccaaggccactgacgtttctatccagcccatcaccaacacacctatgtcaggtactaacccccatgtcttctttgagcccacacattttaactccagtggcaaccaccagctgttcacctgtttctatcatctctgccctggttcaagtcaagccagcacacagttagatataatttcctcttctaggctgggcgcggtggctcatgcctgtaatcccagcacattggaaggctgaggcgagcgaatcacgagatcaggagattgagaccatcctggctaacacggtgaaatccagtctctactaaaaatacaaaaaattagctgggcgtggtggcgggcacctgtagtcccagctactcggaaggctgaggcaggagaatgatgtgaatccgggaggtggagcttgcagtgagcagagatcgcgccattgcattccagcctgggcgacagagcgagactccgtctcaaaaaaaaaaaaaaaaatgtcctcttctggaatcctaattgcctctactctggtctcacctctttttttttaagtgcccaccacttccattgcaatcagaaccacaatatagtaaaccacaagtgcatcatatctgtcacatcttcctccagcaagcccgcctcaactctactggcccatcacagttttgtgaaatgctcccacttcggtgccaagtagattatctctattcaaccaaccatctgtgacactgccacctcctatcaatgtattgactctagaccagaggctggcagaccacatttcatgggtcaagtctcacctgttacctggttttgtaaagttttactggaacatagtcatgcccattcatttatggtttgtctccagctgcttttctgcttttccgtgtatttgcaacagagacagcctggcccaaaagcctaaattatttgctgtttggacctttacagaaaaaatttggcaacctttgctccagtctgagaccaaacaattttgttcattctctggcacttgccatcagcaagccggttacatctgattctatcctcttggttctaagcatactcacttctattctcatgactggtgctgtttgtgatcccattttaaccacttctgacctaggcacacccatcgctacctaagccgccaccaccgcctctgctgtgttgattcgtgctcacacctgtctgagcccaccctctcctatccctgtgagcagccttctccacttgggtcaggtcctcctacatctgcccaagcacactcacctcacctttgctgatcaccacagtgtggtagatgatgtcacctctgtcccagccacggccactggcatgcccatgagtgaatccaattctaccatctcctcctccagctccctccttacacccagtgatcacagtcacaaaagaagcagggcctgccgctttgtataccagcccacccacttatttgatctgctttgatttatttattttcaattttttccataagttattgggatgcaggtggtatttggttatatgaataagttctttagtggtgatttgtgagattttggtgcacccatcaccctagtagtatacactgcaccatatttgaagtcttttatccctcgccccctcccactcttcccccaaagtccccaaagtccattgcatcattcttatgtcttcgtatttccatagcttagctcccacatatcagtgagaacatacgatgttcggttttccattcctgagttacttcacttagaagaatagtctaaaatctcatccaggtcactgcaaatgctgttaattcattcatttttatcagcccaccctcttctatttgggtggccacttctgaagtcaaatagatcttccacttctgaacccatcgcgataacgtttcctcaaacttctgcctcctccatcaccaactccaccaggtgacacattctacctccttctctgtatgacacccacctgcattctggggacatggccacagcagaatcgctttctaccatctctcctcccccaccacacctctcctgagccacctccaccataggtttgttagattcaccctcctctggtctaagcacccccattcccctttaatcatctctgctacaaatgcatcatcttgtgtgacctgtttcataggcaccagaaccactggaaccagactcactgcctccagctctgtcaccatggcccctggaatggacttcacggcctctgctgccagccatactgtgccaggaatagtcttaaacacctctggcctgggtacatccactatgggagcatcatctaccacctcagcccacggcgtcaggaccaccacaggatccacccgtgagccaaccagcagcaccttccaggaaacaggcccggtgtccatgggcacaaacacagttagcatgagccacacacccacaaacgtgatcaaaccaagtggatatttacagccctgggctatcatcctcatttccctggctgcagttgtggctgctgttggattgtcagtaggactgagtttttgtctggtgagtacccagggtgggttcataggggagcctggcaagaaggcaggggggaatcatgtcagcagtgctttggaaaaatccagaatgagaaaggggagtaagttggtgcgctcagaaggaaagaatcacctagcctgatataaggaccagagagaatgcttaagtcagagaaagtgagaagcaaagtagaaaaagaggagggaaaagatggagttggggccaaagtgaagggaaatactgacagaacaagggaaatactgagagagaacaaggaggacataaacataaagaaagcaagaagcagctgggcgcagtggctcacccctgtaattccagcactttggaaggccaaggagggcggatcacttgagtccaggcatttgagaccagcctggccaacatggtgaaacttgtctttactaaaaatacaaaaattagtcgagagtggtagcatggacctgtagtcccagctactttggaggctgaggcacgagaattgcttgaacctgggagatggaggttgcagtgagcagagatcgtgccactgcactccagcctgagtgacagagcaagatcctgtctcgaaaggaaggaagaaagaaaagaaaggtaggaaggaaggaaggagagagagagagaaaaagagaaagaatgaggaagaaaggaagaaagcaagaaagagaaagaaaggaagaaagaaagaaagaaactgagagagaaagagaaagaaaaaagaaagaaggaaagaaagagagagagaaatagagaaaagaaagaagcataaaaatgttcagccatccaaaatgcgggcttccgattgtctcatgtatgacaaatttctggtcctcacagcaattccttgtgtggcctgtgactgttactctctgacctcccactccatctctgctctctggtcttgattgttctttgaatacatatttttcttacatcgatttcacatttattgatgttcttcctgttttcttgtgatcctgcgggtaagttaccatttgaggagtgaagcagagtataaatcagtggtgtgctggagctggctcatcctggcccacaagagattgtgcagttcttcccaattctgagctgagtgatgtgacactggtagcttaaaatatgctgggttggaaatacttacaccacagcaattgtcaaacactacaaatcagcacttttccctcggagagcctgttattaagtgttggacagcataccactggtaaaaatggacaaaatgaaaaatacggaagtcacaaaagatttggataatatagtcaatttgctgaggttctttgttttagaattctcagcctctctccgtatgtggactacataataaataccagcatctaagaattactccctaaattactttattatttcatttgcaagatcaagagagaataacgaaagtgaacattgagtttttactgcctgctaggctcaaggctgaatgtttaaaatgcataatgttatttaatctggcctacaatcccgtggccatattatattcatcttacaagtaagggatctggagcttcatgatcttagctatttgccccagcacatgtagtgagtggcagatataagactctaactcaggttagttggattctggagttcatgcctataatctcaaggctctgtgtagacagctttctagagctctcaattccacgtacctgttctgagctttcttagctgactaacaaagagaaagactgtctgtaaagtgagtctctgtgcctttcacataggggtatggatttacctttgtcttggaagtccaaaaacacataaccttatgatctgcagagctagggcctgagtacgcacataaagatgatatgttaataaggtaacaaggaagcttattttgtcagacggagaaagagtaaaagaacaaggaaaaagagagacagagacagagatcatagtaaggatggtggtaaagagaagagaacatgggcagtttggaaaagtgaaaatctgacattggtgaaacaggcatgtatggtgattagggagaggagacttaattttcatttatcaatgtatttatttttttcttttagagaaaccttttcttccccctgagatattgtggtatttattacccccatggccacagccacagccttggtctggacctgaacttgggcctgggctctgggacattccacagcctgggaaatgcactggttcatggaggagaacttgaaatgggacatggaggaacacacggctttggatatggagtgggccatggactgagccacatccatggagatggctacggagtgaatcatggcgggcattatggacatggaggaggccactgaggacaccatggagtggatcacagagggagccaccaaggaggccacggcaggacaagatggctgtggccatagattgggtatcaaaacatattatgggtgggagggggtcatggaggagaaaaaaataatgatcatgaaataattaaaatggagcataggaagcttcccaggatgtgatccatggagatggacatggactaggtcaagaaaagaaccagcaaaaggacctcagagactttgactggcttggaggggacttcaagtcaaagcttctgtgagtttttcctgagtctcagcctctgttgtggggagtcacgacaaccaccctcaggacatcttctctcccatttcccgccacatcagggtcaacgtttctcatccctgtgtttcctcatggtgctataaatattaccaagacatgtctaagaaacaaaagcacataatgaatgtattatcagggccacacacgtattcgttttcctgtttgttctttcaggttttgttttttttttttttttttgagtgcttattatgtaccaatcactatcccaggagcctttaaatacgtcatcatttggctgggtgtggtggctcacgcctgtaatcccagcactttgggaggccaatgcgggtggatcacttgaggtcaggagttcgagaccagcctggccaacatggtgaaaccccgtctctactaaataaatacaaaaatcagccaggcgtggtggcgagtgcctataatcccagctactcgggatgctgaggcaggagaatcggttgaatctgggaggtggaggttgcagtgaggcgagattgtgccactgcactccagcctgggcgacagaggaagactctgtctcaaaaaaaaaaaaaaggtcatcatttaatcctcagaaaatatcttggtgaccttgaggtaggcaaagatacttagatacttaagcaagacacaaaaagcactagctattaaaagaaagtgtgatgatttggacttcattaaagcctagtatcagcatatacctttaagaggtatattcttaactataaaaggaaagtcaaagatgggagaagatattgcaacacatatagctaacaaacgactcatatccagaatgcagaaagagctacaataagaaaaagatgatgcaattttaaattgggcaaaatatttgataaatagttagcaaaagaggatatcaaaacagccggtgaacatttgaaaaggtacccaatatcactgcttatcagaagtggaatgtaaaaccgcaatgagataccactacatacacacactgtaatgactagcatttgaaagactgccagtaccaagtattggaaaggacattgaacaactggaactctcacacattgttagtgggagtgtaaattgatacaattatcttgggaaaatgtttggcaatgctaaaattaaacacataccctatgactcggtacttccactcctgagagtaaatatccagcagaaatgaatacctgtgtccaccaaaagacatgtaccatgccagcttcattcataccactgcagggtggaaatttaaccccaaagtccactaacattagaacaggtaagtaaattgtgacatattcatgcagtggaatgctacccagtagtgaaaaaaaaaacctatgaaatcacacaataacattaatgaatctcatagtcagtgttgagtaaaagaagtcaaaacaaaagtgtacctactgtataattccattcacatgcagttcaaggccatgtgacattaacctgttgtaataaaggtcagagttgaggatgccttgggggaaaaggctgaccgggagaaggcatgagaaagccttcttgcaggggcagacaggggaagctgagaatgttctgtgtatgatctgggtggtgattacaagggtgtatagatatgtaaaacttcattaaaatgtgcacatgagatctgtgcactttatggtatgtaagttatgtctcaatttgaaaaatgaaaaagatattctgaggctattttctcagcatattatgatttccttggtcagagaatgtggttggagacacatgacgataaatgaggcatttggtaagcccaaagacagtggtgctgcaggaagcattgtgtgcaagggaggcaagcagctattttcaatgaggacaaatcacctctctctttaggttgaaataggtctgatataattaatctgccattctctctggagaatggtgccacataacggggccaacactgatctctgctgttagcagttgaggcactcagccatggattatctgtccagcttggccttggtgaggggaaggccagctcactgagccttgcatacgcttcatccctgccagcctgtctgctttgtccatgtccctgctgagcgagcactagagcagctggaaaaagagattggctgacgtctgcagaatggatcgcttggtcaacctcatcatggaagatttcctctgtagtgaacgcccattggtgaacagtcacatgggatgcacatactctcaccatctgtgcccttcccaagagactcgtccaccttcctctttcccagacttccttgtcatcaattcaccatgtctttcctcaccctgagttatctagccaaactgttagccactgcctattgatcagggttaactgtaactggtcatctctttgcccaggcaaagtaaacaaagcagatgcattctttacaattcggatcactgggagaattttccttccccactgtcctgcagggctgccgtgagtggggtggtaatgctgcagcagcctgctctctgtggtgttagaatagcatgcagaaccacccacacaccagaggaaaccaaatctttcctttctcagtcaactagacataggaaacccttcatgtgactgtgattatggagagagaggttaggaatgtagctggagatgccactggagttacagctgcctactcatgcctcttacttgtgccttgaggaactaactcagccaaattcgcaggcaccacttccattcaaggaggtgagcactgctaagtatgcccagtctagtgtggtggtgcagacaacacccagttcataaagggcagctcatgtttcatgaaccctcgcatgctgaggacccaagattaagtcagatgctaggatgtggaagagggcttgcttttgctccaaaactctggggacctgtgccgtggctcttctactagctacccagtgtctccacacagctttctgatgtaccacagacattttaggcaacattggatctagtcagcaatgtctcaagcagccttatggccttgctttggttcccacttga

SEQ ID NO: 763 - DNA, 81360 bp, Homo sapiens
ataatttgtatgacaatagcacaaaaaggggaagaaaatgcagttatattggcgaaggggtttttttttattttattgacacataatcattgtacgtatttacggggcacagtgtgatattttaatacaggtaaacagtgtgtaatgatcaaatcactaaaattgacacattgatcacttcaaatatttatcatttctttgtactcaaaaacactcaaaatctgctctatttgaaaatataccataaattattgtcaattatagtcaccctatggtgctataggacattcaaattatttctcctttgttagctgtaattttttttttttttttttgagacagagtctagctctgtcacccaggctggagtgcagtgttgccatctcagctcactgcaacctctgcctcccaggttgaagtgattcttctgcctcagcctcctgagtagctgggactacaggcatgtaccaccatgctcagctaatttttgtatttttagtacagactgggtttcactgtgttggccaggctggtctcaaactcttgagccaaggtgaactgcctgcctctgcttcctaacatgctgggattacaggtatgagccaccgcacctgatctgtaattttgtatctgttaaccaaccactctctatcctctcccatccttctcagcctctagtaaccgttattctactttcttttcttttcttgtttttgttttttgttttttgttttttgagacagagtttcacttttgttgcctaggctggagtgcaatggtgtgatctctgctcactgtaatctctgcctcctgggttcagcctcccaagcagctgggactacaggcatgagccagcatgcctggcttttttttttttttttttttttttgtatttttagtagagatgtggtttctccatgttggtcaggccggtctcgaactcccgacctcgggtgatccacccgcctcattattctacttccacgagatcaacatttttagctttcacatataagtgagaacttgtggtatttatcttcctgtgcctggcttatttcacttaacctaatgttctctacgctcatccatgtgaccccaaataacaggattttactctttttaaggctgaatcatatttcattgtgatctataacacatatttatccattcatctgttggtgaacactcagattgattccaaatcttggctattgtgaaaagtgctgcaatccacacgggagtgcgggtgtctgttcaacacagagacttccttttctttggatatatatgctagagggggattgctggatcatatggttgttgtatttttcatttttttgaggaactcccatactgttttctacaatgatggtactaatttacggtctgtcaacagtgtctaagcgttcccctttctccatctcctcaccagcatttgttatttttgtcgttttgataatagctttttcttttttttgagatggaagttcactcttttcacccgggctggagtgcagtggtgcgatctccgctcaccgcagtctccgcctccccgattcaagcgattcttctgcctcagcctcctgagtagctgggattacaggcgcctgccaccacgcccagctaatttttgtatttttggtagggacagggtttcatcatgttggccaggctggtcttgagctcctgacctcaggtgatcctcttgccttggcctcccaaagtgctgggattacagtcatgagccaccacgcctggcttttttttttttttttttttttttttttttttttttgagagacagagtcttactcttgttgtccaggctggtgtgcaatggcacgattttggctcactgcaacctctgcctcctgagttcaagtgattctcctgcctcagcctccccggtagctgggattacaggtgcttgccaccatacctggctaatttttgtatttttagtagagacggggtttcaccatattggccaagctggtcttgaactcctgacctcaagtaatccacccaccacagcctcccaaagtgctgggattacaggcgtgagccaccgtgtctggccaataacagctattctaactggggtgagatgatatctcattgtggttttgattcaccattccctgattattagtgatgttgagccttttttcatagatcttgagccatttgtatgtcttcttttgagaaacgtctatttagctcactgcccattaaaaaagttggattatctgttttgctgttgagtgtttgagttatttttatagtctagatattaatctcctgttagataagtagtttgcaaatattttctcccattttgcaggttgtcttttcactctgtcaactgtttcctttgttgtgcagaatctttagtgtgacataattccatttctctttgttattgttgttgctgcctgtgctatttttttttttttttttttttttttttttggacacggagtctcactctgttgcccaggctggagtgtaggggtatgatctcagctcactgcaacctccacctcctaggttctagccattctcctgcctcagcctcccaagcagctgggactacaggcacatgccaccacgcctggctaatttttagatttttagtagagatgggtttcaccatgttggccaggctggtctcgaactcttaacctcaagtgatctgcccacctcagcctcccagagtgctgggattacaggtgtgagccatcgcagctgaccaagatcttgttaataaaaattttgcccagaccagtgtcatgaagtgttttccctgtgttttcttctagtaatgttatagctttgggtcttatatttaagtcttatattcattttgagttgatttttgtatatgacgagaaatggggatcaggtttgatccttctgtttatggatacccagtttttcaaccatttattgaagagactatcctttccccaatgaatgttcttgatgcctttgtcaaaattgcatcacctggccaggcacagtggctcatgcctgtaaacccagcactttggaaggctgaagtgggtggactgcttgagcccaggagtttgagaccaggctgggcaacatggtaaaactctgtctctacaaaaaacacacacaaatagctaggtgtgatggtgcatgcctgtggtcctagctacttgaaaggctgaagtggaagaatcacctgagcctggggaggtcaaggctgcagtaagctgtgattgcaccactgcactctagcctgggtgacagagtaagaaaccatctcaaaaaaaaaaaaaaaaattcactgtagatgtacggatttatttctgggttctctattctgttccattggtctgtgtgtctgtttttatgccagtgccatgaggctttaattactgtagctttgtagtatattttgaagtcatttagtgttatgccttcagcttcgttcttgctcacgactgctttggctatttggagttttttgtggctctatatgaattttaggattgtttttgctatttctgtgaagaatgtcttggtattttgatagggattgcattgaatctgtagattgctgttggtggtctgatcattttcacagtatgaattcttgcgatccatgagcataaggtgtctttgcatttttctgtgtgtcctcttcaatttatttcaccggtgttttatagtttccctttcagagacctttctcctccttggttaactttattcctaggtactttttatagctactgtaaatgggattgctttcttgactttttttttcagctagttcattgtcaatgtatagaaatactgctgatttttgtatgttgatttttatatcctgcaactttactaaatttcagttctaaaagttttttggagccgggcacggtgtctcacacctgtaatcccaacactttgggaggccgaggtgggcagatcacaaggtcaggagttcgagaccatcctggccaacgtggtaaaatcccatctctactaaaaatacaaaaattagctgggcatggtggcgtgcgactgtaatcccagctacctgggaggctgaggcaggagaattgcttgaacctgggaggcagaggttgcagtgagccgagattgtgccattggactccagcctgggcaacagacggagactccatcttaaaaaaaaaaaaaaaaaaaaaaattttttttggtggagcttttaggattttctatatataagaccatgttgtctggaaacagggatgatttcacggctcttctctagtttgaattccctttatttctttctcttgactaattgctctgtctaggacttccagtactattgaataagagtggcgagtgtgggcatttatatcttgtcccagttccaagaggaagagctttaagcttttccccattctgtatgatgttagctgtgggtttgctatatgtagccttcattgagcggcagtacattcgttatatgcctatgttgttcagagttttgtcataaagcaatgttgaatttcatcaaatgctttctcagcatctcttgagatgattatacagtttttgtctttcgttctgttgatgtaatgtgtcacatttattgatttgcaaatgttgaaccatccttgtatctctgggataaatctcacttgatcacagtgaaggattttttttttttttttttgagacagaatctcactctgtcacctagtctggagtgcagtagtgcgatcttggctcactgcaacctccgcctcccaggttcaagcagtacttctgcctcagcctcccaagtagctgggattacaggtgtgtgccaccacgcccagctaatttttgtatttttagtagagacagggtttcaccatgttggccaggctagtctcgaactccagacctcgtgatctgcctgcctcggcctcccaaagtgctgggattacaggcatgagccaccgcgcccggccgtgaaggatctttataatgtgctgctggatttggtttgctagtattttgttaaggatctttgcatctgtgttcatcagggatattggcctgtagttttctttttgtgttgtgttcttgtctggttttcgtcttagagtaatattggccttgtagaatgatattggaagaattccttcccttcgattttctggaaaagtttgagaaaaattggcattggtactttaaatgtttggtagaattcagcagtgaatctgtggttcttctttgatgagattttttttttgagatggagttttgctctttttgcccaggctggagtgcattggcacgatcttggctcactgcaacctccacctcccaggttcaagtgattctcctgcctcagcctcccgagtagctcggattacaggcacgtgccaccacgcctagctaatactgtatttttagtaaagacagggttttaccacattggtgaggctggtctcaagctactgacctcaggtgatctgcccacttcggcctcctaaagtgctgggattacaggtgtcagccaccagacccggctgaatttttttttttttttttttttttttttagacagagtctcccactgtcgcccggactggagtgcaggggcgcgatctcggctcactgcaacctccacctcctggattcaagcgattctcctccctcaggctcccgagtaggtgggattacaggcacttactaccatgcccagctaattgtttgtatttttagtagagagagggttttaccacattggccaggctggtctcgaactcctaaccttgtgattcacctacctcagcctcccaaagtgctgggattatgggtgtgagccactgcacctagcccaacttttttttttttagacgaagtcttgctgtgtcacccaggctggagtatagtggtgtgatcctgcctcactgcagttgcgaactcctgggctcaagtgatccttctgcttcagcatcctaagtagctgagaccacaggtgcacaccatcatgtctggttaattgtttaatttttttccccgcaggaacagggtcttgctttgttgcctaggctggtctcaaaaccctggcctcaaggtttactacatgcatacaatgtgtattgatcaaatcagggtaattaggatatccatcacctcaactatttgtcatttctttgtgttggaaacattttaaatattttcttctagcgattttgaaatatacaataaattattgctaactatagtcacccaactgtgctatgaaacacaagaacttattccttctatctaactgtatttgtgtacttattaaccaatttctcatcactccctccttcattctgtttcccactggagtgcagtagtatgatcatggctcactgtagcctctctttctcctctaactaaatgatttcaaatgacttatcttcatcttcatgttcattgattttttgttttgttttgttttgagacaggatctcactttgtcacccagggtagagtgcagtggtgtaatcatgggtcactgcagccttgacttcctgggttcacgtgatcttcccacctcagcctcctgggtagctgggactacaggtgtacaccaccataccctgataatttaaaaaaaaattttttttttaaatagggttttgccgtgttgcttatgctggtcttgaactcctagcctcaagcaatctgcctgcttcagcttcccaaagttctaagattacaagcataagccactgctgttgaagctctaaatggcattttttcattttagtccttgttcacctcagctctagaatttctttttttgtgatttctgtatctctgttgaactttacattttgttcatatattgtttatctgattttgacgagttgtatctgtgttctcttgtaacatgctgagcttctttaaaacagttattttgaattctttttcagttaattcatagatctccttttctttggggttggtcatttgaaatgtgttgtgttcctttggtgatgtcatgtttcttttctatgcagttattcttggcttttctgctctactcggtggctgcatctttttaactggactctgggagttctcccagagctattttagtctgtggatagttgttaaatcattgtttttgtgggagtacaagggctaggacctcctagtccaccatcttgatcacattacaccaagaatcagtccactctgagatcatccgtcttctggccaccctttggtttacattttaagaaaatgtggacagagctgtaactttcctctcctctctccagagagctgcctacctctctggagataggtattttggctattcatttcctaggttcaagtttatcccaagacttgtacagtctcttcatcactgcagggaggtggcctcttatccccttagcccagaagtttcagattcccccaggattcggcagttttgaattcccaactcttccactccctctcatccctccagccctcatccttcagagaccatcctgtcacttaggcaccacagtgttgggggagaagatcagtaatgaggccctggggctttggatcaagccagacccttaagtgggccctgggaaacctattaagtaactattttcttattaagagtataagtattcccttcttactgggaatagaagttgaaagattgacagagataagggagaaaggtgtggtagagtccgtctcctcccatttcctacaaaatccttctacagttgactccgctcttacttttgtttacagaggagctgacgtttcatctgggcctgaagaatgagtaaatttccaggtgggaaaaggtcattgtgatattggagaggtatgtataagaatggggaaaatggtccagtatggtggctcatgcctgtaatcccagcactttgggaggccaagttaggtggatcacctgcggtcaggagttcaaaaccagcctgaccaacatggtgaaaccccatgtttctaaactaaaaatacaaaattacccaggcgtagtggcacgtgcctgtaatcacagatacttgggagtctgaggcaagagaatcacttgaacctgggaggcggaggttgcagtgagccgagagcgtgccattgcactccagcctgggcaacaagagtgaaactccatctcaaaccaccccctccccccgccaaaaaaaaaaatagttctgggagaaatgagtgagtggggcacattcaggttgttgtatagctcgtaaggaatgaggtagaagatggtagaggttgagaccacaaagctatgctgggtccatattgtgactgttggaacctgggcttcttccattcagaatccaagtcatcttctcctcaacttaaagttgatctcttcctctcttaggagtcattgttaggacttgtattccttccaggataggaaggtgaccaattgagcctggccaactaaagagtggagagttagagaaggctggaactcaggtatgatggtcttgagtctggacatgtccattactggcttgttgttttttagcctcccagctaattaatcagagtcaataacattattagcaatgctttaacaacccttacctagtacttcctatgttctaacactttatatccattaactaatttggtcttccttcctctacaaaatcgattccactgtgatcctcattttgcagttgaggaaactgaggcagagggttaagtcacttgtctctagttagtgggagagcaaagctttgaccaaggcagtctggctcaaacacacactctaatcactctgctagggggtctcacgctggtatgtgagatgaaatttttagagacagggtctcgctccatcacccacactggagtgcaatggtgtgatcgcgtctcagtgtagccttgaattcctggattcaagtgatcctcttgtctcatcctcccaagtagctgtggctccaggactacaggtgcactccagcatggcaggctaattttaaaaaaataaaattagtaaagacgagatctttctatgtttcccagactggtcttgaattcctggcctcaagctatcttcccaccttggcctctcaaagcgttgggattacaggcgtgagccaccatgcctgccatggatgtcttattttattttatttatttttttgagacggagtctcgccctgtcgcccaggctggagtgcagtggcatgatctcggcttactgcaacctccgcctcccaggttcaagtgattctcctgccccagcctcccaagtagctgagattacaggcacccgccaccatacccagctaatttttgtatttttagtagagacagagtttcaccatgttggccaggctggtctcaaactcctgacctcatgatccacccacctcagtctcccaaagtgctgggattacaggtgtgagccaccgtgtctgtccagatgtctcttttaaatgagtgttacatactctagtcttctttctccagggatggttccttttggggtgtgggtgccagggactgagttcaaagctcttgatagaattcaccaactgagattgggcgcggtggctcacgtctgtaaccctaacactttgggaagctgaggcgggtggatcgcctgaagtcaggagttcaagaccagcctggccaacatggtaaaaccccgtctctactaaaaatacaataattagccaggcacggtggcaggcacctgtaatcccagtttattcaggaggctgaagcacgagaatcacttgaacccaggaggcaaaggttgcagtgagctgaggttgtgccattgcactccagcctgggtgaaaagagtgaaactcagtctcaaaaaaagaattcataaacatcccagtctccagaaccatgagtcaaataaacttctgttctttataaattaaaaaaaatgcaccaatggctgggcatgctggctcatgcctgtaatcccagcactttgggaggctgaggtgggtggatcacttggggtcaggagttcgagaccagcctggccaacatggtgaaaccccatctctactaaaaatacaaaaattagccaagcatggtggcacacgcttgtaatcccagctattcgggaggctgaggcaggagagtcacttaaacctgggaggcagaagttgcaatgagccaagattgcaccattgcaccccagccttggattacagagcgagactctgcggaaaaaaaaatatataaaagaattcacccaactgaaacccatgtttaaagtaaagagaaaatcctataaaaagggagtcttgggtacagaaggctggtggggcacagaagattccaaatctctctctctcaatctctcctctctcttttgtagcccagagcctggtgagctacctgagcagggggcactccatccaatgtcttcacttttaatttccctggtacctacaacctctggtcacgtgcctcattctggttctgcacttctttttctctgtgtgcctctgagtctctctttcagtcccttttcattttctccgcatttgggtgggaagatacagactgataagagagacagaacggcagcatccccctacatacaagaacagactgaaatcagtcagtcctagggacaggtcccagctcagagagaagctatatgactcctttaccaagtcagtctctctaaggctcagcttcctccaccgtcaattacgttattttttaagagaccagagtattgctctgtcatccaggctggagtgcagtggcacaatcatagctcactgcagcctcgaactctcagactcaagcgatcctcctgcctcagcctcccaagcagctgagactataggcctgcaccaccacacccggcctctcctctgtaaattaataataagaatgcctactaccacacactagtcttgcaaagattaaataatatcatgcttggccgggcgtggtggctcacacctgtaatccaagcactttgggaggctgaggcgggtggatcacttgagatcaggagttagagactatcctggccaacatggtgaaaccccatctctactaaaaatacaaaaattagctgggcatgatggtgggtgcctgtaatcccagctactcagcaggctgaggcaggaaaatcgcttgaacccaggaggtggaagttgcagtaagctgagatctcaccactgcactccagcctgggtgacagatcgagactccgtgtcaataaataaataaataaatagataaataaataaatgtattgtgcttatggtgcacttagcctatctcttgcccattgtaatggctcaacaaatagcagtaataataacagcagcaggcgttgctgttttctgttctctcactcccatcggtatttagagggaatacggggatattgccgaggaagggaaagttggagacaatgtcagcgtctctgggccattgtccaggaaagcacggaggaaaagctggggttgggggcccggggactgggaaaggggaaagagagatggggtggaaacgtaaagccatccagggtcttggaaacggagcagctaggaggtgatgcttgtctatggcatgcctctgccacccagatacctgcattttcttctctcccccactggttatttactctctccagatatgtcttccatcctgagattttcagccggtgtagactgtaacaagcatgtgatgagccagaagcaaagtaaaaggactaaggacatcttgcgatttgggtaatttttattcattaacacttcctgggccgggcacggtggctcatgcctataatcccagcacattggaaggctgaggtgggaggattccttgaggccaggagttcgaggccagcctgagcaacatagcgagacccctgtctctacaggtaattttaaaaattagctgggcatggtggtgtgcacctgtggtcccggctactaaggaggcttaggtgggagaatcacttgagcctgggagattgaggctgcagtgagctgtgatcatgccaccgcactccagcctgggtgacagagtgagaccttgtccctacaaaaaataagacttcctaaatacaggaagcactgcaggagatgttttctatacatcatttaaattaatcgctaaaacaggccaggcgcagtggctcagcctgtaatcccagcactttgggaggccaaggcaggtggatcacctgaagtgaggagttcaagaccagcctggccaacatggtgacacccagtctctactaaaaataccaaaaaaatttttttaaatttagccaggtgtggtggtgcacacctgtaatcccagctactcaggaggctgaggcaggagaatcgcttggacccggaggcagaggttgcaataagccgagatcatgccactgcactccaggctgggtgacaagagcgaaactccatctcaaaaataaataaataagccgggcgcggtggttcacgcctgtaatcccagcacttttagagaccgagactggcagatcacgaggtcaggagatcaagaccatcctggctaacatggtaaaaccccatctctactaaaaatacaaaaaagccgggcgtggtggtgggcacctgtagtctcagctactcagaaggctgaggcagaagaatggcgagaactcaggagatggagcttgtagtgagccgagatcgcaccgctgcactccagtctgggcgacagagcgagactctctctcaaaaataaataaataaataaacaaaccaaaacaatcctgtgggtttaaggacgttgctgatgcttgaaaatgttaaaaaattccccctaagctctcccgactcataaatgaaagagttaagaggaaaacgcagatatgaacccaaagctcctgtttgtcccttcactgtgccccaggcgaagacaaaagctaggctcctgcctcagggaactggaaaatttgatcttggggcactctcagtggccacagcccttgagttcctcatcaaggtgggtagatgaagaatctaaaacccagagaaaaaaatgtaacttgtcaacatcacatgccattccacaggccagacaggaacagaaaccaagcctttagactccagcccccagacttccctgaggtgaccccagaattggatgaagaaggcaaccacatctcagattgcactgtacactggcaaacagctgtgcaaatgggcacttacacaaacaaattcgtatagctagaaagagctttttcttttttcttcttgagatggagtctcacttttgtctcccaggctgcaatgcagtggtgcaatctctgctcactgcagtctctgcctcccgcattcaagcaattctccctgcctcagcctcccaagtagctaggattacaggcgtccaccaccacacctggctaattttttgtatttttagtagagatggggtttcaccatgtttgccaggctggtctcaaactcctgaccttaggtgatccacctgcctcagcctcccaaagtgctgggattataggcgtgagccaccacacctggccccttccccaactgtttttttttttttttttaagagacagggtcttgctctgttgcccagactggactgcagtagcttgaacatagctgccttcagcctcgaactcctggactaagcgatcctcccacctcagcctcccaagtagctgggtctactggtgcacaccaccatgcctggctgaattttaaattgtttgtagagacgaggtctttctgtgttgcccaggctggtcttgaactcctaggctcaagtgatctacctgcctcggcctcccagaacgctgagattacaggcatgaatccctgtacccagctaaaagaggctttttggtatgtacattggtctgaggcccttctaagatctgtgaatgggtgtctgtgaataggtatcatattatgcatcacttaacgcctgccttactgacttacaattctaaagtaaactgatgtcttcaaacttttttcgagaaagggtcttgctctgttgcccaagctggagtgcagtggcttgatcacagttcatagcagcctggctctgccaagaccagctcggtcgtggagaccctaacccagcggcgctagaggaattaaagacacacacacacaaacatagagtgtggagtgggaaatcaggggactcacagccttcagagctgagagccccaaacagagtttgacccacatgtttattgacagtaagccagtgttaagcattgtttctatagattatagattaactaaaagtattccttatgggaaacaaagggatgggccaaaacaaagggatgggctctggctagttatctgcggcaggagcatgtccttaaggcacaggtcgctcatgccattgtttgtggtttaagaacgcctttaagcggttttccaccctgggtgagccaggtgttccttgccctcattccggtaaacccacaaccttcagcgtgggcctcatggccatcgtgaacatgtcactgtgctgcagagattttgtttatggccagatttggaggcctgttcccaacacggctcctgaaacaaaatgtgttttctttttttaaatacggtttaccttggaaataaaagtataattacaaacataactttcctttttttttttagagatgaggtctttgctctgtggcccaggttggagtgcagtggtgcagtcatagctcactgcagcctcaaactcctgggctcaagtaatcctcctgcttcagccttccaaataggtgggactacagatgcgtgccaccatgcctggctaatttttaaattttttgtagagatgaggtctccctatgttgtcaaagctggtctcaaacccctggactcgagatcctcccacctctgcctcccgaagtgctgagattataggcgtgagttgctgtctggcacaaacacaactttcaatggaaccataaagtatcagaaccagaggccgcatgtggtaatcccaacactttgggaggccaaggtgggcagatcacctgaggtcaggagttcgagaccagcctggccaacatggcaaaacctcatgtctgctaaaattacaaaaattagctgggtgtggtggtgcatgcctgtaatcccagctacttgggaggctgaggaaggagaatcagttgaacccaggaggcagatattgcactgagcctagctcgcgccactgcactccagcctgggcgacagagcgagactctgtctcaaaaaaaaaatatctgaaccagaagaaacataaagatcatctatttgggccaggcgtggtgggtcatgcctgtaatcccagcactttgggaggccaaggcgggcggatcatgaggtcaggagatcgagaccatcctggctgacatggtgaaaccccgtctctactaaaaatacaaaaaattagccaggggtggtggcgggggcctgttagtcccaggtactcgggaggctgaggcaggagaatcgcttgaacccaggaggtggagcttgcagtgagccaagatcgcgccactgcactccagcctgggcaacagagcaagactctgtctcaaaaaaaaaaaaaaaaaaaaaaaaaaaacatctggtccaactcttattttctggtgaggagacgagctcatacactgatcagctcacccttacacggtagatgttcaaagatggatttcatggttctcaatgcagtggctgttagtctaagctctaaaaaagtaacctcaacatactaacagcctcctgtgaggagaggaaccattagttaaatatcaaggaatggctctgatgatgaaatgtatcagcctgatccggtagtttgctggacattggtgggcatccaccctggtgggtgtgtaagtgtcttgaagcagggcgtcaacctagccaggtaaggcttctgagggaaggcgagtttgtgttcagtttcaaaggggtaaagtttttaaaaattatttcaataggtatttggggaacagggggtggttggttccatggataagctctttagtggcgatttctgagattttcgtgcacctgtcacccaagcagtgtacactgtacccaatgtgtagcattttatccgcccccatcccaaccttctctccaagtccccaaagtccattgtatctttctattttcttttttttttttttttttttttttgagacagagtctcgctctgtcgccaggctggagtgcactggcgcgacctcggctcactgcaacctccacctccagggttcaagcgattctcctgtctcagcctccctagtagctaggatgacaggcatgcgccaccatgcccagctaatttttgtatttttagtagagacggggtttcaccatgttggccaagatagtcttgatctcttgaccttgtgatctgccagccttggcctcccaaagtgctgggattacaggcgtgagccaccgtgcccatcccattgtatcattcttatgcctttgcatcctcatagctgagctcctacttacaagtgagaacatacgatgtttggttttctattcctgagttacttcacttagaagaatggtctccaactccatccaggttgctgcgaatgtcattatttcattcctttttatggctgagtagtagtcgatggtatatatatacacaccacattttctttactcattgactgttgggcatttgggctggttccacagttttgcaatttcaaattgtgctgctataaatatgcatgtctttgtcatataatgatgtattttcctctgggtagatattcaggggtaggactgctggatcgaatgatagatctacttttagttccttaaggcatctttaaaggagtacaaagtcttaaggattggggtacacgaagaaaaagaggaggagaaggatgtacctcagttgaatgagtccagaggaaggctggatggttgacctttggctgggtgcgcagatggacgtgattctagtaatttggggcagtattaaccatgaagctgatttattgcaggtacctcatctgagattgatggtaactgatggcacatgccaaggggcatttttagggaaggatccaacagaattcgaaacaactgactgcagcacaaggcgggagcctctggctctctgaggttccagggccagaaccccaagtcagggggacagtgagaggaggcacccatgatggagaaataaggacagcacaactaattccttcacttatcttgagatggagtctcactctatcgcccaggctggagcacagtggcgcgatctcggctcactgaaacctccacctcccgggttcaagtgtttctcctgcctcagcctcctgagtagctgggattacaggtgcccgccaccacacccagctaatttttatatttttagtagagacagggtttcaccatgttggccaggctggtctctaactcctgaccttgtgatctgcccacctcggcctcccaaagtgccaggattacaggcatgagccagcacgcccggccattccttcacttatgataattcagcaaacaacacagataaacataattcaaatctttgattgcaggaaacggaatttagcggagttgcctacatgacagggggattagagggtggcaccgagcctgcctggggaacaagagtcatcacccaggacgtggcatacacgtgcagccttggaggatgactagaactttcccgggtgggtagatccaggaaatgagaacagcttgagcaaagtcacggtgcattcaggacgtgagtccctcactccaaccggggtacgtgttgcacaagggaagggaacaaaagatgatgcagggcatgatcttgtgaaagaccccaagtgcctttgtgcggctgaggtgggtggatcacctgaggtcaggagttcaagaccagcctgcccaatacagagaaactccatctccactaaaaatacaaaaattagccgggcatggtggcgggcacctgtaatcccagctacttgggaggctgaggcaggaaaatcgcttgaaccaaggaggtggaggttgcagtgagctgagatcgtgccactgcactccaacctgggtgacaagagcgaaactccgtctcaaaaaaaaaaaaaaaaacaaacacgagtgccatgctaaggagtgtggactcgaccctgatggtcgagagggatggttaagcaaagaattgatacctgtggatccgaagggctgttctaattcgtggcatggaaaagtgattcagaagttggctgcaactggaagatcagggaggatctgttaggaaagagaaaacagggctaggcccagtggctcactttgggaggtcaaggcaggcaggtcactagaggtcaggagttcgagaccaagccaggccaacagggtgagaccttttctctactaaaaatacaaaaattagccaggtgtggtggcacgcatctgtaatcccagctactcggaaacccaaggcaggagaattgcttgaaccagggaggcggaggttgcagtgagccgagatcgcgccactgcactccagcctgggcaacagaacgagactctttctcagaaagaaaagaggaaacaggactcaggggaaagagaaggatttccaaggtggaggtgcatctgtggtgcccagttgcattcgagggtgctggaaagagaattaatctggaatgaatcttcctgatttcggcactgggccagctccattcccagaaagggtggggaggcttgggttagaaataacagcttgagcttgggacaggttgagttggaatggttggtggaactgttcaggaggcagtagaaaatatggttctgggctgggtgtggtgtggtggctcatgcctgtaattccagcattttgggaggccaaggctcacttgagcccaggagtgttcgacaccagcctgggcaacatagcaagagtcccatgtctacacagataaaataaattaactgagcattgtggtacacacctgtagtcccagctactcaagaggctggggcaggagtttcacttgaagcccatagcttgagaccagcctgggtaacacagctagagtcccatctctacaaagctttttttttttttttaccttaaaaaaatttaaagtttttttaaaattaaaaatttttaagttttttaaaattaaaaaaattttgtttttttaagttccttaaattttaaaaatgcttcagctttttttaaaaattaagctttttaaaattaaaaaagttataaagtcttctagcatttaaaaaaatgttaagaagtttttaaaaattttaaaacatgggctgggtgtggtggctcacacctgtaatcccagcactttgggaggctgaggcacgaggatcacttgagcccagaagttggagaacagcctgggcaatataaggagaccctatttctacaaataattttaaaaaaaaaataggtgtggtggcaggcacccatggtctcagttacttgggggctgaggcaggaggactgcctcattctgggaggttgaggctgcagtgagctgtgtgatcagaccaccacactccaacttaggtaacagaatgagaccctgtctcaaaaaaaaaaaaaaaaaagtaggtagggtgcagtagcccacccctgtaatcccagcactttgggaagccgaggcagacagatcgcttgagtgcaggagttcaagaccagcctgagtaacatggcgaaaccctgtctcaacaaaaaatagaaaaattagggcagacacggtggctcatgcctataatcccagcactttgggagggtgaggcggatcagctgtggtcaggagtttgagagcagcctggacaacatagtgaaaccccatctctactaaaaatacaaaaattagctgggcgtggtggcacatgcctgtagtcccagctactcgggaggctgaggcaggagaatcgcttgaacctgggaggcagaggctgcagtgagctgagattgcgccactgcactccagcctaggcaacagagtgatatgagacactgtctcaaaaaataaaaattagaaaaattagctagatgaggcagtgttcacctgcggtcccaactacctggggggctgagatgggaagattgcttgaacccaggaggcggagagcacagtgagccaagatcacaccactgccctccagccttggcaatggagcgagacccagtctcaataatgatgatgatatatgattctgcatctaagaggaaggactggaactctcctcatgaccatggcagcagctgctctgactcgtgaaggctgctcttcctcatgaggcggctgcccccgtggagagggtggatgctcttccctggtagttattttctctgcaactgagggagaaatgatgaacccaggattgcaatgggtttgtcctgaatccagcaaaggggaagaaaagggaatcataaagcacccatcccagggcaggagagatgatggatgcactgttctatcagctcagggccgggaggtgtgcagggggtcaggcagcctctgtgcacagaggattctcccgctgcttctgagacttcacccacgtggctctgtctgcaggactggtcattcctgctgctcagaaccagcccactccacgcagagatcacctgggagaacccagactccttccagtccttccccgccggctgcagctcttccttctcactgtaggctgggaaccaggatgcctgccttcctaggtatggacgaggtaggttttaggaggtgggatagaactgggagggtgggtggctacgtctgaaggagacccctgggtgcctggaagcatgcagggcacagcacagcagctccggccatctgaatttccggggaacattggactgggggaagtgaggggtgcccaggatggattgaggggaggattctgggttcctgggagaaggtggggacagagtgagaaagggtagccctcagaaggctgggcgtggggttctggggcctaggacaggcaaaaggcatacaggtgtctaggagggaggtgtcacagtgacacctctccagcctgcactcctgtccctgccgcagaccccaacgcgagctgctggcctgagtccaatgggacagccctgcaggagttcgtgatcctgggcttctccgtgtggcccccggggctccgcgtgctgctcttcgtcctcttcttgccgctctacctggtcaccctggcggggaacctactgatcctgggcctggccctggtggaccccgccctgcactcgccaatgtacttcttcctgggggcgctgtccgcggcgcaggcagcctacacgctggtgctcacgccacgcatgctggccggcttcctcctgccctccaggggccaggctgtggacccctctacctgcgccgcccagatgggcctcttcgtggccctggggggctccgagtgcctgctgctggctgccatggccctagaccgctacctggctatctgccatccactctgctaccctcggctcatgaccatggacgtctgctggggcctgcttggccgcctgctgcgcgggtggctctgtcctggccctgggcctcaccgcggtcatcttccagctgcccttctgccgcggcggcctggtcaaccacgtcttctgcgacctcccggccgtgctggtgctggcctgcgggtgccgggccctgcaggagcgcgtcctcctggtggcctgcctgctgctgctggtgctacccctgctcctcatcctgctctcctacacccgggtgctggtggtcatcctgggtgttgggggggtcgcgggccgccgcaaggccttcaacacggtggcgtcccacctcaccgtggctgtgctccactacggctgtgccacggccatgtatgccaggcccctgaacagccgttcccttgaggaggacaagctggtctcgctcatctatatcaacgtcaccccgctgctgtacccggccatctacacgctgcggaaccgggacatgcaggaggccctgcaatgcatggtcggccagaggacgctggggatggccaccaggtggattttgcctgatgctgggtgccaggcggtgtctgtcctgagatttctcccactgaggggaatctcaccattctggagccatctaagcctccccaacgcctacggggtgtaaatctaagtatagcacgcaaagaccagcaatccgactccagcctagcgctgctgtgtccgttgacgtcttgcgctggatggttctttgctgttgggggatgtcccatgcgttacaaagtgctcggccgcgctctgagtctttctctattcactggatgccggtggcaccctccaccccactaccctgtgtgataatcaaaaatgttcttgggcttggcgcagtggctcatgcctgtaaccccagcactttgggaggccaaggcaggaggatctcgagtccaggagtttgagaccagcctggctaacacagtgaaaccccgcctctacaaaaattgtccaggtgtactgctgtgtgcctgtagtcccagctaagtgggaggctgaggcaggaggatcacttgagcccagggggtggaggctgcagtgagctatgattgcaggactgtactccagcctgggtgacagagcaaagccccatctcaaacaaaaaaatacctcctgaagggcccatttaggagccaggaacctcagaggcatggtcagtgcaggtaacctctgcctacctaaccacctggctggtggatgtgcacgcctatcaaggctgattgggaagaattatgtctactccagtgaggagcaccaagaaggaagctgacaatggcttcaggagtcttgggaaagaggaagagtctcttcataccatttccatccttatctgtggcttcttgaggctggtgtcaggaaacctgaaacacaaaagccctagccctggagcagaagagcctcccagccttctccccaaatgctaccggtatatggaacatgatcacccctaaacagatttaagacagctggtttttttgtgtgtatgcattttgctttgttttgttttttttttgttttttagatggagtctcacactattgcccaggctggagcgcaatggttcgaactcagcttactgcaacctccgccttctgggttcaagcgattctcctgcctcagcctcccgagtagctcggattataggtgcccaccaccatgcccagctaattttttgtatttttagtagagacggtttcactatgttggccacgctggtcttgaactcctgaccttgtgatccgcccgccttggtctcccaaagtgctgggattacaggcatgagccaccacacctggcctacgacagctctttttaaggacttttttagagcagtttaggttcacagcacaattgagaggaaggtacagagacatcccatttacccctgtccctgaacaagatgcacttcactgaggttatgttagattccagagaaacattggttgagggactcttctttccaaaatatttttgcttccaaaagctgtttcaaacaccacaacaccaaaaccctgttttgggttttttggttttttttttttttttttttttttgagacaaaatcttgctctgtcatgcaggctggagtgcagtggtgtgatctcggctcactgcaacctctgcctcctgggctcaagcaattctcttgcctgagcctcccaagtagctgggattactaagattacgggcatgcaccagcatgctcggctaatttttgtatttttcatagtgatggggtttcaccctgttggccaggctggtctcaaactcctgacctcaggtgatccgcccacctcagcctcccaaagtgttgggtttacaggtgtgagcgaccgagcccagccagaaatacaaactagttgactgtgagttatcagatgtcatgaaattgttagcttccaggttcaggggctctgtgatacgtgacgacaaacagaagaaatggtatgtggtgctgcagtgggcctccctggtttaataatatgttcatcttattccagttctgtatcacaaatacagaagggtataatttagcatagaaagtctccatagatcttctatatattatggtatgtatgtctacagattcacaattatgttctgttcaccagtgcaacacaaaaataaaaattacctgtctgtagcacactcggaacacacccctgcgtccctctgggatgttctcatgctttttagatctgttagtcgtaatgatttcatttcttcccatagcctgggcaacaagagtgaaactccatctcaaaagaaaaaaaaacttcatatccacagttgtctttataattaagtatagactggctaaagtggctcaggcctgtaatcccagcactttgggaggccgaggtgggcagatcatgagatcaggagtttgagaccagcctgaccaacatggtgaaactccatctctactaaaaacaaaaagttggccaggcacgctggcgggcacctgtaatcccacctactcgggaggctgaggcaggagaatcacatgaacctgggaggcagaggttgcagtgagtcgagattgcaccactgcacttcagcctgggtaacagaatgaggactctgtctcaaaaaaaaaaaaaaaaaaaaaaagtatacttacaaaaatagatcactctagcataccatcacccttccgtcgttagttttaacagaccatgcttttttgttgtttgtttttgagactgagtctcactctgtcacccaggctggagtgcagtggtgcgacctccactcactgcaatctccgcctcccgggttcaagcgattctcctgcctcagcctcccgagtagctggaattacaggcgcctgccacaattcccggctaattttttgtacttttagtagagccgagctttcaccatgttggccagactggtcttgaactcctgacctcaggtgatccactcgcctcggcgtcccaaagcgctgggattacaggcgtgagccacagcgcccagctgaccatgccttccttaagccaccaaagtggccgaatttcaccccgatatgggacctctgcctagggtggcgtcgtagttttggttgagggctgtttccctggcgatgtccctcctagaggttcggcgacctcgtgatgtgactttgtgacgatcccacggtctcttcacccatgcagcttctccctcgtgtggatcccgtggtggcggatgaggttcgccttccgggaggtcttcccgcagtcggagcactcgtacggtttcttccccgcgagtccgcctgtgggtcaggaggcaggagtcctgggagcagctttcccgcactccgcgcagccgcagggcttctcccccgtgtgagtcctctgacgcaggatgaggtgtgacttctggaaaaaggcctttccgcattccctgcagccgcagggcttctcccccgggtgggagcgaaggtgctcgatgaggcgcgacttgtgggaggttttctcacactcccaacacttgtaaggcttcgctccggcgtgaactgtgcccgggacacacaggcgtgtcttccggaagatcgttttaccacttctgtctctagcgggtttctcctttgtgtgagttccctgtttgtcagggcaaagcttctccctgaaaccactcccccgttcactgcacgcagaggacttctcccccgcgtggaccccgtgatgtaccctgaggtccgatctgcagcacaaggctttcccacacttcgtgcattcgtggggtttctcactactggctccctgagctgcaggaactccctcgtcacagcttaaagcactgccacactggtgacctccgcgtggattcgctcctgaaggtggagtttcaagtttcgaatagagaagtttccgtggccgtcgcactgaaatctcctcctcgccaggtaggcgttaggagtgaagtccaggttacacatcaaactctttctgcacaagtcacgtgtgcggacctgctgttttgatggaaggaggtttgggttctgatggagtttttttccaagttcgttacattcatgaagctcatttccggtccagtctttcttgtctagaaacgtatggctcaaatgttggtcttcgtgttgctgttggctatctggctgggtagcaacttgccaaacttcttctagaaaaaaaaaaaacaaaaccacaaactcgtggttttttttttctttgagacggagtcttactccattgcccaagctggagtgtactggcatgatcttggctcactgcaacctctgcctcccaggttcaagtgattttcccgcctcaacctcctgagtagctgggattacaggtgccagccaccatgctcagctaatttttgtattgttagtacagacaggatttcaccatgttggccaggctggtcttgaactcctgacctcaggtgatctgctggcttccgcctcccaaagtgcagggattacaggcgtgagccaccgcacctggccataaatttgttaatcttggagtactgtatcacaaaactattgcagaaaagcttgaagggaggattcattttgtggttttaagcctaattgcctgtaatcccagctactcaggaggctgaggtgggaaggtcgcttgagcctgggaggttgaagctgtactgagccatgatcacaccacggcactccagcctgggtgatggagtgaaactctgtcccaaaaagtagtaaaaccaagtgcccggtccctttcttgaggcctaggttacacagaggccttcactatccacccttcccatgttctcccgacctatgctccctttcattctgtataccaactggattttctcaaagcatgaggtcctttttgttgttgttgagatggagtctcactctgtcgccaggctggagtgcagtggcgcaatctcggctcactgcaacctcagcctcctgggttcaagcgattctcctgcctcagcctctcaattagctgggattacaggcacccaccaccacgcccagctaattttttgtatttttagtagagacagggtttcaccatgttggtcaggctggcctcaggtgatctgcctacctggacattccaaagtgctgggattacaggcttgagtcactgcacccagccatgagctctttattgttaaaggaattatcttagagctagcggcattttctgcagtgacttattctcacgtggacctatggatctttatgatgtccaacagaagaatactagagtacacacaagccatcctggcctcagattccctgctgtctcctgatgcctgtattaccacttgtttttgttttggtgacagggtctcactccgtcacccaggctgaagcatggtagtacaatcatggctcattgcagcctcaaactcccgggctccaacgatcatcccacctcagccttccaagtagctgggactacaggtgcatgccaccatgtccagctagtttttaaaattgtttttgtagatacgggggtctcactatgttacccagggttgtcttgagcttctggcctcaggcgatcctcctgccttggcctcccaatcagctgggattataaaaattagccaggcacggaggctcatgcctagtttctttttttgtagagatggagttttgctatgttgcccaggctagtctcgaactcctggcctcaagcgattcttttgcctcagcctctccaaatgctgagattacaggcatgagccaccacacctggtgtatcttcatttgcattttaaactaaagatgctacctgctgcctcacctgtgaggctcatgtccgactcaagggtgtcactcctctatttagaagttcctggctgggtgcagtggctcaagcctgtaatcccagcactttgggaagcgaacatgggcagatcacctagggtcaggagtctgagaccagcctggtcaacatggtgaaaccccatctctactaaaaatacaaaaattagccaggcatggtggcgcacgcctgtaatcccagctacttgggagactaaggcaggaggagtgtttgatcccgggaggcagaggttgcagtgagccaagactgtaccactgcactccagcctgggcgacagacaacgactctctcaaaaaaaaaaaaaaaagttcctggccaggcgcagtggctcacacctgtaatcccagcactttgggaggccgaggcaggtggatcacctgaggtcaggagttcgagaccagcctgaccaacatggagaaaccccgtttctactaaaaatacaaaaaaattagccaggcatggtggcacatgcctgtaatcccaggtactcgggaggctgaggcaggagaatcccttgaacttgggaggcagaggttacagtgagccaagatcacaccactgcactccagcctgggcaacaagagcgaaattccaacacaaagaaaaaaaaaatagttcctgagctgaactgctgatttttttttttttttttttttttttgagatggagtctcagctctgtagcccagactggagtccagtggcgcgatcttggctcactacaagctccgcctcccaggttcacaccattctcctgcctcagcctcccaagtagctgggactacaggcacctgccaccaagccaggctaattttttttattttttattttttagtagagacggggtttcaccatgttagccagaatggtctcgatctcctgacctcatgatccgcccgcctcagcctcccaaagtgctgggattacaggcgtgagccactgcgcccagcggaactgctgaatttctgagaggtaaagagcacctgttcatctccgccatcagatttctagggtgagacccatccaggggtatttttaaagctccccaagtaattttcgtgtggatcatcaattaattagcagcgtcctgaacaaacacgtgagaaagaatccttgtcctgatccaaagagagattaaaggagtgtcccccagagcttctcgaagaaacacggacaaatgaaataacagctcttctccccatggggttatactgagtacagcccattaggcagaatggagccatattacatggttttgaaagaagaatttaaaagtcatataaaaggtaatgtagtaggctgaatagtagagtaaccagatgcgtgaagtagacaaagttgacattaacctctaagatcggccaggcacagtgactcacacttgtaatcccagcaccttaagaggccggggtgggaggatcgcttgagcccaggagttcaacacaatcctgggcaacatcgtgagaccccatctctacaaaaaaaccttgaagatgagccaagtttttctttcttttttttttttttaagaaacagggtctcgcgtgatcatagctcactgcaacctcgacctcctggactcaagcgatcctccagcctcagcctcccaaagtgctgggactacaggtgacagctgccatgcctggagggtttaattacttctgattccattactggtgccagctgatgttcgatttttgtttttttgagatgcggtcaagcctgttgcccaggctggaggaaccacagcttattgcagcctcaacctcctgggctcacgtgatcctctcccctcagtccccgattagatgagactacaggcgcgtgccaccacacccggctaatttttgtatttttagtagaaatggggtttcaccctgttggccaggctggtctcaatctcctaaacccatgtgatctgcctgcctcagcctctcaaagtgctgggattgcaggtgtgagccaccatgcctggcccctgaataagcatttaatagaaaataacccagccccttcgttttctgcagcagaaacttggtgatcagcatgaatcaacgccacacgaaggtgagctgggagagagacagcaatgatttaacctcatcaagttggccaggtgcaatggctcacgcctgtaatcccagcactttaggaggccgaggcgggcggatcacgaggtcaggagatcaagaccatcctggccaacatggtgaaacaggatctccactaaaaatacaaaaattagccaggtgtggtggtgcgcgcctgtagtcccagctactcgggaggcagaggttgcagtgagccgagatcacgccactacactccagtctggcagacagagtgagactccatctcaaaaatagtcattaagtacactaaaggacaggaatagctttcaccagtttgtgggtattaagaagagaaaggggactaaattttacgtgtagcaaagatgtttttgaggcatttcacagtgaaagaaaaagatgaaaacaacaaatggcacgcccagccaaaatcccaggcttttaagaacagttgcctgaaacaagaggacatccggccaggcgccatggctcacacttgtaatcccagcactttgggaggccaaggcaggtggatcacccgagttcaggagtttgaaaccagcctgaccaacatggtgaaacccagtctctactaaaaatacaaaataagtcacgcatggtggcaagcgcctgtaatccctgctactcaggaggctgaggcaggagaatggcttgaacctgggaggtggaggttgcaatgagctgacatcgcgccactgcactccagcctgggcaactgagtgagactccatctcaaaaaacaaaacaagacaacatccatgggttctgctttgcagacttccaggaacctcatcccccggccccctgcaggccacccgctcacctgggaagctccacgtccttatctcttcctcctccatccatggctccttcccctgctccaaactggagatcacagctggtttgctgacttgacaccctgttggggagaaacagttaaaggatttgtgctgagccagctgggccttccaagcaagcagacagttcagcctgcaaaacaaaaggtggacgtctcagccacataagagctgtttcgcttggcaggataacttcacgaggactccagtgggatcgagactctgaccactgaaacccaaggccaagcacttttatttttcacacagggtcttgctctgttgcccaggctggagtgcaatggcacaatcacagctcactgcagcctcaatctcctgcactccactcaagtggtcctcctgtctcagcctcccgagtagctgggactacaagcatgcatcaccaccctcaactaattttttaatttttttgtagagatggggttttgccatgttgcccaggcaagtcttgaactcgggcctcaagtgatccttccatttgagactcgcaagtagctgggactgcaggcacatgccaccatgcctggctaattttttatttctcgtttgtatagatcgggtcttgcacctgtagctcaagcaatcctcccacctcggcctcctaaagtgctgggatcacaggcatgagccaccatgcccagcttagcccttttagtgcgtgagcagtttcccagttttatacaactaagaaaaagagttcatgtaacccgaggaccacggggaagtcttcctcacccacagagagcaggtggctgtagatctccagcatcacatcctggtacagggtcctctgctccaggtccagctgctgccactctttccgggtgaagcccacagccacgtccccgaatgacagtgacccctggaacagcacatggctgattaatgtggagtggttggcactgggtaccatggcaaaggcgtagaggagattgatcttaaaccttccgacgtcagctttccccatattaggttacataggaagctgagcacacccctaactttgtactacactttgtggaagagaaaaaaataatcattagaaaaaaaatctcgactgggtgcagtggctcacgcctgtaatcccagcactttgaggggctgaaacgggtggattgcttgaggttaggagtttgagaccagcctggccaacatagtcaaatcccatctctacaaaaaatatattagatggatatgctggtgggtgcctataatcccagctaccagggaggctcaggcaggagaatttgttcaacccaggaggcgtacgttgcagtgagccgagatcccgcccttgcactccaggctagacaacagagtaagactccatcttaaaaaaaaaaaaaaaaaaaaagcatgtgagggttggggggctttcgtcactgtggcagaggtcaaggggggatgctgggtagaaagagctgcagtgggtcccccggacacatgctgctggagtggtgagggatgttcataggcaaatgggtgacccaaagtgtccccaatggtgagacaagcgcgtgcagaggaggggcaggaagcagggcacagcccaggggcagcagcagggaccgggagctatgtgggagtggggagaggcaatccacaaagaagcccagagctctgatcaccctacggaccctgggttctcttccagaccacactctgatctctagaaaacttatgaccaagggctaaaggctgctgaagccagtgacttgtttttttgagatagggtctcactgtgttgcccaggctggagtgcaatgtgcaatatcagctcactgcaacctccgcctcctgggttcaagtgattctcctgcctcagccgcccaagtagctgggattacaggcacacgcccagctaatttatgtatttttagtagagacagggtttcaccatgaggccaggctggtctcgaactcccgacctcaggtggtccagctacctcagcctcccaaagtgctgggattacaggtgtgagctatcatgcctggcgtctacgtagtgtagtatatgtatatacattacatatatatatatatatatatatatatatatatataatcaatgtagtttacatacatgtatatatatatacaatgtctacatagtttttatacatacacatacaatgtctacatagttaattcatgtctttgtaatttctatgtaatttattcatacataatttctatataaatatataatttccatgtaaatatgtaatttctatagatatgcctcttatgggtttattcatgaaataacatatgaaaagcacagagaccacaaaagtgctggacagacagcgtttaacgcggtcattgtcatcttcagtacacagactgccctaacacagagtcactcccagtgggatttgccttcctacagtggcttctggctgggcacggtggctcatgcctgtaatcctagcactttgggaggctgaggcgggcagatcacgaggtcaggagatcgagaccatcctggctaacatagtgaaacccagtctctactaaaaatacaaaaaagttagccaggcatggtggcaggcgcctgtagtcccagctactcgggaggctgaggcaggagaatggcatgaacccaggaggcagaggttgcagtgagccgagatcgcgccactgcactccagcctgggcgacagagcaagactccatctcagaaaaaaaaaaaaaaaaaaaaaccaacagtggcttccaagaaagacaacaagcgaaacctccagcttcacccacagggcgggtgtggctcgccaccttgttctagcctctcctactgctctgagacatttctggtgtgaaacacctagacatccctggcttcacaaagcacaaagaaacccaggctctgtgaacgttttccttcctggagtggacagtggtaatgttcacgaggcctcatcttcctctgggaccaggcccttcctgcccctgtgcacagctgcctggacagagggcctaatacacctgagctaggctggaccaacagaatcctccccgaaaagctttcaaaattggatcagtgaagggagattcagtccctcacagcggcagaacttgcagctgggaggagaggagctggggctacgctatttctggccacatagagtcagcatgagaagaaagtcacagaagtgccgggtgcagtggctcacgcctgtaatcccagcactttgggaggccgaggagggtggacatgaggtcaggagatcgagaccatcctggctaacatggtgaaaccccgtctccactaaaaatacaaaaaattagccaggcatggtggcgggcacctgtagtcccagctactggggaggctgaggcaggaaaatggcgtgaacccgggagggggagcttgcagtgagctgagattgcgccagtgcactccagcttgggtgacagagtgagactccatctcaaaaaaaaaaaagaaaaagtcacagaggcagagaacagggaacaaagattcctggcgatacctggtttgccagatgcctctggagcctgactgcacacctgctcttcccaggactcgcatgctgccttatagatttttttttttttttttttttgagacaggctctcccctctgttgcccaggctggagtccaaaggcacgatcacagctcattgcagcctcgacctcctaggctcaagtgatcctcccaccttagcctcccgtgcagctgggagtacaagcatgtgccaccacgcctggctaatttttgtattttttgtagagatggggtcttgccacattacccaggctggtcttgaactcctggcctcaagcaatcctcctgcctcagcttcccaaagttctagaattactttttttttttaaatcctaacctacttctagttggatttctggcttttccaacttcaaggattagaacttctaaccagtgcagtccacactcacacattcctagaacccggggtgaagagcaggaggaggagaatgcttccaggctgatggaaaacactgatgtcactcacatgcaaagagagctaacagccaagtgggcggatcacctgaggtcaggagttcgagaccagcctggctaatatgatgaaactccatctctaaaaatacaaaaattagtcgggcgtggtggcacatgcctatattcccagctacttgggaggctgaggcaggagaatcacttgaacccaggaggtggaagttgcagtgagccaagatcgtgccattgcactccagcctgagcaacagagccagactccatctcaaaaaaattttttttaattaaaaaaacccattatggcaagcaatttcagatgagatcaggcacgttcagggtggtgtggcggtagacatggcaggctgtttcaagaacacgcagttcattcattcgttcctctagataatgcagtgttacatccaggtcacttggcaccgcacaaggctgtctctgtagacctgagtgttcggcatccccaaacaaccagaatcacagacggctgctttggcataatatctgctgtttatacagagaggaagaaaagtcacaagagatttcctgttgtgtttctttcaagatggttgttattgaggaacgggcctgctacatcttgcatacaaagatcaaatatatctttaaatgccctaaagagctgtatttcccctgagaagtagacacggttgtccaaaacagacaacacaagtcatacattagatggaatctgcctgcgtttttaaagtgacagaaatgtcagatataaatttacaaggcatcgggctgggcatggtggctcatgcctgtaatcccagtactttgggaggccgaagtgcgcggatcacttgaggccaggagttcgagaccagcctggccaacgtggtgaaaccctgtcttcactaaaaatacaaaaattagctgtgtgtggtggcaagtgcctgtaaggaggctgaggcaggagaatcgcttgaacccaggaggcagaggttgcagtgagccaagattatgccactgtattccagcctgggtgacagagcaagactccgtctcaaaaaaaaaaaaaatttataaggcatctcataactgcggcagcctctacagtctctccaccctgcccttcccacaaccttgatcttccattctcttcctgttttcaccgatcctgatttccgtttgtattttgttttatcggatacccttttttttttttttttaagacagagtctcactctgtcacccaggctgcagtgcaatggcacgatctcagctcactgcaacctctacctcctgggttcaagtgattcccctgcctcagcctcctgagtagctgggattacaggctcgtgccaccacacctgtctaattttgtatttttagtagagacagggtttcaccatgttggccaggctggtcttgaactcctgacctcaggtgatccgcctactttggcctcccacagtgctgggattaccagcgtgagccaccacgcccagcctttatcagtcatgttcttatgagcatccgaaatccctgctaaaaagggcagtagaaagaaatgccacactcacctgggccatagttcttcttctctattctggaaaagcagacacctgtgaaggcagacatcagggtggggagagaggatatgagaggccacgcttgcccttgggctcccaatcaactgctgggaccacccccgccctctcccaggcgcaggtgggagaaaacctcctctgaagggtccccattatcaaagcaaagccctcaccttacaaatgtcatagagactcaatcttgtgaggccttacttggatttttgttttgttttttgaaatggggtttcactctgtcgcccaggctggaacacagtgatgcaatcacgactcaatgcagccctggactcccaggttccagcgatcctcccaccccagcctccagagaagctgggactataggtgtgtcacatgcccagctaatatatatatatatatatatatatttttttttttttttttttgagacaagagtcttgctctttcgcccaggccggactgcagtgacgctatctcggctcactgcaagctccgcctcccgggttcacgccattctcctgcctcagcctcccgagtagctggtactacaagcgtgcaccaccatgcttgaataattttttgtatttttagtagagacggggtttcaccgtgttagccaggatggtctcgatctcctgacctcgtgatctgccctcctcggcctcccaaagtgctgggattacaagcgtaagtcactgcgcccagccatgcccagctaatttttaaattttttggtagagacagggtctcactgtattgcccaggctggtctcaaactcctgggttcaagcaatctgcctgcctcagcctcccaaaaccttgggattacaggggtgaaccaccacgactgactgaagtttttcttaatgagtatgtgcatctgtgtctcagtaaccaatgtgcaatttactacaatccccacccattacccaaaaatgtaattactagaaatttattctgaagaaacaggccggacacagaggctcacgcctgtaatcaccacactttgggaggccgaggcaggtgcatcacctgaggtcaggagttcaagatcagcttggccaatatggtgaaaccccatctctactaaaaatacaaatatcagccgggtgtggtggcatgtgcctgtaatcccagctactcaagaggctgaggcaggagaatctcttgaacttgggaggcagaggttgcagggagccaagattgcaccataccactgcactccagcctgggcgacacagcaagactccatccccctcaaaaaattataagaaaacttttttgaggggatagggtcttgctgttgcccagactggagtgcagtggcgtaatctcggcttcctgcgacctgtgcctcctgggttcaagtgattctcatgcctcagcctcccacatatctgggattacaggcacacaccagcaagcctggctaattttttgtatttttactagagatggggtttcaccatgttggccaggctggtctccaactcctgacctcaggtgatccacccacctcagcctcccaaagtgctgggattacaggcgtaagccaccatgcccggcctatttttattttttgtagaggccaggcgcggtgtttcacccctgtaatcccagctacttgggaggctgaggcaggagaatcgcttgagcctctgaggtggaggtggcagtgagctgtgatcgtactactgttctccagcctgggcaacagagtgagactccgtctaaaaaaccaaaacatatatatatgctttttgtagagtcagggtcccgctatgttgctcaggctggtctcgaactcctggcctcaagtgatcctcccgccttggcctcccaaagtgctgggattacaagcatgcatcactgtgcctggcctgtttcttgtttgtatacatcaactacaaactacagcacatgtaataagtttgtaaacatacatctataaacaaaaaattctgggccaggcacagtggctcaagcctgtaatcccagcactttgggaggcggaggcgggtggatcacttgaggtcaggagttcgagaccagcctgaccaacatggtgaaaccccatctctactaaaaatacaaaattagccgggcatggtggcgggcgccagtaatcccagctacttgggaggccgaggcaggagaatcacttgaaccagggaggcggaagttgcagtgagccaagatcgagccactgcactccagcccgggcaacaaagaaaaaccccatctcaaaaaataaaataaaaaagattctgaagaaaagacacagaatattaacaatgattatctttgcatggtaggacttttgtttggttggttttgttttggtgttttctcttcagatagggtctcgctctgtcgcccaggctggagtgcagtggcacattcacagctcactgcaacctctgcctcccgggctcaattgatcctccggcctcagcctcccaagtagctgggactacgacacatactaccatgcctggctaatttttgtattttttgtggagacagggtttcaccatgttgcccaggctggtctcgaactcctaggggctcaagtgatcctcctgcctcagccacccaaagttgctggtattacaggcatgagccgcctcactgggcggatttttttcttaacatattgatattttctaatttcttcaacaagaaattggtgctgtttcacatgtaaatatttcataacaatatacatgcattttactgggttttctccccatgggctcctatcaaagtccttcccctggtgaaagggaagccatggggagggctgaaggcagagaaggtgggacgggccaagtcttagccatgattgtggaacagtggaagaagagcctgtctggtgctcgggggccctgggtgtgagtactggctcaccctctactgtgcgtggcggttctgaatgtctctctcacacccattttgtttagtctttgacgtgagaaggagaaacaaaaaactcaggttaagaaagcaaactctggccaggcgtggtggctcacgcctgtaatcccaacactttgggaggctgaggcaggtggatcacctgaggtcaggagtttgaggccagcctggccaacatggcaaaaccccatctttaccaaaaatacaaaaattagccgggtgtggtagtgggcgcctgtaatcccagctactcgggaggtggaagcaagagaatcgcttgaacccaggaggcggaggttgcagaatgccgagatcagtcactttaaaaaaaaaaaaaaaaaaagattggctccccccgcaacccccaccccaaagaaagcaaattctatggcttgactatagtgtaggatccagggacagtgtggtccgggcttgtcctctgagcaccagggacatgctctggccctgagcccacaaacttgtactccctaaagcaagagcctctttctcctcctagcaaaccttccactcaactgaaacctagatgatccctcaacgtgaccacccagcaaacccatgtttgctctgtcccccagcgggctgggaccatttcaggcacatggaccttgggtttttttatggagttttgctcttcttgcccaggctggagtgcagtggtgcgatcttggctcactgcaacctttgcctcctgggttcaagcgattctccagcctcagcctcccgagtagctgggattataggcacccactaccacacccaggtaatgttagtatttttagtagagacagggttttgccatgttagccaagttggtctcaaactcctgacctcaggtgatctgcccgcctcagcctcccaaagtgctgggattacaggcatgagccaccatgcccagccccaggtacatggaccttgggagctgccaccctccacgtgaccctccggcttcagccctaagctatgtgaagaggtctcagaactggggtctcgctttccaaagtagattcctgctccccgttgtcaagttcttcacaggaatgcttttactcccagcatgcctgggtctcgaacacttgggcaactccacttggctgccaaggctctgctcccctactgagaacttaccttcaggtggggactcaagcttcagcctctgaggttctcgggaccagggtagaaacaagcttgctatgctgagaggagggacccaccttgctgacaaagtccgatcctgagcttttgcaaagacaccaggaaaacctgaaattaaaatgacgcagggaggctcacatgaaaatattagcacacctgtcatctcagtactttgggagcctgaggcaggacaattgcttgaggccaggagttcgagaccagcctagtcaacaaacaccccacctctacagggggaaaagaagacattggcagggttacctttaccgctgatagagagaaaccaatctgtggcagaagggaaagtcagaaagcctagaacacgagacagagtccatgctctgtttctggctttgaaaatggagggaccggctgggcacggtggctcacgcctctaatcccagcactttgggaggccgaggtgggtgcgtcgcctgaggttagcagttggagaccagcctggccaatatggtgaaaccctgtctgtactaaaaatacaaaaattagccaggtgtggtggcgcacgcctgtaatcccagctactagggaggctgaggcaggagaatcactggaacgcgggacgcagaggttgcagtgagctaagctcgcaccactgcactccagcctgggtgacagagtgagattctgtctcaaaaaaaaaaggagatcccattggaaagcaagctggtgggcttcgggagctgagcatggcccccagctgacagccagcaaggaatcggggacctaagtcttaagacagaattctgcaaaccccgaatgcactgacaagcagattcttcccagaacctctggctaaaagcccagcccagcccacgcctttctcagagcctgatgctacctggagcgtggaacccataggtgaggccaccaggatttctgacctcccaaactctgtgttagtaagtgggtgtggttttagtcaccaaatgagtggcaatctgtcatacaacaatagaaaattactacaggccaggcacagtggctcacgccagtaatcccagcactttgggaggccaaggcaagtggatcacttgaggtcaggagttcaaaaccagcctggctaacatcgcgaaaccctgtctctactaaaaatacaaaaattagccaggcatggtggtgggcgcctgtaatcccagctacctgggaggctgaggcatgacaatcacttgaacccagaaggcagaggttgcagtgagccgggattgcactgctgtactccaccctgggtgacagagtgaaactccatctcaaaaaaaaaaaaaaaaaatggcaagcataaagagcaaacctgaataccaaaagaaaaatatatatattgcagccaggcacggtggctcacgcctgtaatcccagcacttcgagaggctgaggtgggcggatcatgaggtcaggagatcaagaccatcctggttagcacagtgaaaccctgtctctactaaaaatacaaaaaaatcagctgggtatggtggcaggcgcctgtagccccagctactcaggaggctgaggtaggagaatggcgtgaacccaggaggcagagtttgcagtaagccgaaatcgcaccactgcactccagcctgggcgacagagcaagactgtctcaaaaaaaaaaaaagaaaagaaaagaaaagaaaagaaaaatacatatattgcatagatcccactgactcaaaaaacaatacaattagaaaataaaaagaatgcaaaaaaaaattaaatcaccaaatatgaaatgaatccatactcaaaaatattcccaaagaaacacgaggcctatatgtttttcaggaattttataaaactgtcttcaagacttttgcaatgtgtataagtggtttattcaggttttctatatgtcagtcaattttagcaatttacaattttctacaaatgtgtcttacttaatttcagagttatgccattaaatgatttatagtaacatctcattttttaaaaatctactggccaggcacggtggctgatgcctgtaatcccagcactttgggaggccaaggcaggtggatcacctcaggtgaagagttcgagaccagcctggtcaacatggtaaaacctcgtctctactaaaactacaaaaaaaaaaattagctggacatggtggcacatgcctgtagtcccagctactcagggaggctgaggcaggagaattgcttcaacccaggaggttgaggttgcagtgagccaagatcatgccactgcactccagcctgggcgacagagggaaactccatctcaaaaaaaaaaaaaaaaaaaaaaaagaaggccaggcacggtggcttacgcctgtaatctcagcactttgggaggctgaagagggcagattgcctgaggtcaggagttcgagaccagtctggccaacatagtgaaaccccatgtctactaaaaatacaaaaaaattagccgggcatggtggcgtgtgcctgtaatcgcagctactccagaggctgaggcaggggaattgcttgaaccagggagatggaggttgcggtggagccaagatcgcactactgcaccccagcctgggtaacagagcaaactccatctcaaaaaataaaaataaataaaaataaaaataaatctactgtatctgaaatcatctcatcttccattctaaaaatagcttattttggccaggcacagtggctcacacctgtaatcccagcactttgggaggccgacacgggcagatcacaaggtcaggagatcgagaccatcgtggctaacacggtgaaaccccgtctctgctaaaaatacaaaaaattagccgggcgtggtggcaggtgcctgtagtcccagctactcgggaggctggggcaggagaatggcatgaacccaggaggtggaccttgcagtgagccgagatcgtgccactgcactccagcctgggtgatagagtgagactccatctcaaagaataaaaaataaaaaaataaatagcttatttctattctcccttcatcagtgcagactgaagtttgtctaatttattagttttaaatacaaatcaaatttttttttggaggggggaggtttaacaaatcctttccaataagtgattttattttatttatttatttatttatttatttattttttgagacggagtctcgctctcttgcccaggctgaagtgcagtggcacaatctcggctcactgcaagctccgcctcccgggttcacgccattctcctgcctcagccccccgagtagctgggactacaggcgcccaccaccacgcccggctaattttttgtatttttagtagagacggggtttcaccgtgttagccaggatggtctcgatatcctgaccttgtgatccacctgcctcggcctcccaaagtgctgggattacaggcatgagccaccacgcccggccccagtaagtgattttagctttttaactttttacttgagtgacttgagactcaaaggaaagtctcaagaatagtacaaagaatttccaaatacccttctcatctagatctcccaaatattaacattttaccacatttgcgcaggcggctgatgaaaaaggtcccaccacaaggtggcagagtaaacacgacagcacctgggcgaggctttgtgcaggcaggaaggccctcacaccagaggccgtcccagggctgtggcatgggggccattacccaggagagggcacagggccagctcctgggtatctctgagagccttagggtccttttgttgttgttgttttgatatggaatcttactctgtcacccagtctggagtgcaatggcacgatctccaacctccacctcccgggttcaagcgattctcctgcctcagcctcccgagtagctgggattacaggcccctgccattatgcctagctaatttttgtagagacagggtttccccatgttggccaggctggtcttcaactcctgacctcaggtgatccgcttgcctcagcctcccaatatgctggggttaaaggcatgagccaccgctcccagctagccttggggtcttaatagccacatggtttgtcttatacatggccggcagatgttgggtacagtttcccaggtatgcacaccaagagatctctaaatcactacaaatctgcatgtacttgggctatgattcaaacaactggggccaggcatggtgcctcacacctgtaatcccagcactcagggaggccaaggcgagaggatcccttgagcccaggagttcaaggccagcctgggaaacatagcgagacccgtctctattaaaaaataaaacaggccaggcgtggtgggtcacgcctgtaatcccagcactttggaaggccaaggcgggtggatcacgaggtcaggagatcaagaccatcatgctagctaacacggtgaaaccctgtctctactaaaaatacaaaaaattagccaggcgtggtggcgggtgcctgcagtcccaaactactcagtaggctgaggcaggagaatggcgtaaacccgggaggcagagctggcagtgagccgagatcacggcgccactgtgctccagcctgggcgacagctcaaaaaaaaaaagatttgtaacaaaataaaacaactggggccaggcatggtggcttacacctataatcccagcactcagggaggccaaggcaagaggatcccttgagcccaggagttcaaggccaaactgggcaacatagcaagacccctgtctctattagaaaataaaaaaggccaggtgtggtggctcacgcctataatcccagcactttgggaggccaaggcaggtggatcacctaagattagcagttcaagaccagcctggctggtcttgatggtgaaaccatctctactgaaactacaaaaattagccaggtgtggtggtgggtgcccgtaatcccagctactggggaggctgaggcaggagaatcacttgaacgcggggggcagaggttgcagtgaactgagatagtgccactgcactccagcctgggcaacagagcaagactgtctcaaaaaaaaaaaaaaaatactcaatttaggtttaatgtctcatgatttgattcaggtgatacatttgtggcagaaatttttttgttttaacttgctctatttttttgttttaagtgggaaaacactttattccataaaacagagtaaatgttcctctcttccttttaatttctcctcatatgcttttagctttgggggtttgcgctttttctcttttcttttcttttttttgagactgagttgcgctctgtcgcccagggtggagtgcggtggcgcaatctctgcttaccacaagctccgcctcccaggttcacgccattgtcctgcctcagcctcccgcgaagctgggactagaggcgcccaccaccgcacctggctgattttttgtatttttagtagagacggggtttcatcgtgttagccaggatggtctcgatctcctgacctcgtgatccgcccgcctcggcctcccaaagtgctgggattgcaggcatgagccaccatgcctggcttttctcttttttaaatatctttttctgggagacacagactggacaaatgggagtggatgtgccctattcctttttatatgctaaccacctgagctgaatgtcattaagtttcattctttttatttaatacatatattaggactacaataagttaaaaagaaaaaacttaaatcaattcttggaaaggttttattaaaactaataaaataattggtttgtatttaagattaataaaatcgaccagaatccaggcacaattgagcaagagaaggcatgaaaaagacaatttcagatacggtcgaggtttgattttttttttttttttttttttttttttgagatagggtgtcactctgtcgcccagacgagagtgaagcagcatgatcttggctcactgcaacctccgcctcccaggctcaagcgattctcttgcctcagcctcttgagtagctgggattacaggcgtgtgccactactgcccagctaatttttttgggggggtatttttagtagacacggggttttaccacattggccaggccggtatccaactcctgacctcaaatgatacacctgccttggcctcccaaagtgctgggattacaggagtgagccacagcacccggccatggtcgagttttataattgtaagattactctaagcctggcgtgatggctcatgcctgtaatcccagcactttgggaggccaaggcgggcggatcacgaggtcaggagttcgagaccagcctgaccaacatgatgaaaccccatctctactaaaaatacaaaaatcagcctggcgtgggggtgcccgcctgtaatcccagctatttaggaggctgaggcaggagaatcgcttgaaccggggagttggaggttgcagtgagctgagattgtgccactgcactccagcctgggcgacagagtgagactcagtctcaaaaaaaaagaaaaaaaaaggaaaagaaaaacctctttcagtaagacccaagcgcaagtgtgatagaaaaaccaccataaaaacatttgctcttatcaagatttaaaaccatagtaccagtttcattctctccccaaatcaagtgagtttcatcttaaaaaaagcatcagacagacatcctccgccaactccatcacatcacaccaccccgagtgttgctcacctttcttcaccaagggctagaaaagaacagtctacacggaactggcgcagccgcctccttctccgccagtctccaacagaggtgctggcactgtcccgccttagtctggcgtctcccgtctccctactcaattttctcacaccctcagtccaaccctcataactctacttcctgcaggggtactttgaccaacacccaaatatgatcatgcctctgccttgaagtactgcatttgcagctggagcaagagggagaccccagcctcggaccttgctggtcaggcccccaccccgcccccagcctcacggggcgccccccctgtgccgagtcctcagtatcacccatcattactccttagggatgctcctccctggtcctcaaagaccctattgtcctttcatctgcaacatcttatttttctttaagtctgacctgaagtcagttgaccttccccagttgaaactgatcctccctcccctgggtgtccatgcatcctgacagttgaggtaactaacagggcgcctacccctggatcgcccccacatgttaacgtgaccaacacctctgtaggactgcatccaacgagggaccccagctccgtgctcccccagatcggacccaggcactcagtagatgttttgaatgagcccagacgcctgaaataacccccctccacaccctgccttcgtttccctcctagctcagtgcccaccactggctgtgatcagggttctgcatgagccaggttggagaggaagaagggggttaccctctgcaagagacggggactttccccaacagccccactcttccccctagagacccaggcaccgcagtgcagtggagatcaggggcctggatgggcagagaagctccaggggaagggacggcaacaaacccactcttggggaagagcggggtcccctgtgcagagaacaagcccccagctcacccgcgtccaagtggtcacagtggcaggtgccctgcgcgagcttccaggggacggtggggtccgaggaggcagagctgcggggaggggcagtgagatgaggggccagccgctgctcgggacccaccactacctgtggcgtcccccagcccaacttggcagcacccgacaacccgcggagacgtctggaggagccgcccccaggaccccagtgcagtgccggctctgcagcaagtgggtgccggccacgctggcgctgcgcacagcccgggagccaagacgccgttcctcccacacgtgtctgaggtgtcagtcgccatgggaacagcctggggtccggaagtgcgcgcattgcagtcttgcacctcaaaacactgcgtaaaagaaccccctgggactacaactcccagaacccccccacgatgccatgattccggttaggccaccctgcacttccagccacagccatggctgcagtcacatgggaggtggccatgggctggcagggtgtggcgctatggctctggctgacacagagctgggggtgaatgcgccctcttacatgtcccccatggccaagggtggccctcatgggccccacgtgtctgatctgatctgccccaagccctgttccatcctgtggggcgggatatggctggcccgaactcgaagtcccacctgggactggcactgggcctccttcctagagagtctgttacctggggagatcataaaaatatttatttatttagagatagagttttgctcgtcgcccaggctggagtgcagtggcatgatcttggcccactgcaacctctgcctcccaggttcaagcggttctcctgcctcggcctccctagtagctgggattacaggcacccaccaccatgcccagctaattttttgtatttttaatagagatggggtttcaccatattggccagactggtctcgaactcctgacctcaggtgatccacccacctgggcctcccaattgctgggattacaggtgtgagccaccatgcctggccaagaattttttaagactatgctctggctctgtcacccaggctggagtgcagctgcacgatcagagctcactgcaggctccaactcctgggctcaagtgatcctcccccatcagcttccccagtagctgaaactgcaggcccgcaccaccatgctggctaatttttttatttcttattttgtaaagatagggtctccctatgttgcccaggctagactttaactcctgggctcaatgaatcctcctgctgggattacaggcgtgagccacagtgcctggctaaaaactttatttttatattaaggcctatccttcagtcctcatgatagtccccaaaatagatgtcattactttcatttcataggcgaggaatcagaggtagcccatctcaatatttaccttggaggaacccctgcataaaaatgatgtctgggacccgggcgtggtggcttgctcgtgtaatcccagctacttgggaggctgaggcgggaggctcagttgaggtcagaagtcaaggctgcagtgagccaggattgcactgctgcactccagcctgggaaacagtgagacctccatctctttttttaaaaaaattttatctgtaggccaggcacagtggctcacgcctgtaatcccagcactttgggaagccaaggcaagtggatcacttgaggtcaggagtttgaggccaacatggctaagtctcgtctcttctaaaaatacaaaaattagccgggcgtggtggcacctgtaatcctatctactcaggaggctgagacaggagaattgcttgaacccgggagtggaggttgcagtgagtagagatcgtactattgcattccagcctgggcgacagaacacgagcccatctcaaaaaaaaaaaaaggccgggtgcggtggcttacatctgtaatcccagtactttgggaggctgaggcaggcagatcacgaggtctggagttcgagaccagcctagccaatgtggtgaaaccctgtctctactaaaaatacaaaaattagccggatgcagtggcgagtgtctgtaatcccagctactcgggaggctgaggcagaagaatcacttgaatccaggaggcgaaggttgcagtgagccaagatcacaccattgcactgcagcctgaatgaaagagcgagactccatcaccaaataacttaaaaaataaatttatccaaaacttacaaagtgagagtaaaagaagtttaataaagtttaaaatgatgctttttgtatgcttgaccatttctacctttgaagttagtaatgtttaaaactttgagatatcctagtttatttaacttagtaaattagaattcctgttttacaatgttaatggaattgtctgtagagttcaaacaagcataatatttgtctaaaattgatattccttatggtttcatatatcatggagggggacactgaatgtctccatgtgattttatttgaaaattatccaatgatttcagtttttaatatgtttaaacagtaagcttcatatcaatctattttgaattactggacacagccactgagactttttaaaatttactcttagatccggcctatggtttgttgttttgagccagggtttcactctgttgcccgggctggagggcagtggcatgatcacggctcactgcagcctcaacctccccaggctcaggtgatccgcccacctcagcctcctgagtagctggaactacaggcatatgccaccatgcccagctaatcatgctctttttgagtgggagaaaaacaatccttttattttataacatgggatcgcttgttggtttttttgtttgtttgtttttctgagacagcttggaatgcagtagtgcgatctgcagcctcgacctccaaggctcaagaaatcctctcacctcagcctcctgaggagcttgggccacaggcacatgctgccatgcccagctaattctgttaatttttgtagagatgtggtctatgttgcccaagctagtcttgaattcctgagctcaagggatcctcccatcttagcctccccaagtgctgggattaaaggcataagacgccacacccagccgcccagctggcttttccttttgtttctacaaaaatattttgtctctttgtaaaaggttttgtatctggtttcctggatcaagtttggacatcagtaattggagtcctttgcacattcaactacatagatttctaacttgtggtagattctacctgtggtttctaccgtgtggttctagagagaattatcaacactaggccgggcgcagtggctcatgcctgtaatcccagcactttaggaggccgaggcaggcagatcacgaggacaggagttcgagatcatcatggctaacatggtgaaaccctggctctactaaaaatacacaaaattagccaggtgtgatggtgtaggcctgtaatcccagctgctcaggaggctgaggcaggagaattgcgtgaacccagcagacaaaggttgcagggagccgagatagcaccattgcactccagccctgagcccacagtgtgtgactccatctcaaaaaaacaaaacaaaacaaaaagaaaacaaataaacagtagaaatcatctccataaaaatgattcatttacaaatcttgtgggtggagactcttttcagaataatccttttggggccaggcacagtggctcacacctgtaaacccagcactttggaaggccaaggtgggtggatcacctgaggtcaggagtttcagaccagcctgaccaacattgcgaaaccccgtctctactaaaaatacaaaaattagccagcagctcacgcctgtaatcctagcactttgggaggccaagatgggcggatcacctgaggtcgggagtttgagaccagcctgaccaacagggcaaaaccccgtctctactaaatatacaaaaaaaattaaccacgtgtggtggcgcatgcctgtaatcccagctactcgggaggctgaggcaggagaatcatttgaacccaggaggcggaggttgcagtgagccaagattgcaccactgcactccagcctgagcaacaagaacgaaacttcatctcaaaaataaaaataaaaaaataaaaacattagctgggcgtggtggtgggccctgtaatcccagctactcaggaggctgagtcaggagaattgtttgaaagagaatcacttgaatccaggaggcagaggttgcagtaagccgagatttcgccacagcactccagcctgggcgacagagcaagactctgtctcaaaaaaaaaaaaaaaaaaaaaaaaattatatatatgcatataaaagaataatccttttggggttttacgtcatttgttcctttcttcctctttaggtcattttggttatacatattttcttccagattgtcctttaatcaggacatgtttttaactcagatatttgttatgcctattactttttcaagatttctctacaaatttgtattttagatcagtggggaaaaaatacactatgtagaccctcaaacaccatgggtttgaacttcgaaggtccacttatatgcaggtttttttttcttcaaccaaacacaaatagaaaatacagtatttgagggatgtgaaactcaaataaatacaagcccaacttttcatatacacagttccgcaaggccaactgtgggatttgagtatggcagatttgggtatgagggtgatatggtttgggtctgtgtccccgcccaaatttcatgttaaattataatccccggctggccgcgctggctcacacctgtaatcccagcactttgggaggccgaggcaggtggatcacctgaggtcaggagttcgagaccaccctggccaacatgatgaaactccgtctctactaaaaaaacaaagattagccggacatggtggtacatgcctgtaatccaagctacttgggaggctgaggcaggagaactgcttgaagccgggaggcagaggctgcagtgagctgagattgcaccactgcactccagcctgggcaacaaagcaagactccatctcaggaaaaaaaaaaaaaaaaaaaattataatccccagtgttggaggtgggtctggtgggaggcgattggatcatgggggtaggtttcccctttcgtgctgtactcgtgagagtgagtgacttatcatgagagctggttgtttaaaagtgtgcagcacctcccgtctttctctctcttcctcctgctctggccatgtaagacattcctgcttcccctttgccttccgccatgactgtcagtttcctgaggcctccccagccacgcttcctgtacaggctgcagaactgtgagtcaattagacctcttttctttataaattacccagtctcaggtagttcttcatagcagtatgagaatgaactaatacaaaggggttgtgtcctggaaccaatcccctccaaatatgaagggctgactttattttattatggtacaaaggctagtacagtggctcccacctgtaatcccagcactttgggaggccaaggtaggaggatcgcgtgaacctgggagcttgaggctgcagtgagctatgatcacaccactgcactccaacctgaccagcagagcgagaccctgtctcaaaaaaaaaaaaagtaataataggctgggggagggggctcatgcctgtaatcccagcactttgagaggccaaggcgggcggaccacaaggtcaggagttcaagaccagcctggccaacatggtgaaaccctgtctctactaaaatacaaaaattagctgggtgtggtggcaggcatctgtaatcccagctactaggaaagctgaggcaggagaattgcttgaacccaggaggcagagtttgcagtaaggagagacagcgccactgcactctagcttgggcaacaaattgagactccctctcaaaaaaaaaaaaaagaaaagaaaaagtaataataaatggttgaaaatgttttccttcccaataaattcatggttgctatgaaacagtagcaaaaaaaattaaattcctatatctatttttagagagttttccaataatttctcttttatattgattagtgtcaccagagatttgtctatcacttgtttatttttccaaagataaaatctttattatttttcctatcttccctagtaagagagaaaataaaactcttacagctatcatcttctaatatcaagataacatgaaaactcctgtaaaatgaatgggaaggggaatattccaactctaattacaaaatgagagctaagaacgtatgcaactatattatttaggacatggataaaactgctgtaatagagctcccaaaataaaagtgctctaaaaattactgataaagccgaacgtggtggctcatatctgtaatcccagcattttggaaggctgaggtgggtggatcacttgaggccaggagttcaagaccagcctgggcaacatggtgaaaccctgtctctactaaaaaatacaaaaatttgtcggaagtagtggctcatgcctgtaatccagcactttgggaggccgaggcaggtggatcctgaggtcaagagatcaagaccaccctggccaacacggtgaaaccccgtctctactaaaaatgcaaaaattagctgggtgtggtggtgcgcacctgtagtcccagctattcaggaggctgagacaggagaatcgcttgaacccaggaggcagaggttgcagtgagccaagatcacaccactgcactccagcctggcaagagagcaagactctgtctccaaaaaaaaaaaaaaaaaaatttgccaggtgtggtggtgcacacctgtctgtagtgctagctacttgggaggctgaggcagaaggattgctcgaactcagaaggtggaagttgcagtgagccaagatcatgccactaatccacagcctgggcaacagagtgagactatctcaaaaaaaaaaaaaaatcaccaatgattatttctcattaaaaaaatccatgtgactccgaaggagtcagaaaactagactcctaaatgagtgctctagctgggcttggtggttcacacctgtaattccagcactttgggagcctacggtgggaggatcgattgagcccagttcaagaccagcctgggcaacatggcaagacatcatctctaaaaaactttttttttctcacgcctgtaatcccagcactttgggaggccaagacgggtggatcacgaggtcaggagatcgagacaatcctggctaacacggtgaaaccccgtctctactaaaaatacaaaaaattagccgggtgtgttggcaggcgcctgtagtcccagctactcgggacaatggcgtgaatccaagaggcggagcttgcagtgagccaagatcgcgcccctgcactccagcctgggcgacagagcaagactccatctcaaacacaaacaaacaaacaaaaacacccttaggtaatgatcaccaatgactgctgacatctttttgaaaaaaaaaaaataagaaaaccagacatcctgtccatctatatggctgtacacgacatcacctatgagtaatcctggggaaaaaaaaaaaaaaaaaacttgagtctaagcctcttgatctaatcaacaaattacaggacataaaagggcagcagaaaaatatgtcaaatgacaccacaatgagacaatctgcaaaatccaggctgtaagaaattctacacttttttctacaaataaaatgccaacagagagagggacggaggaaaggaagagagggagaaggaatctatggatcacaagagaatcaaggaacatatcactagtgatatatggatcctattatctaaacaagagctcactgagctttccaattcatgtgcttcctcttgttaaccgcactggctcattccgggtcttctgtgccatcctgcttccaggtctccactgggaaaaaatagcaacaggaaaaatggcattttatcagggccatgtactgggaagatgcttaacactgtctccatggtttgatattttatatatataatatataatgaatatatataacataaaaatatatatttgtatgtaaaatataaaaatatggatatataaaatataaatataaaataggccaggcatggtggctcacgcctgtaatctcagcactttggaaggccaaggtgggtggatcacctgaggtcaggagtttgagaccagcctggccaacatggtgaaacctcgtctctactaaaaatagaaaaattacctaggtgtggtggcaggtgcctataatcccagctactctggaggctgaggcaggagactcgcttgacccgggaggtggaggctgcagcgagctgagatcataccattgcgctccagcctgggtgacagagtaagactctgtctcagaaaaaaatatatataattatatatatgtaatataaaatgttatttatatgtaatatattgcataaatatattttatatgtaatataaatatatttttatgtaatataaaaatacataaatgcaaaactatttatatataaattacaatatattttatataatatggtttgtattatatattatatactatatattatataaatatgtctttataaagatttttatatcatatagttcatattataaatatatagtttatattatatataatatgtaacagatgatatctttttttttttttgagacagagcgttgctctgtcacccaggctggagtgcagtggctcgatcttggctcactgcaagctccgcctcccgggttcatgccattgtcctgcctcagcctcccgagtagctgggactacaggcacccgccaccacgcctggctaattttttgtatttttagtagagacggggtttcatcatgtaagccaggatggtcttgatctcctgaccttgtgatccacccacctcggcctcccaaagtgctgggattacaggcatgagccactgcacccggtgacttttttttttttttttttttttttttgagacagtctcgctctgtcacccaagctggagtgcactggggcaatctgggctcactgcagcctctgcctcccaggttcaagtgatctccccacctcagcctcccaagtaggtaggattacagacatgtgtcaccatgcctggctgattttttgttttgtttctttgagacagagtctcgctctgtcacccaggctggagtgcagtggcccaatcttggctcattgcaacctctgcctcccaggttctggtgattttcctgcctcagcctcccaaatagctgggactacagtcacatgccaccatacccagctgatttttgtaattttagtagacatgaggtttcaccatgttggccaggatggtctcaatctcttgacctggtgatctgcccacctcgacctcccaaggtactgggattacaggtgtgagccaccgtgcctggcccttttttaatatttttaatagagaaggggtttcaccatgttggccaggctggtcttgaacttctaacctcgagtgatctgtgtccttcagcctcccaaagtgctgggattataggcatgagccgtcacactgggcctataatacatattatatattatatataaataatatatttttatattacaatgttttccttttcagaggcagggtctcactctgttgctgaggctggagtgcagtggtgtggtcaaagctcactgcagcctcaactttctggactcaagagatccttccaccccagcctaccaagtatctgggactacaggcgcacaccaccatgcctggctaatttttgtatcttttgtagaggcaaggtttcactctgttgcccaggctggtcttgcattccgggcttcaagcgatcctcctgcctcagactcccaaagtgctaggactgcgggtgtgagccaccaagatcaatttcttcattcccccaaaaatagaagccatggaggctcctgactgcctggtggctgccaatgatttttcaccaacagacccctgccccttttttttttttttttttttaacatcataaggcagcctcctgtctcctctgcagagcacctgtttcacctttgtatacaggacacctccagtgaactttgactcctcatggtagccctgagagcaactaaccctgttctgcacctggggaaactgtagcccagattgtttagccaacgttcagtaagttagtgaccaggtagtgtattagtctgttctcgcactgctataaagaaatacctggccaggcgcggtggctcacacctgtaatcccagcactctgggaggccgaggcaggcgaatcaccaggccaggagatcaagaccatcctgactaacacggtgaaaccctgtctctactaaaaatacaaaaaactagccaggtgtggtggtgggcgcttgtagtcccagctactcgggaggctgaggcaggagaatggcgtgaacccgggaggcggagtttgcagtgagccgagatcgtccactgcactccagcctgggtgacagagcgagactccgtctcaaaaaaaaaaaaaaatcaaaacaaaacaaaaacaaacaaaacaaaacagaaatacctgaaggccaggcacagtggttcacgcctgtaatcccaacactttgggaggccaaggcgggtagatcatgaggtcaggagatggagaccatcctggctaacacagtgaaaccccatctctactaaaaatacaaaaaattagccgggcgtggtggtgggcgcctatagtcccagctactcaggaggctgaggcaggagaatggcatgaacccggggggcagagcttgcactgagctgagattgcgccactgcactccagcctgggtgacagagcgagactccgtcccagaaaaaaaaaagaaagaaagaaagaaagaaagaaatacacagtggcttacggctataatgccagcactttgggaggccaagtctggcagatgacctgaggtcaggagttcaagaccagcctggctaacatggtgaaaccccatctctactacaaatataaaaattagccaggcatggtggcgggtacctataatcccagctactctggaggctgaggcaggagaatcacttgaatccaggaggcggaggttgcagtgagctgagatcacaccactacattccggcctgggcaacagagtgagactcagactcaaaaacaaacaaacaaaattttaaaaagaaaaaataaatacataaataaataaacccaagactgggtaatttatgaaggaaagaggtttaattgactcacagttccacattgctgggaaggcctcaggaaaattactgtcatggcgaaaggcaaaggagaagcaggcaccttctcaggaagcaggatggagtgagtgcaagcaggggaaatgccagtgcatataaaaccatcggacacctcaagactcactcactatcaggagagcagaatgggggaaactgcccccatgatccgattacctccacctgtcccgctcttgacacgtggggattatgggattacaattcaagatgagattctaggtggggacccaaaccctaaccataccaggtagggactagaaatctgcttcccaaactcctactccaatgctatgctctctggacactgtgtcccagtcctggaaggaaagagaacaagaaactcagatggcctggactgagggcaaaggagggtgaggctggcactgacatcctcagaggctcctgcagggtcgtgtgtatgaaacccaagcccaagcttcatgccctgccccccaaaagcagggaatgcacactgtagcaaatgctaagccagctctctagcacgtgaaacagtcttgttcagagacaggagagggctgctctccagtggttcttcaaggctgctttctccctgcctagtctgaaggattgctttctcttttctgcatttagtatttttggactgcggttgacctcggctaactgactgttagtaagaggggaaaccactgtagttcaaaactccagtcttggtggggcgctgtggctcaggcctgcaatcccagcactttgggaggctgaggtgggaggagcacttgaagccaggagttccagaccagcctgtgcaacatagcgacatcccatctctacaaaaaatgtaaagattagccaggcatggtgatgtatgcctgttgtcccagctgattgggaggctgaggtgggaggattgcttgagcaaacctcctctaaaccatgagttcaagactgcggtcagctatgattgcaccactgcactccagcctgtgcaacagagtgagactctgtcttaaaagtaaataggctgggcatggtggctcacgcctgtaatcctagcagtttgggaggctgaggcaggaagatcatcacattcccacttctgtcctcatcgcccatccctcacctcccttctcatcctaaaagagctaaaggattgcttttattgatgaaccgtacattgtatgcgaacacacagaacctcagtgtgcagtttgatgggtttagacacccatgtaactgaaacacaatcaggatacagcagtgtccatgctcccagaaagctccttcatgtctcttttcactcaatccccttccccttggactgcaaataggaaaggttctgatacttcccagagcactcaaactttctgggtctctctgccagccagcggttctgggcaagccatctacccatcagaccatcaggcccctgcgaaacagcagtcaccggccacttccctgaagacacaagtaatcatgctgtccactctgctggctgtcaccatgaggtcacccaggtcaagcagcgagtatactttaaaaaaaaaacaaaaaacacttcctctggccaggcgcgatggttcacacccgtaatcccaggactttgggaggccgaggcaggtggatcacctgaggtcaggagttccagcactggccaacatggtgaaaataaaaaaaaaattagctgggcgtggtggcacacgcctgtaatcccagctacttgggagactgaggcaggagaatcgcttgaacccgggagccagaggctgcagggagctgagatcgcgccattgtactccagtctggacaacagagtgagactccatctcagaaaaaaaaaaagaaagaaagaaaagaaatggcaaacttcctctaaaacttttcacacaaagcttattcttccttctctgtctgcacccgagacctcacgctcagtttatccgtggctaaaatctgcggcaaagccagccctgatcaagagggtgaggatgcctgtaattaccttagcaacagaacatgctgtgcatttgaatcacatcatctcatccccatagcaacacagaatcgcagaatcactgtgctctggagccaagtggcaacagcgctgagtccaacctcttagattaaaacaaaacccaacagaaacaaacaaaaaaagtcgtttaccattcagatagctttcatagtcttgtacttatttttttgttgttgtttggaaataaaatgaactttgataccaataagatagcaaggaacatccacttgggctgctgggtttttggctgatttaatcagaggctttgtcctatgttattaggaacaaaaaagaattttttgattgatggaagtagagcgagtcggccagggatgaacgtagagatgttgatatcagagaccacagagctgtggcaagaattcctcattcatttatgaaacacgtcttcatgagattgcatccttctctgcctctgaggtcggcgtgcaaagaacgaccttctcttttatcagctggggactgtaaaagggaaatatgtgcccggcgcggtggttcacgcctgtaatcccaacactttgagaggccgagatgggcggatcacgaggtcaggagatcgagacaatcctgactaatacagtgaaatcccatctccactaaaaatacaaaaaaatagccgggcgtggtggcacgcacctgtagtcccagctactcaggaggctgaggcaggagaatggtgtgaccccgggaggcggagcttgcagtgaaccgagatcatgtcactgcactccagcctgggcaacagagcaagactctgtctcaaaaaaaaaaaaaaaaaaaaaaaaagaaagaaatattttctctgcagtctcctgacaccaactcctggcctcaaggaagttctccagggcagagggtaacaatacgaaatgtaaacatgggatgtgggtgtggttcaatacctcatcctgatatcggctctaccttttggctatgtcttggtctaattcaaaaccatgaactctggggcaggggatatctcagtagcctccttaggaacatgctacaagctgagatcaacagagcaggggacattggaggttgcacttcaaagatgaatgggggccaggagcagaggctgatgagtgtaatcccagcactttgggaggccgaggtaggtggatcacttgaggccaggagttcaaggccaacatggtgaaaccctgtctctactaaaaatacaaaaaaattaggcgagcatggtggcacacacctgtggtctcagctactcaggaggctgaggcacaagaatcgcttgaacctaggaggtggaggttgcagtgagtcaagatagtgccactgaactccagcctgggcaacaaagcaagactccatctcaaaaaaataaaaaagatgaatgaatcctctccaagcaagaaacgtcctgggggcaggaaagcatccatttctgcatcctcagcatctagcacagtttccagcatatatcaggtgctgaaaaaaactttttaaaaggccaggcacagtggctcacgcctgtaatcccagcactttgggaggccgaggcaggaggatcgcttgagcccaaaagtttgagacccgcctggggcaacatggtgaaaccctgtctctacaaaaaattagccaggcatggcggcacatgcctgtactcccagatacccaggaggctgagatgggaggataacctgagcctgggaggtcgaggctatagtgagtcgtaattgagccactgcactccagcctggatgagtgagaccttgtctcaaaaacaaaacaaaacaaaaatcttaaaaaaaaatagactgggggccaggcgtggtagctcatgcctgtaatctcagcactttgggagatcggggccagcggatcacctgaggtcaggagttcaagaccagcctagccaatgtggcgaaaccttgtctttactaagaatacaaaaaaaattagctgggcgtggtggcacgcgcctgaagtcccggctactcaagaggctgaggcacaagaatcgcttgaacccgggtggtggaggttgcagtgaactgatatccggccactgcactccagcttgggtgacagagcgagactccatctcaatttaaaaaaaaaattatatatatatatatatatatatgtacacacacaaaaaaattagctgagcatggtggcaggcgcggtaatcccagctacttcggagcctgagatgggagaatagcttgaactcaggacgtggaggttgcagtgagccgaaatcgcgccagtgcactccagcctgggcaacagagcaagactccatctcaaaaaaaatagatgctgggttttgccatgttgcccaggctggtctcaagctcctggcctcaagtgatcctccttgctcggccttccaaagtgctggattacaggctggagccaccatatctgggcctgaaaaaactatgtcctcgtgttacaggagcatatttgacaggctcatttaaatatccccacttccatcaagaactgaccaaagctaccaagggtcatgggggagaaatccaccagccttatcaaacccctacaaccctacggtttcacatatgggtggaccaagtgcctacaaacagccagataggacttgcagtttggcacagaaggatcttggaagtcaccacactgagctcacaaataaaaagctgtacaaactgaacagtcaacaactcctctgaaatccatccgtggagggaggtcacagggcaaactccccgccgcaaaattggagagacaggcggatacagagaattaaaacttacctgcatagaaacccacgggcagaagccccacaccggacccagtgaagaggggtgggaagagcagaaggctgaggagctgaattgctgtgcccggctgaagaagtctgagacagaaactcccagcagggccgggcgcggtggctcacgcctgtaatcccagcacttggggaggccaaggcgggggatcacgaggtcaggagttctagaccatcccggctaacacggtgaaaccccgtctctactaaaaatacacaaaattagccaggcgtagtggcaggcgcctgtagtcccagctactggggaggccgaggcaggagaatcgcttgaacccgggaggcggagcttgcagtgagcagagatcacgccattgcactccagcctgggcgacggagcgaaactccgtcacaaaacaaaacaaacctccgagcggacccagacagggcgccctgtgctcttgtgagttttacctacagaggctcaaccaggttctcagagtgaatattagagaaaaatcccctcgtgcctccagcagggggaggggaagagagacaagcccgggctttccgttcttaacaaggccaaccctcaggagaaactacttaaccacagctgaacctgctggggcttcatcagtgcctacctgacctgggggaagaaaaatacccaactccagctggccctagccttccacctggagaaaaggaaaaacccaaccccagcccccaggagccgtcctgtcccgcctcagcaggtgacttggggtgttaataagcacttatgaagtccagtccagaggcacaggctcactaaaggattaagatctggccgggcacagccgggcgcggtggctcacgcctgtaactccagcactttgggaggccgaggcaggcgcatcacgaggtcaggagatggagaccatcctggctaacacggtgaaatcccgtgtgtactaaaaatacaaaaaattaaccgggcgtggtagcaggtgcctgtagtcccagctactcgggaggctgaggcaggagaatggcgtgaacccgggaggcagagcttgcagtgagcacagattgcgccactgcactccagcctgggcgacagagtgagactctgtctcaaaaaaaaaaaaaaaagatctgtccgggcacaatggctcatgcccagaatcccagtactttgggaggttgaggtgggaggattgcttgagctgaagagtttaagaccagcctgagcaatatagtgagacctcatctttaaaaaataataataatttaaaacaaagattaagacctgctcagaggactattacagaaggcttctcctcccaccacaccttaccactactctcccccaggtctatttatagcagctccttttacccaataaattatgtccagttatcggagaaaaaattacaaggcataataaaatgcaaaaaccatccagaagctttgtagaaggtgtttttttaaaaggtcagccgggcgcagtggctcacgcctgtaatctcagcactttgggaggccgaggagggtggatcagctgaggtcaggagttcaagaccagcctggccaacatggtgaaactcccatctctactaaaaacacacaaaaattagttgggcatggcggtgtgcgcctgtggtcccagctgctcaggaggctgaggcaggagaatcgtttgaacccgggaggcggaggttgcaacgagccaaaatggcaccactgcctccagtctgggtgacagagcgagatgccatctctaaataaataaataaataaataagtaaataaagaggtggggaaagctataccatgataatactaaacaaagaagacctcaaagcaaagaaagttatcagagcttaagaggcattacagccaggtgttccattcacatcgataatcccagcactttgggagaccaaggtgggggggattgcttgagcccaggagtttgtgatcaacctgggcaacatagcaagaccctgtctctacaataaataaaaatatatgtacatatatcagctggtcatggtggtgcataccgtagtcccagctacttaggagaccaaaactggaggatcacttgatcctgggagctccagatttcagtgagtcatggtcacaccagtgtactccagcctcggtgacagaatgagaccctgtgccaggaaaaaaaaaaagaggggcattacagaatgataaaggagtccgttctccaaaaacacataattaatccctaatgtgtatgcacctaacaaaagcatcagaatacatgaggttagaagtgctggaactaggccgggcacagtggctcacgcctggaatcccagcactttgggaggccgagaagggtggatcacctgagggcaggagttcaagaccagcctggccaacatggtgaaaccccgtctctactaaaaatacaaaaaattagccgggcatggtggcaggcgcctgtaatcccagctacttgggaggctgaggcaggagactcgcttgaaccagggaggtggaagttgcggtgagctgagattgcgccattgcactccagcctgggcgacaagagcgaaattctgtctcaaaaaaaaaagtggtggaatggcacagagaaattgataaagtacgatggtatttcaagacttactgtaaagctacggtaatcaggacagtgtgatattagtgaaaaaaatagataaatagatcaatgagccaggtgcagtgtctcacgcctgtaatcccagcactttgggaggccaaggcaggtggttcacttaaggtcaggagaatgagaccaccctggacaacatggcgaaacactgtctcttaaaaaacaaaatagatcagttgaatagaacagacatctcagaaacagacccacataaatagagtcaaatgacctttgacggaagagcaaaggcaatacaatgagcaaagacaaagacggtctttttaacaaatgttgctgaacaactggatggacatccacatgcaaacaactgagtccagactctgaccttacacacttcacagaattaattcagatggatcagagacctaaatgtaaaggtcaaaaccataaaacttttagaaggtaacacaggagaaaatctagataacttcaggtttggtaatgactttttagatacaacgccaaaggtgggattcatgaaagaaagaattgggccgggtgcaatggctcacgcctgtaatcccagcactttgagaggctgaggtgggcagataacctgaggtcgggagtttgagaccagcctgaccaacatggagaaaccccacctctactaaaaatacaaaattagccaggtatggtggcacatgcctgtaatcccagctactcgggaggctgagacaggagaatcacttgaacccgggaggcagaggttgcagtgagccgacatcatgccattgcactccagcctgggcaacaagagtgaaactccgtctcaaaaaaaaaaaaaaaaaaaaaaaaacagaaaaaaaattgctaagttggacttcactgaattaaaaaatgtcttccctctgaaagatgttgtcaagagaatgaaaagacaagccgcagactgggagaaaatatttgctaaagatatagctgataaagaaggacggttggccgggcgcggtggcttactcttgtaatcccagcactttgggaggccgagatgggcagatcacgaggtcaggagatcgagaccatcctggctaacacggtgaaaccccgtctctactaaaaatacagaaaattagccaggcgtggcagcatgcacctgtagtcccagctactggggaggctgaggcaggagaatggcgtgaacctgggaggcggaagcttgcagtgagccaagatcacaccactgcactccagcctgggcgacagagtgagactcagtctcaaaaaaaataaaaaatgaagaaggactgttaaccaaaatatacaaagaactcttgaaactcaacaataggaaaacaacctgatttttaaatgggccaaaagaccttaagagacatctttccaaagaagatatacaggtggagaccggtcacggtggctcacacctgtaatcccaccactttgggaggccgaggcaggcagatcacaaggtcaggagatcgagaccatcctggctaatacagtgaaacctcgtctctactaaaaatacaaaaaattagctgggcatggtggcaggcacctgtagtcccagctactggggaggctgaggcaggagaatggcatgaacccaggaggtggagcttgcagtgagccaagatcacgccactgcactccagcctgggtgacagagcaacacaccatctcaaaaaaaaaaaaaagatacacaggtggcaaatatgcatatgaaaagatgcttcatatcatatgtcattgggaaaatgcaaactgaaacaatgagatacctctacaaacctattaggatgacaaaaatccagaacacggcagagcacagtggctcatgcctgtaatcccagcactttgggaggccgaggcggacggatcacctgaggccagcagttcaagaccagcctggccaacatggtgaaaccccgtctctactaaaaatacaaaaattagctgggcgtggtggtgggcgcctgtaatcccactacttgggaggctgaggcaggagaattgcttgaacccgggaggtggaggttgcagtgagccgagatcgcgccattgcactccagcctgggggacaagaacgagacttcatctcaaaaaaaaaaaaaaaaaaatccaggacacttggctgggcgtggtgacgcatacccatagtcccagctcctcagaaggctgaggcgggaggatcaattgagcccaggacgttagggctgcagtgagctatgatggcaccactgctctccagcctgggtgacacagcgagactctgtctcagtggaaaaaaaaaattaatgctgtatgattccaactatattacattcagaaaaggcccaactatggagacagtaaaaggatccgttgctagggtctggaaacaaaaggttgccagggacaaccttttgtccctgggacggatgcacgaagggagggacgcatgaagaggcagagcacggaggatttttcgggcagggaaacgcctctgagagagctctaacagtggatgcatgttctgacacatttatccaaacccatgacatgcacgacaccaagacggaccctaatgcaaactgtggactttgtgtgaaaatgatgtcaatataggttccctgattgtaacaaatgtaccacgttggtggaagatgataatgggagaggctattagcacgggcagggaacatgtgagaactctctgtacctttcgctcaatgttgccatgaatctaaaactggcctaaaaaagtcaagtctattaaaaaaaaaagacgcggtgagcattgggaagaaagggacagggcacatgccttcctcatggaaatcatgcaaacatatattaaaaaaaaaaagacacagtgagcattgggaagaaagggacagagcacatgccttcctcatggaaatcatgcaaacatatcttctgaagaagaccccactttttttatttttattttttttgagatggagtttcgctctttcacccagtggcatgatcttgactcactgcaacctccaacccccaggttcaagctatcctccagcctcagcctcccgagtagatggggttataggcgcccaccaccatgcctggctaattttggtattttttagtagagacggggtttcgccatgttggccaggctgttcttgaactcctgacctcaggtgatccacctgcctcagcctcccaaagtgctgggattacaggcatgagccaccgcggccggccagaccctacttttgagtggggtcttctgcagatgagcctgagaaggccagcaggattaggtgaccaggaagaaaagagatctttgcatcttcagatgtatgggagcaccgcccatggcaaatctaaacatgagcagctccgggcaccatgaagtgggcataggaagatcaaaagagactgaagaatctttcttttttttttttgagacggagtctagttctgtcacccgggctggaatagagtggcatgctctcagctcaccgcaacctccatctccaaagttcaagcgattctcctgtctcagcctcctgaacagctgggattacaggcatgcatcaccacaccggctaatttttgtatttttagtagagatggggtttcacagtgttggccaggctggtctcaaactcctggcctcaagtgatccacctgctgcagcctcccaaagtgctgggattacaagcatgagcgaccatacccggcccaaaagaagctgaagaatcttaattttaactttcaaattttattgatgtaattattgttagagtcagggtctcgctctgtctcccaggctagagtgcagtggtgcaatcacagctcactgtagcctccaactcctggcctcaatcaatcctcctgccttagcctcccaaagtgctgcacttacagatgtgagccacggtgcctggcccttaatttttaaaaaaagcttatgtatctcagaaaatatttctttccggccgggcctggtggctcacacctgtaagcccaggactttgggaggtggaggcaggcggatcacctgaggtcaggagttcaagaccggtctggccaacatggcgaaaccatgtctctactaaaaacacacaaaaaagttagcagggcgtggtgatgggtgcctgtaatcccagctactcaggaggctgaggcacaagaatcgcttgaacccgggaggcggaggttgcagtgagccaagatcgcaccattgcactccagcctgggcaacaagagtgaaactccatctcaaaaaaaaaaaaaaaagaaaaagaaattgtttctttccaacaggagagagcccagcacttatagggaagccctgagcatggattcaggttaaatggcattggatcatggcgggtaactgcaagagaagcaactacagggttgtgaggggatgaaggagccagaaggaacagatctcaggatacagataacagccttgaatccgccaggcacggtagctcatggctgtaatcccagtactttgggtggctgaggcaggcaggtcacctgaggtcaggagttcgagaccagcatggccaacatggtgaaaccccgtctctactaaaaactaccgcgggaggctaaggcgggtggatcacaaggtcaagaaatcaagaccatcctggccaacatggtgaaaccccatctctactaaaaatacaaaaattagctgggcgtggtggcacacgctgtagtcccagctacttgggaggctgaggcaggcgaatcacttgaacccaggaggtagaggctgcagtgagccgagattgcaccactgcactccagcctagcaccagagctgagactgtgtctcaaaaacaaaacaaaacaaaacaaaacaaaactacaaaaattagctgggtgtggtgggatgcacctgtaaccccagctactcaggaggctgaggcaggagaatcgcttgaacccaggaagcggaggttgcagtgagccgagattgcaccattgcactccagcctgggtgacagagcaaaactctgtctccaaaaaaaaaaaaaaagtagcttaaaccaatagccaagggagttagagtcaccagatacttggttctctatagaaattaaagataacatcttgggcctggtatggtggcacacacctatatttccttcactttaggaggccaaggcgggcggactgcttgagctcaggagtttgagaccagcctgggcaacatagcaagacccctgcctgcactaaaaatacaaaacatttgccgggcgtggtgacacatgcatgtggtctcagctactcaggaggctgaagtgggagaatcacccgagtccaggaagtggaggctgcagtgggcaatgattgtgccactgcactccagcagctgggagaagggagtgagaccctgtctcaaaaaaaaaaaaaaatcagtgagaggaagcaaggactgaccttcacagggtccagatgcctggcacagtgaggccaaccacccacaccaaggtttgcagcgagaaaaaagagggcatttatttgcagggcgccaagcaaggagaatctggcagctttacatccagaactccctgctggcttgcaggtaggcgtctttaaaggtaaggaggcggaggttacggcaaagtcataaatcagtatggaggctatacgttggtttggccctaaaaggtgggatatcttaaagtgggggcttacaggtcataggtggattcaaagattttttttttttatttctaattggttaaggaagagaaaactttgtttaaaaatgcggagttggccaggcgcaatggctcatgcctgtaatcccagcactttgggaggctgaggggggcggatcacctgaggtcaggagttcaggaccagcctggcaacatgataaaaccccatctctactaaaagtacaagaattaggtaggatgcggtggcgggcacctgtaatctcagctacttgggaggctgaggcaggagaaaggtagaacctgggaggcagaggttgcagtgggccaagatgatgccactgcactccagcctgggcaacagagcaagactctgtctcagaaaaaaaataataatataatataaaaataaaataaaagtacaaaaattggccaggtgcggtggcttacgcctgtaatcccaacactttgggaggccaaggcggatgaatcacccaaggtcaggggttggagacaagcctggccaacatggcaaaaccccatctctactaaaaatacaataattagctgggcgtggtggtgggtgcttgtaagcccagctactaaaaaggctgaggcaggagaattgcttgaacccggaaggcagaggttgcagtgagccgagatcatgccactgaactccaacctgggcaacagagcgagactccatttcaataaataaataggcggggtggggtggctcacacctgtaatcccagcactttgggaggccgaggtgggtggatcacgaggtcaggagttcgagaccagcccggccaagatggcgaaaccccgtctctactaaaaatacaaaaattagccaggcatggtggcatgcacctgtaatcccagctacttgggaggcagaggttgcagggagcagagatcgcactactgcactccagcctaggcgacacagcaagactccatcttgaaaaaataataataacgataaataaataaattctaagaggtagcacttagccatcagaggtgagagaaatacactgatcatacgggtggcaacgctggaatgagaaccatggcgtcctaaccccaagcaatcagtggcaatgggaaatagacctagcggtgttcctaatggattgacagctacccagtgatgtcgtggcttgatctacacaacaaaaacaacaataaaagaggtcaagagcaggccaggtatggtggctcaagcctgtaatcccagtactttgggaggccaaggtgggtggatcacccgagatcaggagttcgagaccagcctggccaacatggtgaaactccatctctactaaaaatacaaaaattagccaggcatgctggtgcgtgcctgtagtccccacagcaacttgggaagctgaggcaggagaatcgcttgaatgcttgaacctgggaggcagaggttgcagatcacgccactgcactccagcctgggggacagagagagactctgtctcaaaaaacaccacaacaaaaaacaaaacaaaaacaccagcacccacaaaggctcagcggcatgcagcagtgtggtgcgattggagtccctctggttcctagaattggagtaaggggtctggcctctgtcctccaggtgccggggagggaaggaagtaggggaaccacacactcagtgtcacaggagggtgtggcatgggtgctgggaaaaggtggtgctgccatctagggcaggagctggttccacgttgacttggggggatcagagaatgcagattccaggagacagagtccagagttttcaaaggaaatgggcaggtggtggccactgagggcagtgcctaggttcctggctgctgagcttcttttatttttctttgtatcttttttttttttttgagagagtcgtctttctctgtcacccaggctggagtgcagtagcgcaatctcggcagactgcaacctctgcctactgggttcaagcgattctcatgcctcaggtttgccagaagctgcgtttacagacgtgcaccaccatgcccacctaatttttgtatttttagtcgaaacagagtttcactatgttggccaggctggtctcaaactcctgacctcaagtgatccacccgccttggcctcccagtgttgggattacaggcgtgagccactgcactcgtcctggctgagcttaaaaataacaccatatttcattagatctagggcaccatcacctgtaagatgcatgtttctcttaggtactactaagaaagagaaatcaggccaggcaaggtagctcatatttgtaatcccagcactttggcaggctgaaggggtcggatcccctgagcccaggagtttgagaccagccagggcaacagagcaagacccatatctacaaaaaaaaatttttttttttaaattttctttgagatgaagtcttgctctgttgcccaggctggagagcagtggtgtgatctctgctcactgcaacctctgcctccccagtttaagcaattcttctggctcagcctcccaagtagctgggggttacaggcgcatgccaccacgcctggctgatttttttttcttttgttttttcctttgtatttttagtagagacggggtttcaccatgttggccaggctggtctcgaactcctgacctcaggtcatccaccaaccttggcctcccaaagtgctgggattacaggcatgatccaccgagcccagcctctacaaaaaaattttaaaaatcaactgggcatgttggcacacgcctgtaatcccagctactggggaggctgagtcagggggatcacttgagcccaggaggttgaggctacagagagctatgatcatgccactgtactccagcctcagcaacagagccagaccctgtctctgaaacagaaacaaacaaaaaaagacagaaagataaatcactgacagttaattttgccaacatttttatcttgtactttttcaagcattcagagaagtttaacagaattgtatcatgaacacatgtacggccacctcccagatgctactactggcatcttaccctatttgtcctgtcatgtatctatcccttgatacattcatccatccttttttctttttttttctttctttaattttgagacagagtctcactctgtgtccaggctgaagtacagtggtgctgccttgcaaccacccccggctaatattttgtatttcgactagggatggggtttcaccacattgcctgggatggtctcaaactcctgacctcaagccattcccacccaccccctttgcttcccaaagtgctctcaaagcatgaatcactacacctggccagaatatatatatatagttgttgctgttgtttttgtttttgccttttttgagatggagtctcactctgtcgcccaggctggagtgcagtggcgtgatctcggcgcactgcaacctttgcctcctgggttcaagcgattctcctccctcagcctcctgagtagctgggattataggcatgtgccaccacatctgggtgattttgtatttttagtagaaacggggtttcaccatgttggccaggctggtctcaaacccctgacctcaggtaatccaccgccacggcctcccaaagtgctgggattacaggcatgcgccaccgcgcccggctgattctatatatatttaaagggctttggctcacacatgtgtctgcatttgttaaccatcagtgaacgttcactcaaaagttatgcattgcaccgtgtaaatttcccctgccaaaaacgaagcggtaaacacatattcaactctagttaatagtatgcatgctgaagtgcttatcgtgatgtttgccagctactttgaaatgcatttttaaaaatgatggggcaggtgtggtgactcacgcctgcagtcctagcacttcaggaggctgagtcaggcagatcacttgagtccaggagatcgagaccagcctgggcaacatggcaagaccctgcctctagaacaactacaaaaattagccaggtgtggtggcgtgcctgtggtcccagctagccgggaggctgaggcagaaggatcacctgagcccaggaggtcgaggctgcagtgagctacgatcatgccactgcaccactgcactccagcctgggtgacagagcaagaccctgtctcaaaaaaaaaaaaaagaatcgcagaaagttccatcatgcctgttccactcaatcttcactgcctgttctgactagctttgcctattctagaacttcttagaaatggaatcattctagattccttagaacgtgtttgagatccatgcaagttgtgggcatcagtagttcacttatttttattgtcaggtggttttctagggcataggtgccccatagtttgttgaatccttctgctgttgatcaacacctgagctgtttccagtgtttggttattattgacaaaaaaaaatcattgatttcttttttgttgtttttggtttttgttttgttttgtttttttgagaccgagtctcactctgtcgccaggctggagtgcagtggcatgatctcggctcactgcaacctccgcctcccaggttccgtgattttcctgcctcagcctcccgagtagctgggattacaggcatgcgccaccacgcccagctaatttttgtatttttagtagagacggggttttaccatgttggccaggatgttctcgaactcctgacctcaagtgatcaacccacctcggcctcccaaagtgctggcattacaggcatgagccactatgcctagcctttttttttttcttttttttaagatggtgtcttgctctgtcacccaggctggagtgcagtggcgcaatcacagctcactgcagcgtcaacttcctggggccagacgaccctcccagacgaccctcccacctcagcctctcgagtagcttggaccacagctgtgcacacagcgctgtgagattacagtgagctatgatggcgccactgcacttcagcctgggcaacagaggaagactccccctctaaaaaagaaaatgcactcagtgttgaaaagacgctttatcaaagaagatatacggatggcaaataagcacaggaaagcatgcacaacattactgaccacgaggaattgcaaattaaaccacaacaggccaagtgaggtggctcatgcctgtcatcctagcactttgggagtcccaggtgggtggatcacttgaggccaggagttcgggaccagcctggccaacatgatgaaaccctgtctctactaaaaatacagaaattagccaggtgtggtggcaggtgcctgtaatcccagcatctcaggaggctgaggcaagagcattgcttgagcctgggagtcggaggttgcagtgagctgagattgtgccctgcacaccagctttggtgacagcgagactccatctcaaaaaaaaaaaaaaatgtatagaactatacacctaacacaggtgaattttgccgtatgtaaattatacttcaatcaaccaaaaaaaagcacctgaaaatatacgtaactacaccaacaaaaaagagagaggccacatctccacatctttgtactgtgtgtgtgtgtgtgtgtgtgtgtgtatgtctgtcgtgcatagcagaggggggaagaagtgtgttcggaggcacacctgctgccataacgatggccggcagctttaactaccatgcatttttaatcacagaagggttcagtgctcgaatttccaggagctgaccaccaggtctgaaattcagcctggcccttctctgacatgtgcagcctcttgtccaatcctgccctgtccgccccactcctctagtcctgatcacgggacttgaggtgtttcccggaacaatagtcccattcccgcctcccaggaggggagcccatgccaagtcagccagcctaggagggtccccttgggtccaacatgctgggagttggtggcctcttgtggccagaaatagaattatcacatattaaaaatgatcactggccgggcgcggtggctcacgcctgtaatcccaacactttgggaggccaaagcaggcgaatcacgaggtcaggagattgagaccatcctggccaacatggtgaaaccctgtcactactaaaaatacaaaaattagctgagcatggtggcgcacgcctgtaatcccagctactccggaggctgaggaaggagaatcgctcgaaccggggagtcggaggttgcagcgagccgagatcgcaccactgcactccagcctggcgacagagcaggactccatctcaaaaaaataaaaataaaaattagctgggcatggtgggacgctcctgtagtctcagctacttgggaggctgcggtgggaggatgacttgagcccgggaggtcaaggctgcaatgagtcataattatgccactgcactccagcccgggtgacagagcgagaccctgtctcagaaaaactgaaagaatttttttttttttgagacggagtctcgttctgtcgcccaggctggagtgcagtggcgcgatctccgctcactgcaagctccgcctcccaggttcacgccattctcctacctcagcctcccgagtagctgggactacaggtgcccaccaccacgcctaaataattgtttgtatttttagtagagatggggtttcaccgtgttagccagggtggtctcgatctcctgacctcatgatccgcccgcctcggcctcccaaagtgctgggattacaggcgtaagccacggcgccgggcccaagaatttttaaaagatcatagtaggccgggtgtggtggctcatgcctgtatcccatcattttgggaggcccaggtgggagaatcgcttgagcccaggagtagttctggacaacagaacaagaccctgtctctattaaaaatattaaaagatcacattaagggttgattctgcttatggctggggtgggaacggcatttccatacagggttagaggcctgtacattagtgcaaccttttcagcagcacaagtcaaaatctaaaatacacacacccggccgggcgcggtggctcacgcctgtcatcccagcattttgggaggccgaggcatgtggatcacgaggtcaggagattgagagcatcctggctaacacagtgaaaccccgtctctacttaaaaaatacaaaaaattggccgggcatggtggcgggcacctgtagtcccagctactcgggaggctgaggcaggagaatggcgtgaacccgggaggtggagattgcagtgagccgagacagcgccactgcactccagcctgggcaacagagcaagactctgtctcaaaaaaaaaaaaaaaaaaagagaaaaaaatacacacaccctctgacctatgggaatcacagaagtcttgcccaaacagattttcctctagttctaagtaaaagagacaagaatattcacatctttgtgttaagtgaaaccacaggaacacaattggctatatccagaatgcgggacattctgtaggacaggggcttcagtctcgccaacaaatccctgacataaaaacgggcagtgaagccgggcgcagtggctcatgcccgtaatcccagcactttgggaggctgaggcgggccgattgcctgaggtcaagagtttgagaccagtctggccaacatggtgaaaccctgtctctactaaaaatacaaaaaaattaactgggcgtggtggcatgcacctgtaatcccagctactcgggaggctgaggcaggggaattgcttaaaccaggaaggtggaggtttcagtgagccaagatcatgccattgcactccagcctgggtgacagagagagactccatctcgaaaaaaaaaaaagtgcactgaagagaccattgattataaagaaacttaagaccaggcacattggctcacatctataatctcagcactttgggaagctaaggcaggcggatcacctgaggtcaggagttcaagaccaccctggccaacgtggtgaaacctcatctctactaaaactacaaaaattagctgggagtggcagcatgcacctgtagtcccagctactccggaggctgaggcaggagaatcgtttgaacatgggaggtagaggttgcagtgagctaagatcgcaccactgcgctccagcctgggcaacagagcgagactctgtctccaaaaaaaagaaaaagagagagagagaacgagagaaagagagagccaagaatatctccacgggatcatagacaaactggggggaggtggtcaggaattctgtggacctgtgcttggcagcacccactcgaagcaatcagattaacacctggagtagacccaaaacattccccacacgcacccagacccattgtcacaggtaccaggggcttagcataagctgtggccagcacggaacaaacgataagccgctctggcacagcggtgactcctaggaagccaggcttaaagatgacgtcagagccatccccggccatctggaaggctgcctgcccaaagctgcgccttctcgggagaaatcacaggaagaatgccaagctaccagttcctgactgaccagggcaaaaggggaaattctctgaatggtgatagcagcctccaagccacacacacgtccag

SEQ ID NO: 764 - DNA, 9812 bp, Homo sapiens
ctgggccatagttcttcttctctattctggaaaagcagacacctgtgaaggcagacatcagggtggggagagaggatatgagaggccacgcttgcccttgggctcccaatcaactgctgggaccacccccgccctctcccaggcgcaggtgggagaaaacctcctctgaagggtccccattatcaaagcaaagccctcaccttacaaatgtcatagagactcaatcttgtgaggccttacttggatttttgttttgttttttgaaatggggtttcactctgtcgcccaggctggaacacagtgatgcaatcacgactcaatgcagccctggactcccaggttccagcgatcctcccaccccagcctccagagaagctgggactataggtgtgtcacatgcccagctaatatatatatatatatatatatatttttttttttttttttttgagacaagagtcttgctctttcgcccaggccggactgcagtgacgctatctcggctcactgcaagctccgcctcccgggttcacgccattctcctgcctcagcctcccgagtagctggtactacaagcgtgcaccaccatgcttgaataattttttgtatttttagtagagacggggtttcaccgtgttagccaggatggtctcgatctcctgacctcgtgatctgccctcctcggcctcccaaagtgctgggattacaagcgtaagtcactgcgcccagccatgcccagctaatttttaaattttttggtagagacagggtctcactgtattgcccaggctggtctcaaactcctgggttcaagcaatctgcctgcctcagcctcccaaaaccttgggattacaggggtgaaccaccacgactgactgaagtttttcttaatgagtatgtgcatctgtgtctcagtaaccaatgtgcaatttactacaatccccacccattacccaaaaatgtaattactagaaatttattctgaagaaacaggccggacacagaggctcacgcctgtaatcaccacactttgggaggccgaggcaggtgcatcacctgaggtcaggagttcaagatcagcttggccaatatggtgaaaccccatctctactaaaaatacaaatatcagccgggtgtggtggcatgtgcctgtaatcccagctactcaagaggctgaggcaggagaatctcttgaacttgggaggcagaggttgcagggagccaagattgcaccataccactgcactccagcctgggcgacacagcaagactccatccccctcaaaaaattataagaaaacttttttgaggggatagggtcttgctgttgcccagactggagtgcagtggcgtaatctcggcttcctgcgacctgtgcctcctgggttcaagtgattctcatgcctcagcctcccacatatctgggattacaggcacacaccagcaagcctggctaattttttgtatttttactagagatggggtttcaccatgttggccaggctggtctccaactcctgacctcaggtgatccacccacctcagcctcccaaagtgctgggattacaggcgtaagccaccatgcccggcctatttttattttttgtagaggccaggcgcggtgtttcacccctgtaatcccagctacttgggaggctgaggcaggagaatcgcttgagcctctgaggtggaggtggcagtgagctgtgatcgtactactgttctccagcctgggcaacagagtgagactccgtctaaaaaaccaaaacatatatatatgctttttgtagagtcagggtcccgctatgttgctcaggctggtctcgaactcctggcctcaagtgatcctcccgccttggcctcccaaagtgctgggattacaagcatgcatcactgtgcctggcctgtttcttgtttgtatacatcaactacaaactacagcacatgtaataagtttgtaaacatacatctataaacaaaaaattctgggccaggcacagtggctcaagcctgtaatcccagcactttgggaggcggaggcgggtggatcacttgaggtcaggagttcgagaccagcctgaccaacatggtgaaaccccatctctactaaaaatacaaaattagccgggcatggtggcgggcgccagtaatcccagctacttgggaggccgaggcaggagaatcacttgaaccagggaggcggaagttgcagtgagccaagatcgagccactgcactccagcccgggcaacaaagaaaaaccccatctcaaaaaataaaataaaaaagattctgaagaaaagacacagaatattaacaatgattatctttgcatggtaggacttttgtttggttggttttgttttggtgttttctcttcagatagggtctcgctctgtcgcccaggctggagtgcagtggcacattcacagctcactgcaacctctgcctcccgggctcaattgatcctccggcctcagcctcccaagtagctgggactacgacacatactaccatgcctggctaatttttgtattttttgtggagacagggtttcaccatgttgcccaggctggtctcgaactcctaggggctcaagtgatcctcctgcctcagccacccaaagttgctggtattacaggcatgagccgcctcactgggcggatttttttcttaacatattgatattttctaatttcttcaacaagaaattggtgctgtttcacatgtaaatatttcataacaatatacatgcattttactgggttttctccccatgggctcctatcaaagtccttcccctggtgaaagggaagccatggggagggctgaaggcagagaaggtgggacgggccaagtcttagccatgattgtggaacagtggaagaagagcctgtctggtgctcgggggccctgggtgtgagtactggctcaccctctactgtgcgtggcggttctgaatgtctctctcacacccattttgtttagtctttgacgtgagaaggagaaacaaaaaactcaggttaagaaagcaaactctggccaggcgtggtggctcacgcctgtaatcccaacactttgggaggctgaggcaggtggatcacctgaggtcaggagtttgaggccagcctggccaacatggcaaaaccccatctttaccaaaaatacaaaaattagccgggtgtggtagtgggcgcctgtaatcccagctactcgggaggtggaagcaagagaatcgcttgaacccaggaggcggaggttgcagaatgccgagatcagtcactttaaaaaaaaaaaaaaaaaaagattggctccccccgcaacccccaccccaaagaaagcaaattctatggcttgactatagtgtaggatccagggacagtgtggtccgggcttgtcctctgagcaccagggacatgctctggccctgagcccacaaacttgtactccctaaagcaagagcctctttctcctcctagcaaaccttccactcaactgaaacctagatgatccctcaacgtgaccacccagcaaacccatgtttgctctgtcccccagcgggctgggaccatttcaggcacatggaccttgggtttttttatggagttttgctcttcttgcccaggctggagtgcagtggtgcgatcttggctcactgcaacctttgcctcctgggttcaagcgattctccagcctcagcctcccgagtagctgggattataggcacccactaccacacccaggtaatgttagtatttttagtagagacagggttttgccatgttagccaagttggtctcaaactcctgacctcaggtgatctgcccgcctcagcctcccaaagtgctgggattacaggcatgagccaccatgcccagccccaggtacatggaccttgggagctgccaccctccacgtgaccctccggcttcagccctaagctatgtgaagaggtctcagaactggggtctcgctttccaaagtagattcctgctccccgttgtcaagttcttcacaggaatgcttttactcccagcatgcctgggtctcgaacacttgggcaactccacttggctgccaaggctctgctcccctactgagaacttaccttcaggtggggactcaagcttcagcctctgaggttctcgggaccagggtagaaacaagcttgctatgctgagaggagggacccaccttgctgacaaagtccgatcctgagcttttgcaaagacaccaggaaaacctgaaattaaaatgacgcagggaggctcacatgaaaatattagcacacctgtcatctcagtactttgggagcctgaggcaggacaattgcttgaggccaggagttcgagaccagcctagtcaacaaacaccccacctctacagggggaaaagaagacattggcagggttacctttaccgctgatagagagaaaccaatctgtggcagaagggaaagtcagaaagcctagaacacgagacagagtccatgctctgtttctggctttgaaaatggagggaccggctgggcacggtggctcacgcctctaatcccagcactttgggaggccgaggtgggtgcgtcgcctgaggttagcagttggagaccagcctggccaatatggtgaaaccctgtctgtactaaaaatacaaaaattagccaggtgtggtggcgcacgcctgtaatcccagctactagggaggctgaggcaggagaatcactggaacgcgggacgcagaggttgcagtgagctaagctcgcaccactgcactccagcctgggtgacagagtgagattctgtctcaaaaaaaaaaggagatcccattggaaagcaagctggtgggcttcgggagctgagcatggcccccagctgacagccagcaaggaatcggggacctaagtcttaagacagaattctgcaaaccccgaatgcactgacaagcagattcttcccagaacctctggctaaaagcccagcccagcccacgcctttctcagagcctgatgctacctggagcgtggaacccataggtgaggccaccaggatttctgacctcccaaactctgtgttagtaagtgggtgtggttttagtcaccaaatgagtggcaatctgtcatacaacaatagaaaattactacaggccaggcacagtggctcacgccagtaatcccagcactttgggaggccaaggcaagtggatcacttgaggtcaggagttcaaaaccagcctggctaacatcgcgaaaccctgtctctactaaaaatacaaaaattagccaggcatggtggtgggcgcctgtaatcccagctacctgggaggctgaggcatgacaatcacttgaacccagaaggcagaggttgcagtgagccgggattgcactgctgtactccaccctgggtgacagagtgaaactccatctcaaaaaaaaaaaaaaaaaatggcaagcataaagagcaaacctgaataccaaaagaaaaatatatatattgcagccaggcacggtggctcacgcctgtaatcccagcacttcgagaggctgaggtgggcggatcatgaggtcaggagatcaagaccatcctggttagcacagtgaaaccctgtctctactaaaaatacaaaaaaatcagctgggtatggtggcaggcgcctgtagccccagctactcaggaggctgaggtaggagaatggcgtgaacccaggaggcagagtttgcagtaagccgaaatcgcaccactgcactccagcctgggcgacagagcaagactgtctcaaaaaaaaaaaaagaaaagaaaagaaaagaaaagaaaaatacatatattgcatagatcccactgactcaaaaaacaatacaattagaaaataaaaagaatgcaaaaaaaaattaaatcaccaaatatgaaatgaatccatactcaaaaatattcccaaagaaacacgaggcctatatgtttttcaggaattttataaaactgtcttcaagacttttgcaatgtgtataagtggtttattcaggttttctatatgtcagtcaattttagcaatttacaattttctacaaatgtgtcttacttaatttcagagttatgccattaaatgatttatagtaacatctcattttttaaaaatctactggccaggcacggtggctgatgcctgtaatcccagcactttgggaggccaaggcaggtggatcacctcaggtgaagagttcgagaccagcctggtcaacatggtaaaacctcgtctctactaaaactacaaaaaaaaaaattagctggacatggtggcacatgcctgtagtcccagctactcagggaggctgaggcaggagaattgcttcaacccaggaggttgaggttgcagtgagccaagatcatgccactgcactccagcctgggcgacagagggaaactccatctcaaaaaaaaaaaaaaaaaaaaaaaagaaggccaggcacggtggcttacgcctgtaatctcagcactttgggaggctgaagagggcagattgcctgaggtcaggagttcgagaccagtctggccaacatagtgaaaccccatgtctactaaaaatacaaaaaaattagccgggcatggtggcgtgtgcctgtaatcgcagctactccagaggctgaggcaggggaattgcttgaaccagggagatggaggttgcggtggagccaagatcgcactactgcaccccagcctgggtaacagagcaaactccatctcaaaaaataaaaataaataaaaataaaaataaatctactgtatctgaaatcatctcatcttccattctaaaaatagcttattttggccaggcacagtggctcacacctgtaatcccagcactttgggaggccgacacgggcagatcacaaggtcaggagatcgagaccatcgtggctaacacggtgaaaccccgtctctgctaaaaatacaaaaaattagccgggcgtggtggcaggtgcctgtagtcccagctactcgggaggctggggcaggagaatggcatgaacccaggaggtggaccttgcagtgagccgagatcgtgccactgcactccagcctgggtgatagagtgagactccatctcaaagaataaaaaataaaaaaataaatagcttatttctattctcccttcatcagtgcagactgaagtttgtctaatttattagttttaaatacaaatcaaatttttttttggaggggggaggtttaacaaatcctttccaataagtgattttattttatttatttatttatttatttatttattttttgagacggagtctcgctctcttgcccaggctgaagtgcagtggcacaatctcggctcactgcaagctccgcctcccgggttcacgccattctcctgcctcagccccccgagtagctgggactacaggcgcccaccaccacgcccggctaattttttgtatttttagtagagacggggtttcaccgtgttagccaggatggtctcgatatcctgaccttgtgatccacctgcctcggcctcccaaagtgctgggattacaggcatgagccaccacgcccggccccagtaagtgattttagctttttaactttttacttgagtgacttgagactcaaaggaaagtctcaagaatagtacaaagaatttccaaatacccttctcatctagatctcccaaatattaacattttaccacatttgcgcaggcggctgatgaaaaaggtcccaccacaaggtggcagagtaaacacgacagcacctgggcgaggctttgtgcaggcaggaaggccctcacaccagaggccgtcccagggctgtggcatgggggccattacccaggagagggcacagggccagctcctgggtatctctgagagccttagggtccttttgttgttgttgttttgatatggaatcttactctgtcacccagtctggagtgcaatggcacgatctccaacctccacctcccgggttcaagcgattctcctgcctcagcctcccgagtagctgggattacaggcccctgccattatgcctagctaatttttgtagagacagggtttccccatgttggccaggctggtcttcaactcctgacctcaggtgatccgcttgcctcagcctcccaatatgctggggttaaaggcatgagccaccgctcccagctagccttggggtcttaatagccacatggtttgtcttatacatggccggcagatgttgggtacagtttcccaggtatgcacaccaagagatctctaaatcactacaaatctgcatgtacttgggctatgattcaaacaactggggccaggcatggtgcctcacacctgtaatcccagcactcagggaggccaaggcgagaggatcccttgagcccaggagttcaaggccagcctgggaaacatagcgagacccgtctctattaaaaaataaaacaggccaggcgtggtgggtcacgcctgtaatcccagcactttggaaggccaaggcgggtggatcacgaggtcaggagatcaagaccatcatgctagctaacacggtgaaaccctgtctctactaaaaatacaaaaaattagccaggcgtggtggcgggtgcctgcagtcccaaactactcagtaggctgaggcaggagaatggcgtaaacccgggaggcagagctggcagtgagccgagatcacggcgccactgtgctccagcctgggcgacagctcaaaaaaaaaaagatttgtaacaaaataaaacaactggggccaggcatggtggcttacacctataatcccagcactcagggaggccaaggcaagaggatcccttgagcccaggagttcaaggccaaactgggcaacatagcaagacccctgtctctattagaaaataaaaaaggccaggtgtggtggctcacgcctataatcccagcactttgggaggccaaggcaggtggatcacctaagattagcagttcaagaccagcctggctggtcttgatggtgaaaccatctctactgaaactacaaaaattagccaggtgtggtggtgggtgcccgtaatcccagctactggggaggctgaggcaggagaatcacttgaacgcggggggcagaggttgcagtgaactgagatagtgccactgcactccagcctgggcaacagagcaagactgtctcaaaaaaaaaaaaaaaatactcaatttaggtttaatgtctcatgatttgattcaggtgatacatttgtggcagaaatttttttgttttaacttgctctatttttttgttttaagtgggaaaacactttattccataaaacagagtaaatgttcctctcttccttttaatttctcctcatatgcttttagctttgggggtttgcgctttttctcttttcttttcttttttttgagactgagttgcgctctgtcgcccagggtggagtgcggtggcgcaatctctgcttaccacaagctccgcctcccaggttcacgccattgtcctgcctcagcctcccgcgaagctgggactagaggcgcccaccaccgcacctggctgattttttgtatttttagtagagacggggtttcatcgtgttagccaggatggtctcgatctcctgacctcgtgatccgcccgcctcggcctcccaaagtgctgggattgcaggcatgagccaccatgcctggcttttctcttttttaaatatctttttctgggagacacagactggacaaatgggagtggatgtgccctattcctttttatatgctaaccacctgagctgaatgtcattaagtttcattctttttatttaata

SEQ ID NO: 765 - DNA, 5338 bp, Homo sapiens
actagggaagagaggaaaaaataataaacaaattttatctttggaaaaatgaacaagtgatagacaaatctctggtgacactaatcaatataaaagagaaacattgttggaaaactctgtagaaatagatctaggaatttaattttttttgtgttactgtttcatagtttcatagcaaccatgaatttattgggaagaaaaacattttcaaccatttttttttttctttttttttttttttgagagggggtctcgatttgttgctcaagctggagggcagtggcgccatctccgctcactgcaacctctgcctgctgggttcaagcaattctcctgcctcagctttcctagtagctgggattacagatgcctgccaccacacccagctaatttttgtattttagtagagacagggtttcaccatgttggccaggctggtcttgaactcctgaccttgtgatctgcccgccttggcctctcaaagtcctgggattacaggcatgagcccccttccccagcctattgttacttttttttttttgagacagggttttgctctgttggtcaggttggagtgcagtggcgtgatcatagctcactgcagcctcaagctcccaggttcaagcgatcctcgtaccttggcctcccaaagtgctggattacaggtgggagccactgtactagcctttgtaccataataaaataaagtcagcccttcatatttggaggggattggttccaggacacaacccgtttgtattagttcattctcatactgctataaagaactatctgagactgggtagtttataaagaaaagaggtctaattgactcacagttctgcagcctgtacaggaagcgtggctggggaggcctcaggaaactgacagtcatggcggaaggcaaaggggaagcaggaatgtcttacatggccagagcaggaggaagagagagaaagacgggaggtgctgcacacttttaaacaaccagctctcatgataagtcactcactctcacgagtacagcacgaaaggggaaacctacccccatgatccaatcgcctcccaccagatgcacctccaacactggggattataatttttttttttttttttcctgagatggcgtcttgctttgtcgcccaggctgtagtgcagtggtgcaatctcagctcactgcagcctctgcctcctggcttcaagcagttctcctgcctcatcctcccaggtagctcggattacaggcatgtaccaccatgcccagctaatttttgtatttttagtagagacggggtttcatcatgttggccagggtggtctcgaactcctgacctcaggtgatccacctgccttggcctcccaaagtgctgggattacaggcgtgagccaccgtggccagctgggtattataatttaacatgacccaaaccataatcaccctcatacccaaatctgccatactcaagtcccacagttggccttgtggaactgtgtacatgaaaagttgggcttctatatgtttgagtttcacatccctcaaatactgtattttctgagttcggttggaaaaaacctgcatataagtggaccttcgaagttcaaacccatggtgtttgagggtctacgtggtgtatttttccctcactgatctaaaatgcaaatttatagagaaatcttgaaaaagtaataggcataacaaatatctgagttaaaaatatgtcctgattaaaggacaatttggaaaaaaaatgtataacaaaaatgacctaaataggaagaaaggaacaaatgacataaaaccccaaaaggattattccttttttatatatatgtgtgtgtgtgtgtgtgtgtgtgtacacacacacacacacacacacacacacacacacacacacatatatatatatatatatatatatatatatatatatatatatatatatatatatatattttgagacagtcttgctctgtcgcccaggctggagtgccatggtgtgatctcggcttactgcaacctctgcctcccgggttcaagtgattcaaacaattgtgcctcagcctcctgagtagctgggattacaggtgtccaccaccatgcccagctaatgtttttatttatttatttttatttttatttttgagatgaagtttagttctttttgcccaggctggagtgcaatggtgcaatcttggctcactgcaacctccgcctcttgggttcaagcgattctcctgcctcagcctcccaagtagctcagattacaggcatgcgccaccacacctggctaatttttttttttgtatttttagtagagacggggtttcgccatgttggtcaggctgatctcgaactcccgacctcaggtgattgcccatcttggcctcccaaagtgctaggattacaggcgtgagccactgcacctggccaatttttgtatttttagtagagagggggtttcaccgtgttggtcaggctggtctcaaactcctgacctcaggtgatccacctagcttgaccttccaaagtgctgggtttacaggcatgagccaccgcgcccaaccccaaaaggattattctaaaaagagtctacacccacaagatttgtaaatgaatcatttttatggagatgatttctactgtttattttggttttgttttgttttttttttttttttttttttttgacggagtcacacactgtcgctcagggctggagtgcaatggtgcgatctcggctcactgcaaccttcgcctgctgggttcacaccattctcctgcctcagcctcctgagtagctgggattaaaggtgtacaccatgacaccgagctaattttttgtatttttagtagagccagggtttcaccgtgttagccaggatggtctcgaactcctgacctcgtgatctgcccgccttagcctcccgaagtgctgggattacaggcaagagccaccgcgcctggcctactgtttataattcactctagaaccacgcggtagaaaccacaggtagaatctaccacagggtggaaatctacgtagttgaatgtgcaaaggactccaattcctgatgtgcaaacctgatccaggaaaccagacaaaaaaccttttacaaagagacaaaatctttttgtagaaacaaaaggaaaagccggctgggcatggtgtcattcacccccagctctgtgtcaaccagaagcccggcgccacaccctgccagcccatggccacctcccacgtgactgcagccgtggctgtggctggaagtgcagggtagcctaaccggaagcatggcgtcgtggggggttctgggagttgtagtccctgggggagctgcttttacgcagtgttttgaggtgcaggactgcaatgcccgcacttccggaccccagactcttcctacggcgactgacacctcagacacgcgttgtggggggcggcgctctggctccggggctgtgcccagcgcgagcgtggccggcacccacttgctgcagagccggcactgcactggggttcttgggggcggctcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcaggtgagctaggggcttgttctctgcacaggggatcccgctcttccccaagagtgggtttgttgccgtcccttcccctggagcttctctgcccatccaggcccctgaagtccactaccctgcggtgcctgggtctctagggggaagaagggggctgttggggaatgtccccgtctcttgcagagggtaacccccttttttctctcctacttggctcatgcagacccccgatcgcagccagtggtgggcactgagctaggagggaaacgaaggcagggtgtggaggggggttatttcaggcgtctgggctcattcaaaacatcttctgagtgcctgggtccgatctgggggagcacggagctggggtcccttgttggatgcagtcctacagaggtgttggtcacgttaacatgtgggggcgatccaggggtagccgccctgttagttacctcaactatcaggatgcatggacacccaggggagggaggatcagtttcaactggggaaggagtgacttcaggtcagacttaaataagatgttgcagatgaaatggcaatagggtctttgaggaccagggaggagcatccctgaggggtaatgatgggtggtactgaggactcagcacaggggaggcgcccagggccgtgaggctgggggcggggtggggggctgaccagcaaggtccgaggctggggtctccctcttgctccagctgcaaatgcagtacttcaaggcagaggcatgatcatatttgggtgttggtcaaagtatccctgcaggaagtagagttatgagggttggactgagggtgtgagacaattgagtagggagacaccagatgaaggcgtacagtgtgagcacctctgttgtagacgggtgaggagaaggaggcggctgccgcagttctgtgtagactgttcttttccagcccttggtgaagaaaggtgagcaacacttggggtggtgtgatgtgatggagttagcagaggatgtctgtctttgatgtttttttttttttttttaagatgaaactcacttgagttggggagagaatgaaactggtactatggttttaaatcgtgataggagcaaatgttttcgtggtggtggtttttctatcacgacttgcacttgggtcttactgaaagaggtttttcttttcttttttttttttttttttgagactgagtctcactctgtcgcccaggctggagtgcagtggcacaatctcagctcactgcaacctccaactccccggttcaagcgaattctcctgcctcagcctcctaaatagctgggattacaggcgggcgccaccacgcctggctgatttttgtatttttagtagagacggtttcaccatgttggtcaggctggtctcgaactcctgacctcgtgatccgcccgcctcggcctcccaaagtgctcggattacaggcatgagccaccttgcccggcctgaaggagcttttcctatgacatgtccataattcttttttgctatttttgattagtaatattggaagagatctaaatacatagcaaagtaaaagaaaatggagcctttgtactcatgatccaaattgagcagatgtcaaaagtttacttcattctgagccgaatggatgtgaaaaaaa

SEQ ID NO: 766 - DNA, 25236 bp, Homo sapiens
actagggaagagaggaaaaaataataaacaaattttatctttggaaaaatgaacaagtgatagacaaatctctggtgacactaatcaatataaaagagaaacattgttggaaaactctgtagaaatagatctaggaatttaattttttttgtgttactgtttcatagtttcatagcaaccatgaatttattgggaagaaaaacattttcaaccatttttttttttctttttttttttttttgagagggggtctcgatttgttgctcaagctggagggcagtggcgccatctccgctcactgcaacctctgcctgctgggttcaagcaattctcctgcctcagctttcctagtagctgggattacagatgcctgccaccacacccagctaatttttgtattttagtagagacagggtttcaccatgttggccaggctggtcttgaactcctgaccttgtgatctgcccgccttggcctctcaaagtcctgggattacaggcatgagcccccttccccagcctattgttacttttttttttttgagacagggttttgctctgttggtcaggttggagtgcagtggcgtgatcatagctcactgcagcctcaagctcccaggttcaagcgatcctcgtaccttggcctcccaaagtgctggattacaggtgggagccactgtactagcctttgtaccataataaaataaagtcagcccttcatatttggaggggattggttccaggacacaacccgtttgtattagttcattctcatactgctataaagaactatctgagactgggtagtttataaagaaaagaggtctaattgactcacagttctgcagcctgtacaggaagcgtggctggggaggcctcaggaaactgacagtcatggcggaaggcaaaggggaagcaggaatgtcttacatggccagagcaggaggaagagagagaaagacgggaggtgctgcacacttttaaacaaccagctctcatgataagtcactcactctcacgagtacagcacgaaaggggaaacctacccccatgatccaatcgcctcccaccagatgcacctccaacactggggattataatttttttttttttttttcctgagatggcgtcttgctttgtcgcccaggctgtagtgcagtggtgcaatctcagctcactgcagcctctgcctcctggcttcaagcagttctcctgcctcatcctcccaggtagctcggattacaggcatgtaccaccatgcccagctaatttttgtatttttagtagagacggggtttcatcatgttggccagggtggtctcgaactcctgacctcaggtgatccacctgccttggcctcccaaagtgctgggattacaggcgtgagccaccgtggccagctgggtattataatttaacatgacccaaaccataatcaccctcatacccaaatctgccatactcaagtcccacagttggccttgtggaactgtgtacatgaaaagttgggcttctatatgtttgagtttcacatccctcaaatactgtattttctgagttcggttggaaaaaacctgcatataagtggaccttcgaagttcaaacccatggtgtttgagggtctacgtggtgtatttttccctcactgatctaaaatgcaaatttatagagaaatcttgaaaaagtaataggcataacaaatatctgagttaaaaatatgtcctgattaaaggacaatttggaaaaaaaatgtataacaaaaatgacctaaataggaagaaaggaacaaatgacataaaaccccaaaaggattattccttttttatatatatgtgtgtgtgtgtgtgtgtgtgtgtacacacacacacacacacacacacacacacacacacacacatatatatatatatatatatatatatatatatatatatatatatatatatatatatattttgagacagtcttgctctgtcgcccaggctggagtgccatggtgtgatctcggcttactgcaacctctgcctcccgggttcaagtgattcaaacaattgtgcctcagcctcctgagtagctgggattacaggtgtccaccaccatgcccagctaatgtttttatttatttatttttatttttatttttgagatgaagtttagttctttttgcccaggctggagtgcaatggtgcaatcttggctcactgcaacctccgcctcttgggttcaagcgattctcctgcctcagcctcccaagtagctcagattacaggcatgcgccaccacacctggctaatttttttttttgtatttttagtagagacggggtttcgccatgttggtcaggctgatctcgaactcccgacctcaggtgattgcccatcttggcctcccaaagtgctaggattacaggcgtgagccactgcacctggccaatttttgtatttttagtagagagggggtttcaccgtgttggtcaggctggtctcaaactcctgacctcaggtgatccacctagcttgaccttccaaagtgctgggtttacaggcatgagccaccgcgcccaaccccaaaaggattattctaaaaagagtctacacccacaagatttgtaaatgaatcatttttatggagatgatttctactgtttattttggttttgttttgttttttttttttttttttttttttgacggagtcacacactgtcgctcagggctggagtgcaatggtgcgatctcggctcactgcaaccttcgcctgctgggttcacaccattctcctgcctcagcctcctgagtagctgggattaaaggtgtacaccatgacaccgagctaattttttgtatttttagtagagccagggtttcaccgtgttagccaggatggtctcgaactcctgacctcgtgatctgcccgccttagcctcccgaagtgctgggattacaggcaagagccaccgcgcctggcctactgtttataattcactctagaaccacgcggtagaaaccacaggtagaatctaccacagggtggaaatctacgtagttgaatgtgcaaaggactccaattcctgatgtgcaaacctgatccaggaaaccagacaaaaaaccttttacaaagagacaaaatctttttgtagaaacaaaaggaaaagccggctgggcatggtgtcattcacccccagctctgtgtcaaccagaagcccggcgccacaccctgccagcccatggccacctcccacgtgactgcagccgtggctgtggctggaagtgcagggtagcctaaccggaagcatggcgtcgtggggggttctgggagttgtagtccctgggggagctgcttttacgcagtgttttgaggtgcaggactgcaatgcccgcacttccggaccccagactcttcctacggcgactgacacctcagacacgcgttgtggggggcggcgctctggctccggggctgtgcccagcgcgagcgtggccggcacccacttgctgcagagccggcactgcactggggttcttgggggcggctcctccagacgtctctgcgggttgtcgggtgctgccgagttgggttgggggacgctacaggtagtgggtccggagcagcggctggcccctcatctcactgcccttcctcggaccccaccgtcctctggaagcttgtgcagggcacctgccactgtgaccacctggacgcaggtgagctaggggcttgttctctgcacaggggatcccgctcttccccaagagtgggtttgttgccgtcccttcccctggagcttctctgcccatccaggcccctgaagtccactaccctgcggtgcctgggtctctagggggaagaagggggctgttggggaatgtccccgtctcttgcagagggtaacccccttttttctctcctacttggctcatgcagacccccgatcgcagccagtggtgggcactgagctaggagggaaacgaaggcagggtgtggaggggggttatttcaggcgtctgggctcattcaaaacatcttctgagtgcctgggtccgatctgggggagcacggagctggggtcccttgttggatgcagtcctacagaggtgttggtcacgttaacatgtgggggcgatccaggggtagccgccctgttagttacctcaactatcaggatgcatggacacccaggggagggaggatcagtttcaactggggaaggagtgacttcaggtcagacttaaataagatgttgcagatgaaatggcaatagggtctttgaggaccagggaggagcatccctgaggggtaatgatgggtggtactgaggactcagcacaggggaggcgcccagggccgtgaggctgggggcggggtggggggctgaccagcaaggtccgaggctggggtctccctcttgctccagctgcaaatgcagtacttcaaggcagaggcatgatcatatttgggtgttggtcaaagtatccctgcaggaagtagagttatgagggttggactgagggtgtgagacaattgagtagggagacaccagatgaaggcgtacagtgtgagcacctctgttgtagacgggtgaggagaaggaggcggctgccgcagttctgtgtagactgttcttttccagcccttggtgaagaaaggtgagcaacacttggggtggtgtgatgtgatggagttagcagaggatgtctgtctttgatgtttttttttttttttttaagatgaaactcacttgagttggggagagaatgaaactggtactatggttttaaatcgtgataggagcaaatgttttcgtggtggtggtttttctatcacgacttgcacttgggtcttactgaaagaggtttttcttttcttttttttttttttttttgagactgagtctcactctgtcgcccaggctggagtgcagtggcacaatctcagctcactgcaacctccaactccccggttcaagcgaattctcctgcctcagcctcctaaatagctgggattacaggcgggcgccaccacgcctggctgatttttgtatttttagtagagacggtttcaccatgttggtcaggctggtctcgaactcctgacctcgtgatccgcccgcctcggcctcccaaagtgctcggattacaggcatgagccaccttgcccggcctgaaggagcttttcctatgacatgtccataattcttttttgctatttttgattagtaatattggaagagatctaaatacatagcaaagtaaaagaaaatggagcctttgtactcatgatccaaattgagcagatgtcaaaagtttacttcattctgagccgaatggatgtgaaaaaaaaagtatgctgggttcagattttcttacagaactaaaacctcctaaatactgttgacgaccctttgtactctccctcactgagattaaacttaaaattgctatatatcttttattttggggggttgagtctcttgtcgcccaggctggagtgcagtggctggatctgggctcacggcaacctctgtctcccgagtaggtgggatcacaggcgcccacgaccacacctggctaatttttgtatttttggtagagacgggtttccccatgtcgggcaggctggtgttaaactcctgacctcaagtgatccacccaccttggcttcccagagtgctgggatcacaggcgtgagccactgcacctggccaaaattgatacgtgtttttgtttatttactagacaggagtgtagccataaacagtataagattgctttgtatgttcatcacctttgcctgtatttccttcagggttgtctttttcttatttttagcatttttttcatattttttagatataaattcactttgagttacagacattgcaaaaatcttgagtagaatgtaatgaattcctggtgtttccccgatggctgtattttttaggatggatccacttaatgttgagtggcttattctggttttctgtttgccagtcaattttagtaatttatattttctaggaaagtgtcccatttaattttgaatttatggcaattatttagagtaatcttataaacctcgaccatggctgggcgctgtggctcacacctgtaattgcagcactttgggaggtcaaggcgggtgtatcacatgaggtcaggagttggataccagccgggccaacatggtgaaaccccgtgtctactaaaaataccaaaaaaaaaattagctgggcagtagtggcacacgcctgtaatcccagctactcaagaggcagaggcaagagaatcgcgtgagcctgggaggcggaggttgcagtgagccgagatcacgccactgcactcttgtctgcgcgacagagtgagaccctatctcaaaaaaaaaaaaaaaaaaatcaaaccttgaccatatctgaaattgtctttttcatgccttctcttgctcaattgtgcctggaatctggtcgattttattaattttaaatacaaaccagttattttattagttttaataagacctttccaaaaattgattttttttctttttaacttattactgtagtcctaatatatgtgttaaataaaaagaatgaaacttaatgacattcagctcaggtggttagcatagaaaagagaataggggctgggcatggtggctcatgcctgtaatcccagcaatttgggaggctgaggcaggcggatcacgaggtcaggagatcgagaccgtcgtggctaacacggtgaaaccgcatctctactaaaagtacaaaaaattagccgcgtgtggtggcaggcacctgtagtcccagctactcgggaggctgaggcaggagaatggcgtgaacccgggaggcagagctggcagtgagccgagattgtgccactgcactctagccggcgcgacagagcgagactccctctcaaaaaaaaaaaagaaaaaacaagctcaaacccccgaaagtaaaagcatatgaggagaaattaaaaggaagagacgaacatatactctgttttatggaattaagtgttttcccacttaaaaaaatagagcaagttaaaacaaaaaaaatttctgccacaacgtatcacctgaatctaatcatgagacattaaacctaaattgaataatttattttttttttctttttgagacagttgctctgttgcccaggctggagtgcagtggtgtgatctcggctcactgcaacctctgccccccgggttcaagtgattctcctgcctaagcctccccagtagctggtattacagtcacccaccaccacacctggctaatttttgtagtttcagtagggacagggtttcaccatgttggccagggtggtcttgaactcctaatctcaggtgatccacccgccttggcctcccaaagtgctgggattacaggcgtgagccaccacgcctggcctgttttattttctaatagagacaggagtctcgctatgttgcccaggctggccttgaactcctgggctcaagggatcctctcaccttggcctccctgagtgctgggattacaggtgtgagccattatgcctggccccagttgtttgaatcatagccgaagtacatgcagatttgtagtgatttagagatctcttgctgtacatacctgggaaactgcacccaacatctgctggccatgtataagacaaaccatgtggctttcaagaccccaaggctagctgggcacggtggctcatgcctttaaccccagcacattgggaggctgaggcaggcggatcccctgaggtgaggagttcacgaccagcttggccaacatggggaaaccccgtctctacaaaaattcaaaaattagctagacatgatggcaggggcctgtaatcccagctactcgggaggctgaggcaggtgaattgcttgaacccgggaggcggaggttggagatcgtgtcactgcactccagactgggtgacagagcaagattccatatcaaaaaaaaaaaaaaaaaaaaagaccctaaggctctcagagatacccaggagctgtccctgccccctctccttctgggtaatggcccccatgccacagccctgggatggcctctaacctgagggccttcctgcctgcacaaagcctcgcccaggtgtgtactctgccaccttgtggtgggacctttttcatcagccgcctgcataaatgtggtaaaatgttaatatttgggagatgtagatgagaagggtatttggaaattcttcatactattcttgagactttcttttgagtctcaagtcactcaagtaaaaagttaaaaagaaaaagctaaaattacttattggaaaggatttgttaaaaacaaacaaaaatttggttgtatttaaaatgaataaatttagacaaacttcagtctgcactggtcgagggagaatagaaatcggctattttagaatggaagagatgatttcagatacagtagatagattttttttttttttttttgagacggagtcttgctctgtcgcccaggccggagtgcagtggcgtgatcttggctccaccgcaacctccatctccctggttcaagcaattcccctacctcaccctctggagtagctgggattgcaggcgcacgccaccatgcccggctaatttttttgtatttttagtagagatggggtttcactatgttggccagcctggtctcaaactcctgacctcaggcaatccacccacctcagcctcatgacttcaggcaatccgcctgcctcagcctcccaaagtgctgggattacagcatgagccaccatgcctggccttttgtttgtttgtttgttttttgagatggagtctccctctgtcgcccaggctggagtgcagtggcatgatcttggctcactgcaatctccacctcctgggttgaagcgattctcctgcctcagcctccccgagtagctggggctacaggcatgcgccaccatgtccagctaatttttttttttgtagttttagtagagacaaggttttaccatgttgacgaggctggtctcaaactcttgacctgaggtgatccacccaccttggcctcccaaagtgctggtatgacaggtgtgagccaccgcacctggtcagtagatgtttataaaaagtgagatgttactataaatcatttaatggcataaatctgaaattaagacacatttgtagaaaattgtaaattgctaaaattgactgacatatacaaaacccaaataaaccacttacacatgtcgcaaaagtcttgaagagagtttgataaaattcctaaaaaacatacaggcttggtatttctttgggaatacttttgagtatggattcatttcatatttagtgtatttagtggtttaaatatttttttgcattctttttattttctaattttattttttgagtcagtgggatctatggaatgtatgtatttttcttttagtattcaggattgcttttgatgcttgcctttttttttttttttttttttttttgagatggagtttcactctgtcacccaggctggagtgcagcagtacaatcccggctcactgcaacctctgcctcctgagttcaagtgattctcacgcctcagcctcccaagtagctggtattacaggcacccaccaccacacctggctaatttttgtatttttagtagagacagggttttccccatgttggccatgctggtcttgaattcctggcctcaagtgatccacccaccctggcctcccaaagtgcagggattataggcgtgagccactgtgtctggccaaaattgctatatatctatgtttttgtttatttactagacaggagtgtagccatgaacagtgtataagattgctttgtatgtttatcacctttgcctatatttctttaggggttgtctttctcatttatttttagcatatattttatatataaattcactttgtcttatgaacactgcaaaaatcttgagtagaatgtggtaaaattcctggtgtttccccaatggctatattttttaagatgaatccatttcatttaatgttgagtggtttattctggttttctgtttgtcagtcaattttagtaatttatattttctagaaaagtatcccatttaattttgaatttatggcaattgtttatactgatcttacaattataaacctcgaccgtatctgaaattgtctttttcatgtgcacaaatggtttatctttgccttctcttactcaattgtgcctggcttccggtcaattttattaatcttaaatacaaaccaattactttattaggtttaatcaaacctttccaagaattgattttagttttttctttttaatgtattattaaagtcctaatacctttttttttttttttttttttttttttttgagatggagtctcgctctgtcgcgcaggctggagtgcagtggcatgatctcggctcactgcaagctccgccttccgggttcatgccattctcctgcctcagcctcccgcatagctgggattgccagtgcctgccaccaagcctggctaatttttgtgtgtgtgtgtgtgtgtgtgtttttagtagagactaggtttcaccatgttagccaggatggtctcgatctcctgacctcatgatccgcccacctcggactcccaaagtgctgggattacaggagtgagccactgcacccggctagtcctaatacatatgttaaatacaaggagtgaaacttaatgacatttagctcaggtggcttccacagaaaaaagaatagggagcatctacccccattgtccagtctgtgtcttccagaaaaagatatttaaaaaagagaaaaaaagagcaaaaccccaaaggtaaaagagaatgagcagaaatttaaaaagaagggaggaagatggccaggcgcgggggctcacgcctgcaatcccagcacttcgggaggccgaggcagcaagatcacctgaggtcaggagttcaagaccagcgtggccaacatagtgaaaccccatctctactaaaaatacaaaaattagctgggcgtagtggcacgtgcctgtaattccagctacttgggaggctgaggcaggagaatcacttgaacccaggaggtggaggttgcagtgagctgagatcacgccactgcactgcagcctgggtgacactgtctcaaaaaaagaaaaaaatcttttactgtgatggaagatgtattggtttctcttccttttgtctttttggttttggattttgtgttcgtttgcagcgcatctccgtgacatacacttgctgatgctgacctgagatggaattaatatctgtttgttgctgagatggaattaatatctgtttgttgctttgcttcttttcagtgggttgttttttccgtttccatctctggctagtcttgaaggctagacttgcgtaggagagcagacacgaggacatgagccagttctgctgagctgttactgtgtaaggagcagggagcgctggagggtggttgaaccgtgtccagccaggagttgagtgggcggtgggctggtcaccatggttaccgcagtgggccactagcttcacaattccgtagcatcgctttgtgctgcgaatgggaccttccgctcttgatcccctccttgtgttgacggctgctgcttgcatctccaggcctgtgggtggaggggttctctttgtcttctcagtccagggtgggccctgggtctctgagtcacagtgatcctgtccctcccctcgtgtcaggagacctttaagcctgagcccaggatatattcctgtccctggttcaaggaggaaggcacaaggtcttgcctgtgttctggtggcaacagggttgactgccattcccctggcagcttgaggcttttgttcctcagaagagaaagttcgggagggggcttcgcatgtttccctccacggcagccgcatccctcctccagaccttcactcccaaggaagtctctctggtcttctgcccagccccgatctttctcgtgagcacccagagagcatttgtattaatcagtttatttttatgtttgttttttttgatatggaatctcgctcttacccaggctggagtgcagtggtgtgatctcggctcactgcagcctccaccccctgggttcaagcaattctcctgcctcagtctcctgagtagctgggattacaggcatgcaccaccacacccagctaattttggtatttttagtagagacagggttttgccatgttagccaggctggtctcgaactcctgacctcaagtgatccactcaccttggcctcccaaagtgctgggattacaggcttgagccactgtgcctggcccagaattttttctttatagatgtatgtttacaaacttattacatgtgctgtagtttgtagtcgatgtatacagacaagaaacaggccaggcacagtgatgcatgcttgtaatcccagcactttgggaggccaaggcgggaggatctcttgaggccaggagttcgagaccagcctgagcaacatagcgggaccctgactctacaaaaagcatatatatatatatatgttttgagtttttagacggagtctcactctgttgcccaggctggagtatagtggcgcaatcacagctcactgccacctccacctccgaggctcaagcgattctcctgcctcagcctcccaagtagctaggattacagggacaagtcacaggaagccaagattgtgccgtaccactgcactctagcctgggcaacagagccagaccccatcccccaaaaagttttcttatcattttttggggggatgcaagctcgctttgttgcccaggctggagtgcagtggtacagcacaatctcggctccctgtgatctctgcctcccaagttcaagagattctcctgcctcagcctcttgagtagctgggattacaggcatgtgccaccacacctggctgatttttgtattttagtagagatggggtttcaccatattggccaagcgggtcttgaactcctgaccttaggtgatgcacctgcctcggcctcccaaagtgtggtgattacaggcgtgagcctctgcatctggcctgtttcttcagaatagatttctaataattacatttttgggtaatgggtggggattgtagtaaattgcacattggttactgagacatagatacacatattcattaagaaaaactccagtcagtcgtggtggttcacccctgtaatcccaaggttttgggaggctgagatgggcagattgcttgaacccaggagtttgagaccagcctgtgcaatacagtgagaccgccttctctaccaaaaaatttaaaaattagctgggcgtgtgacacacctatagtcccagcttctcgggaggctgaggtgggaggatcgctggagcctgggagtccagggctgcattgagttctgattgcatcgctgcattccagcctgggtgacagagtgaaaccctgtctcaaaaaacaaaacaaaaatccaagtcaggcctcatgagattgagtccctatgacatttccaaggtgagggctttgctctgataatggggatccttcagagaaggctttctcccacctgtgcccgcgaggcggggggtgggggtggtctcagcagttgatcgggagcccacgggcaagcgtggcctctcatatcctctctccccactctgatgtctgccttcacagatacctgctttcccacaacagcaaggaagaaccatggcccaggtgagtgtggcatttctttctactgcactttttcagcagggattttggatgctcataagaacatgactaataaaggctgggtgtggtggctcacactggtaatcccagcactgtgggaagccaaagcgggtggatcacttgaggtcaggagtttgagaccaacctggccaatgtggtgaaaccttgtctctactaaaaatacaaaattagatgggtgtggtggtgggtgcctgtaatcccagctacttgggaggctgaggcaggagaaccacttgaacctgggaggtggagattgcagtgagctgagatcataccactgcacttcagcctgggtgacagagtgagactctgtctcaaaaaaaaaaaaaaaatctgataaaatgcaaacagaagtcaggatcagtgaaaacaggaagagaatggaaggtcacggctgtgggaaggacagggtggagagactgtagaggctgctgcagttgtgagatgccttgtaaattcttttttgagacagagtctggctctatcatctaggctggagtgcagtggcataatctcggcccactgcaacctctgcctcctgggttcaagcaattctcctgcctcagcctccttacaggcacctgcttacaggcacctgctaccacacacagctaatttttgtatttttagtaaagatgaggtttcaccacgttggccaggctggtctcaaactcctggcttcaagtgatctgcccacctcggcctcccaaagtactgggattacaggcgtgagccactgtgcccagcccgatgccttgtaaatttatatctgacattcctgtcacttaaaaaaggcaggcagattccatctaatatatgacttgtgttgtctgttttggacaaccgtgtctaattctcggggggaatacagctctttcaagatttaaagatgtatttgatctttgtatgtaagatgtggcagacccgttcctcaataacaaccaccttgaaagaaacacaacaggaaatctcttgtgacttttcttcctctctgtataaacagcagatattatgccaaagcagccgtctgtgattctggttgtttggggatgccgaacactcaggtctacagagacagccttgtgtggtgccaagtgacctggatgtaacactgcattatctagaggaacgaatgaatgaactgcgtgttcttgaaacagcctgccatgtgtaccgccacaccaccctgaacgtgcctgatcttgtctgaaattgcttgccataatgggttttatttttttaattaaaaaatttttttgagatggagtcttgctctgtcgcccaggctggagtgcagtggcactatcttggttcactgcaatctctgcctcccgggttcaagtgattctcctgcctcagcctccggagtagctgggaatataggcatgtgccaccatgcccgactaatttttgtatttttagagatggagtttcatcatattagccaagctggtctcgaactcctgacctcaggtgatccgcccacttggctgttagctctctttgcatgtgagtgacatcagtgttttccatcagcctggaagcattctcctcctcctgctctgaaccccgggttctaggaatgtgtgagtgtggagtgcactggttagaagttctaatccttgaagttggaagagccagaaatccaactagaagtaggttaggattaaaaaaaaaaaaagtaattctagaactttgggaaggtgaggcaggaggattgcttgaggccaggagttcaagaccagcctgggtaatgtggcaagagcccatctctacaaaaaatagaaaaattatccaggtgtagtggcacatgcctgtactcccagctgcaggggaggctaaggtgggaggatcacttgagcctaggaggtccaggctgcaatgagctgtgatcgtgcctttggactctagcctgggcaacagagggagagcctgtctcaaaaaaaaaaaaaaaaaaaatctataaggcagcatgcgagtcctgggaagagcaggtgtgcagtcaggctccagaggcatccggcaaaccaggtatcgccaggaatctttcttccctggtctgtgcttctgtgactttttttttttttttttttttgagacggagtcgcgctctgttgcccaggctggagtgcagcggcgcaatctcagctcactgcaagctccccctcccgggttcacaccattctcctgcctcagcctccccagtagctgggactataggcacccgccaccacgcctggctaattttttctatttttagtagagatggggtttcatcatgttagccaggatggtctcaatctcctgaccttgtgatccgctcacctcagcctcccaaagtgctgggattacaggcatgagccactgcacccggcgcttctgtgactttcttctcatgctgactttgtcagtgtgcccagaaatagtgtagccccagctcctctcctcacagctgcaagttctgccacggtgagggactgaatctcccttcagtgatccaattttgaaagcttttcggggaggattctgttggtccagcctagctcaggtgtattaggccctctgaccaggcagctgtgcacaggggcaggaaggggctggtcccagaggaagatgaggcctcgtgaacattaccactgtccactccaggaaggaaaacgttcacagagcctgggtttctttgtgctttgtgaagccagggatgtctaggtgtttcacaccagaaatgtctcagagcagtaggagaggctacaacaaggtggcgagccacacccaccctgtctgtgaagctggaggtttcccttgttgtctttgtcggaagccactgttttttgttttttgttttttggagagtgagtctcgctgtgtcactcaggctggagtgcagtggcgcgatctcagctccctgcaacctctgcctcccgggttcacgtcatgctcctgcctcagcctcctgaaaagctgggagtacaggcgcccgccaccacgcccagctaacttttttgtatttttagtagagatggggtttcaccgtgttagccaggatggtctggatcttctgacctcgtgatccacccgcctcggcctcccaaagtgctgggagtacaggcgtgagccaccgcgcccggccagaagccactgttttgtagaaagccgagtcccactgggaatgactccctgttaggggaatctgtactaaagatgacaatgactgggttaaatgctgtctgtccagcactccgtggtctctctgcttttcatatgttatatcatgaataaacccatgagaggcatatctatagaaattatatatttacatggaaattttatgtttatatagaaattagatatgaataaattacatagaaattaagacattatgtagacattgtatgtgtatgtataaaaactacatagactgtctatatatatactagacatgtatgtaaactacatagactatatatatatatatatatatatatatatatataatgtatatacatatacatacactacatagactcgtgatagctcacgcttgtaattccagaactttgggaggctgaggtaggcggaccacctgaggtcaggagttcgagaccagcctggccacatggtgaaacccgtttctactaaaaatacataaattagctgggtgtgtgcctgtaatctgaggtactcaggtggctgaggcaggagaatcacttgaacccaggaggcggaggttgcagtgagccgatattgtacattgcactccagcctgggcaacacagtgagaccctatctcaaaaaaaaagtcactggcttcagcagcctttagcccttggtcataagtttttctagagatcagagtgtggtctggaagagaacccaggctctgtagggtgattggggctctgggcttctttgtggattgcctctccccactcccacatagctcccggtccctgctgctgcccccgggctgtgccctgcttgttgcccctcctctgcacgcgcttgtctcaccactggggacaatttgggtcgcccatttgcctatgaacatccgtcatcaccccagcagcatgtgtccagggggcccaccacagctctttatacccagcatccccccttgacctctgccacagtgatgaaagccccccgactctcacatacttttttttttttttttttttttttttttgagacagactcttgctctgtcacccaggctggagtgcagtggcacgatctcggctcactgtaagctccgcctcctgggttcaagtgtttctcctgcctcccgagtagctgggattacaggtgcctggcaccatgcccagctaattttttttttttttgtatgtttagtagagatggggttttaccatgttggccaggctggtcttgaactcttgccctcaagtgatccacctgcctcggcttcccaaagtgctgggattacagacgtgagccaccctgtctgatctccttcaaattatttaaactttgattaaacaacatagtgagaccccaactctacaaaaaatttaaataaaaccagctggcctatgcctgtaatcccagctactcgggaggctgaggcgagaggatcacttaaacccaggaggtagaggctgcagcgagccatgatcacaccactgcactccagcctggacagagagagaccctgtcccaaaaagagaagatctaaggccaggggcagtggctcacacctgtaatcccagcactttgggaggctgagacaggtggatcacctgaggtcaggagttcgagaccagcctgaccaacgtggagaaaccctgtctctactaaaaatacaaaattagccaggtgtggtggcacaagcctgtaatcccagctactcaggaggctgaggcaagagaattgcttgaacccagcaggcagaggttgcggtgagccaaggtggcaccattgcactccagcctgcgtgacaagagtggaacaccctctccaaaatagaaaatctctctttctctctatatatatctctatataatatataaatagataatatctatatgttatatatatattttatatacatcctcatattttctaataggtataaattgaagatgtttaaatgggggtctttaattcattgagagaggggatgggatgggtgaaggaggccaagccctgttctgcatctgtggaaccccttctctgcatttctcttgctgttttaattttgagcactagcttacattgaggattagaatcatgtgataatttagctcctgctatcctcccttccggtggctcccaccttttttccacatcagatcatctgtagttcccctccgtaaataccgtgaggtgggagtctgcatttcctacagggaaaaaaaaaatcacttctacccgtggctggtacgctctctccctctcccacacacgccttacacccggcattttcattctctttgtagtttctacgagacttttctgtgcctcctttgcccatgccaggcctcttgctaggaatatccttcagacatcagatcattctgtttatctttcgtgattctactcccctgtgatctcctaggaagcttcacttgacagtacgttggatctggctgctgtcttcctcgtgcccattctgtatgtaactacatgtctaccaccgcctatagtgtaatcttacggtacagctgtcttcctgtgttcatctggcagcaacactcctaactaccttcagaacaggaacaattttgtgttcagccctcgaccccaagcgcctggtagaacaccagcagtgtgcgaggtccctgaaagacacttgatcattgaaggaatgaatggagatccagtagtgagatttatttatttatttttgagatggagtctcactctgttgtacagcctggggtgcaagggcgggatctcagctcactgcaagctacgcctcctgggttgaagcaattctcctgcctgagcctccctggtagctgggattacaggcacccaccagcacgtccatctaatatattttttgtagagatggggtttcaccatgttggccacgctggtctcaaactcctaacctcaagcaatccacctgtctcagcccctcaaagtgctgggattacaggcgtgagccactgcacccggttgatattttttctaacaattttttttttctcttccacaaagtgtagtacaaagttaggggtgtgctcagctttctatgtaacctaatatggggaaagctgacctcggaagggggtaagatcaatctcctctacgcctttgccatggtacccagtgccaaccactccacattaatcagccatgtgctgttccaggggtcactgtcattcggggacgtggctgtgggcttcacccggaaagagtggcagcagctggacctggagcagaggaccctgtaccaggatgtgatgctggagaactacagccacctgctctctgtgggtgaggaagacttccccgtggtcctcgggttacatgaactctttttcttagttgtataaaactgggaaactgctcacgcactgaaagtgctaagctgggcatggtggctcatgcctgtgatcccagcacttcaggaggccgaggtgggaggattgcttgagccacaggtgcaagacccgatctatacaaacgaaaaataaaaaattagccaggcatggtggcatgtgcctgcagtcccagctacttgcgagtctcaaatggaaggatcccttgaggcccaagttcaagacttgcctgggcaacatggcaaaaccccatctctaccaaaacattaaaaaattagttgagggtggtgatgcctgcctgtagtcccagctactcgggaggctgagatgggaggatcacttgagtgcaggaggttgaggctgcagtgagctgtgattgtgccacttcactccagcctgggcaacagagcaagaccctgtgtgaaaaataaaagtgcttggccttgggtttcagtggtcagagtctcgatcccacttggagtcctcgtgaagttacctgccaagcgaaacagctctctgtggctgagatgtccaccttttgttttgcaggctgaactgtctgcttgcttggaaggcccagctggctcagcacaaatcctttaaccgtttctccccaagagggtgtcaagtcagcaaaccagctgtgatctccagtttggagcaggggaaggagccatggatggaggaggaagagataaggacgtggagcttcccaggtgagcaggtggcctgcagggggccgggggatgaggctcctggaagtctgcaaagcagaacccatggatgttgtcttgttttgttttttgagatggagtctcgctcagttgcccaggctggagtgcagtggtgcgatgtcagctcattgcaacctccacctcccaggttcaagccattctcctgcctcagcctcctgagtagcagggattacaggtgcccgccaccatgtgtgacttattttgtatttttggtagagactgggtttcaccatgttggtcaggctggtttcaaactcctgaactcaggtgatccacctgccttggcctcccaaagtgctgggattacaggcgtgacccatggcgcctagccggatgtcctcttgtttcaggcaactgttcttaaaagcttgggatcttggctgggcatggtcgctcacacctgtaatcccagcactttgggaggccaaggtgggtggatcatgaggtcaggagatcaagaccatctggctaacacggtgaaaccccgtctctactaaaaattagctgggtgtggtggcacgcacctgtagttgcagctactcaggaggctgaggcaggagaatcgcttgaacctgggaagcagaggttgcagtgagccgagattgtgccactgtgctccagcctgggtgacagagcgagactcatctcaaaaaaaaaaaaaaaaaaaaaccctggatctttgcaagcagctgtggacatttggccttaaaccttgagatgccttagtgatcctgccacctgcacacatcactacacgattcctttcctgtctctggattttagagaaaggcatagtctatttttttcttttttttttcttttttttgttttttttttttttgagacagtctggctgttgcccaggctcgagtacagtggtacgatcttggctcactgcaacctccgcctcccaggttgaagtgattctcctgcttcagcctcctgagtagctgggattacaagcacgtgccaccaccatgctcggctaaattttttttttttttttttttttttcagtagagatggggttttgctatgttggctggccaggctggtcttgaacttctgacctcagatgaccctcccacctctgcctcccaaggtgctgggattacaggcgtgagccaccacgcctggccctcttttttcttgttttgagagactgtcttgctttttcacccagactggagtgcagtggagtgatggtagctcactgcagcctccaactcctgggctcaagtgatcctcttacttcagcctccttagtagctgctacttcaggcacatgccatcacactgagccactgagctcattttttttttcatttttgtagagatggggtctccctatgtcgtccaggatggtctcaaactcctaggctcaagcgatcctcctgccttagcctcccaagtagctgggactacaggcatgagccatatgcctgaccatctattttcatttgtcctttgattctgctctgctgtcccccactaagacctcgattgccaagtcttcctgtagaatcttcagtattttccctgtggttataaaacaggttttctcctgtgttcagagattcattgatctgccctatgttaaaatagctgttattttgtgctatttgttcttcttttcatcgttttcttttactgtgaaatgcctcaaaaacatattttctacacgtataatttagtcgcctctctcttcttcacacccacaaactggtgaaagccattgctgtcctttagtgtacttaatgactttatttatttgtttttgaataaataatccagtgttgcccacactggagtgtagtggcatgatctcggctcactgcaacctctgcctcccgagtagctgggcctacaggtgcgcaccaccatgcctggctaatttttgtatttttagtagagataccgtttcaccatgttggccaggatggtctcgatctcctgacctcgtgatccgcccgcctcagcctcctaaagtgctgggattacaggcgtgagccactgcgcccggccaacttgatgaggttaaatcactgctgtctccctcccagctcaccttcgtgtggcattgattgatgctgatcaccaagtttctgctgcagaaaacgaaggggctgggttatttggagctggcaccatcttttctattaaatgctcatttaggggccaggcatggtggctcacgcctgtaatcccaacagtttgagaggctgaggcaggcagatcacatgggtttaggagtttgagagcagtctagccaacgtggtgaaaagccatttctactaaaaatagaaaaattagctgggtatggtggcatgtgcctatagtgtcatctaatcaggggactgaggggagaggatcacttgagcccaggaggttgaggctgcaataagctgtggttcctccagcctgggcaacagagcttgaccgcatctcaaaaaaacaaaaatcgaacatcagctggcaccagtaatggaatcagaagtaattaaaccctccaggcatggcagctgtcacctgtagtcccagcactttgggaggctgaggctggaggatcgcttgagtccaggaggtcgaggttgcagtgagctatgatcacgcgagaccctgtttcttaaaaaaaaaaaaaaaaaaaagaaaagaaaagaaaaacttggctcatcttgaaggtttttttgtagagatggggtctcacgatgttgcccaggattgtgttgaactcctgggctcaagcgatcctcccaccccggcctcttaaagtgctgggattacaagtgtgagtcactgtgcctggccgatcttagaggttaatgtcaactttgtctacttcacgcatctggttactctactgtccagcccagtacattaccttttatatgacttttaaattcttctttcaaaaccatgtaatatggctccattctgcctaatgggctgtactcagtataaccccatggggagaagagctattatttcatttgtctgtgtttctgcaagaagctctgggggacactcctttaaatccctctttggatcaggacaagaattctttgtcacgcgtttgttcgggacgctgctaattaattgatgatccacaccaaaatcacgtggggaacttcaaaaatatccctggctgaatctcaccctagaaatctgacgggggagatgaacaggtggtctttacctctcagaaattcagcagttcagctcaggaacttctttcttttttcttttttttttttttgagacggagtttcactcttgtagcccaggctggatgcaatggcacgatctcagctcaccacaacctgtgcctcgcaggttcaagcgattctcctgcctcagcctcccgagtagctgggattataggcatgtgccaccgcacctcgctaatttcttgtatttttagtagagaggggggtttctgcatgttggtcaggctggtctcaaactcctgacctcaggtgatccgcctgcctcggactcccaaagtgctgggattacaggtgtgagccaccgcacctggccaggaactttttttttttttttgagagagagcctttctctgtcacccaggctggagtgcagtggcacagtcactgcaacctccgcctcctaggatcaagcagtcctcctgccttagtctcccaagtagctgggattacaggcacgcgccactgtgcctggctaatttttctatttttagtagagacagggtttcaccatgttgaccaggctggtctcagactcctgaccccaggtgatctgcccaccttggcctcccaaggtgctgggattacaggtgtgagccactgcacccagccaggaacttttttttttttcttttctccttttatttttttgagacagtgtttcgctcttgttgcccaggctggagtacacaatggcatgatctcggctcactgcaacctctgcctcttcggttcaagtgattctcttgtctcagcctcccaagtagctgggattataggcatgtgccaccacgcttagctaattttgtactttcagtagagacgggggtttcaccatgttggtcaggctggtctcaaactcccgacctcaggtgatccgcctgcctcggcctcccaaaagtgctgggattacaggcgtgagccactgtacccagccagg

SEQ ID NO: 767 - DNA, 909618 bp, Homo sapiens
tccagcaacagaaaaaattctgactacgggagataatttttcagacaaactaagatgattaattactaaataaaaacagacacaccaaatggattattaatacaacgaaatatcttttttctctctaatttatgagatgggatatttggaagcaatcccagttaatgcagtataactaagatgtataggaaaaatgaatcatccatttcaagtaatgagccatagagaaatgttagtaatgatgaaaaggaaacttacaaccagattgaggaggacaaactgctctgccaatttctggatttctttattttcagcaaacactttctttaaagctataatataaagaaaaatcattaagcatccatcttagcattggttaaaagctttgttcaattttcagttaaattgcattttatttacttattgaattgcattttaaatacagtattctactttggccttttagcaaatgattagtgaagtaatatctatggcattgactacctctgctttctattcactcattcatccattcattcatcaattcatttttttctccagctcatatttattgaatggctgccatgtgttacgcactgtgttctgtactagggatggtgcagtgaacaaaaaaaagcatgtgttttttcacagagctcacatacttgtgtgggagacaaaccataaacaaagaaataagtagatgatactttcaggtagagatatgtactttgaagaaaaataaagcaaagcaaagggtttaaaaactgtgagtggtcagggcagatcttcctgaggagctaacgttgaagtgagggagtggtccattttggggtaggccactgtgggcagggggaactgcaaaagcactagctgtgaggtgggaatgagctcacctgtgggaggaacagcacgaaggccaggctggagagagtgaagaaagcaagaggagagtggtaggaagggagagatagccattggcctgatcatgtcagcctcataggttgtgatcagaaatttggatttagttctgtgataagaagccacttgagcacgtgagtgatggaatctgatttatgtctaccagcctcactctggcttctgtgtggactggctgtagggtggccagttaggtgactgttatggtagtctagacaagatctgatctgggcttggaccagggcagtagcatggaggcaataggaagtggttggatttgggcccagtgcaaaatgaaagggtagagccccttgttgaagaattactaagacttttaagacaatgatagccaagtttaaaccaagtttgggaaccttctaagcttggggccctgtgagatggcacaggcttcatgcctgtgaagctggtgctggtttaaggatatattttgaagataaagccagtatttgctggtgtattgaatgtggactgtaagagaaatcaagaagttgaagatgaatcctaaaactagtttttcaaaatatgtaccaatggttatcacaaaatgtggagatatttgaagtcacttttaaatatgtttttactatataaaatattctttctttaatgcaactgtggttctaaagatacaaacatgagtgatctgaaccctggccctaaggctaaaagcctataaaggaaatcatacttagaagaataaattaccttgactgtgtgggcactcatccaagtgatgaataatcatcaagggtttgttgctttaaaagacagagattagacaaattttaatgagtaagatttcacatatatctagatgtcactaggtggtgctcttgagagctttgagggagctctgagtaatcctgatctttaccttgtcttggatttatatagagcttcttcatatgtctgagtccagatgagttggtcaccccaacctagaatgaaatgaatcagtatatttgaagcttgtataaattcagacccaaagctgttgaaaagcaatggtaaagactgggataatagaccctatactaaagaagaagaaaaacccctggagaaagtagaaataattataaacagtgataagtctagaaggaacacaaccaaaaataacctggcaccaggttagaaccaggtttaagcaccaagagagaggaaatcttttccaattaagtagcagttggaagccaacaagaagctgactcctacctctggagagggtctggggcagtttgggtcgagagtcctttgtgtcctttttggctccaggtttgactgtggtatctctggccagagtgtaggagagggccacaaggagcaagaatgctgacactggaattttctccatggcaactctagtatggaaaaccaaccaaaatcagtaaacaaaattgaactagcagtcttcagggtctgcaggttgccccacaacggtggaatataccagaaactgaggctctgctgagactggacatacgagattggcgtaaatagctctgttccatgggattttcctaagaatacaggtggtctttgacttacaattgagtaatgttccaataaacccattgtaaactgaaaatattgcaagtcaaaatgcatccagagtagtctctcctttcccagggttttactttctgcggtttcagctaaccacggtcaaccgcgtccaaaataagtgagcacagtgcaataagatattttgagagagagaccaaattcacctaacttttattataagatactgttgtaattgttctgttttattattagctcttattaatctcttattgtgcttaatttataatttcaactttatcatagatatgtatgcataggaaaaaacatagcatatgtagtgtttggtactaatgtgcggtttcaggcatccactgagggtcatggaccataacccccacagataatgggggaactaccgtaatacacctaacccactgaacaccacagctgaacctaccgtaaatgtgctcagaacactcacattagcctaaagttgggaaaagccatccaacacaaagcccattttatagtaaagtgttaaatatctcaagtaatttttatgaatactctattggaagtaaaaaccagaatggttatatggatacttgaaatacagtttctactgaatgtgtattgcttttgcaccatcataaagtcaaaaaattaagtcaaacttctgtaagttgggactgtttgtatatagtatggatagctgtctattgatccacatagataaagacaaaaagatatagatctctatagatatagagttatctatatagatatatatatctatatagaaatagataaatagagatatattttgagaaaatagatatacatactctagtagctaagaaaatttacatttactttttttggagacaagggctcactgtgttgcccaggctggagtacagtggcacaatcgtggctcactgcaacctccacctcctgggttcaagtgatcctccctcctcagcctcccaaggagctggggctacaggcacgtgccagcatacttggctatgcttttgtattttttagtagagatggagttttgtcatgctgcccaggctggtctcaaactcctgacctcaagtgatcctcctgccttggcctccgaaagtgctgggattacaggagtgagccaccacgcctagctgatatcttagttaaattactttttctttctggtatgccacagttgattcccaggaaaaactaaagcctatgaaaaggaaagtacatggcaagataagttttgtgagtgaggagggagggagggagcaaagtgagttgctctagcaagtcactaaggttgtccacggggccgtaacatggaaggctggagatttgggattctgataaaaccaaacactaaaagtgctaaaaaggaaatatgaaaccccggcacctaactctagtattggtgaatggttttgaatgaagtcaaataaactctgcaaggaattactattgttaagcaggaagtttttcataatctaatatcttgagtggaaacctttgctaagcattagctgatttttttttaagtgttgctaagctaccagatcgaaatgatgttttgtatttaactgaccaatgattaactaatccatagtatgtaagcacaaaatgtcttactcagaaaagatgtaagcaaaaatcagggatatactttgttcattttctatacctacaaagatgtggaaatgccaataacttttgtcttctagagttttgcaaaaacaacctaagtgttcactgtaagtcaacaattctcagccctctttgtataaagacttctttgtaatgttaaaaaaatcaagaacttttacatgagaataattatacatttggaatactggctggttcagaaacatatggcaaataatttctttgaatctatcaacaaacatttgattttatcttttatttataacagcatctatatatattctaaaaaatagtaaattgatggtaaggcatttttatttacttagcccatttacagttcttgttttccaagtagctattaggaccttgcagtatctccaaagatcacaggttggaactattgatatattgcttgtgttttacggcaggatgactcaaggaaggctaacataactcctgctgtacaaacatcctgctgtggggtgactttctgagattcactccactgagttttcgtaatgtgaatagattctgctctgcaaatttcctgcataaaccacctcaaaacacaattccatggaaaatattgataatttggagacacacacagacataggtacacacacacacacacacacacacacacacattatgtgaagccagcactttttactcatcaccgtatccctgtcttcttgtctttagcaaataatgaacttgcaagacattttagtgtccctatttgtagatgcttcaggaaagcaaccagctctctcctctaatagcctatcccatgaatttaaagattgcagaggcaacaagaatgtctttgcagcaaaaagagaaagaaaactgttttctgatttgcaataatatattccaagcgggcaatccgagctgaggtgtcatagtggagaagcctatggggctttgctttagcccgtgggaaagaaagctttagatggtgactgagacgaaaatccctggaccctgtcccaggcttgaaaaatcctaggattcacctactcttggaaattttgtttcgcaaaagagaaagcatttctctgaactaactcgggaacgtcacactgtgccagctctagccaaagaaaggccccagtaagacttttgtggaaattccatgatttcccttccgtatcctacttcattgcctttggaaacttgcagttctctgttgcttgattgcctacaactttatatagcaatcagaggcccgaattcactccagcaagtacccttctaaagctgctgtcaggagccttacctggatttcctcacccacctgccttgtgtgagtcggcggctaggatgcggtccaagcttctgagtgtgccagcacagctgagtctctatttatgcaccagggcatacctcaatcccacccactagtgctgcatttacttgttgctaactcagaaacgaaccttcctttccccaagtgattatcttccctgggttaaagagttccttgtttttaaaaataacattgcaaaagtatgcttttcagtatgcatgtttttaactatttgtgaaacgtattgttaagaggttttgaaacgatgggcagagtgccaaatccaggtagactttgaatgaagacatttgatttgcctgaaggctgatttgtctttacatgattggacagagtttgtagtttgtagattttttttctgctccgtgggcagattgcctttatttacttgaagacacacaagagatgattcacaattctgatcctcgcagtcatataacctgccatactccattatgataaaaattattttctacaatacttccctgctcctgtcaaaacaatgcaccctaacttctacaggtatgaaaaaaaatacaaatcaagtaacccacgtaatttttcaaaactgaggaagtattggcaaaaaaaaaaaaaaaaaacagcctaatatcgtgagcttgtaataaatgccttgccattgaatgtatgcagcaacttccctccacagagttcaaaggtatttcacagataatctcttatttaaaggcaaactttcctgccacgcaagcaggaagccatttactccattttctcagacctaaaaactaaggtctgcaaccaagttttttttcccctcaagaccatttaattactccctgaagattttaaaactggaatttaaattttctgtcagaaaattttaatcctgtattttgttcatgaagttgtgtgcagtctttaaaagctcagaatgaagaaaatgttaacaacagaaagttaatgaatgggatgcaagccctatataaatgactttttaaaatgagttaaggtcataatatttcaaaaacatttgcaagtatgtatatttttccaataaatccttgaattctgtgggcaaaatcgtgattctccaaatactgaatttcctttcaattctaatgaatttatagaagtaatttcttcaggagtttgaaaacgatgatttgagcaaaattcttaaaactagcaggcccttagatagacccttgtaatattcaattccagtctttcattttacagatgaataaatgaagatggcaaaaaattcataactttttgaaggtctcacaactagtttagggcagagttgggaccaaagtccttcagtcccttatccactgaaagtaacaagtggatgggatttggagtcacgagattcccatctgaatcctgcatcctggtgcttgctcataggatgatctgagatctcatttaacatccccaaaacttcagtttctccatctataatatggggataatattaacatacgggaccattttgaatattaaatgacttttccctgtattgccacatggtttttccctctgtacctgtctgtgtcatttttttccttttcttataaggacaccagtcatattgtatttgggtcctgcctaatgacctactttaacttaattacctctgtaaagatcctattctgaagtcctggggattaagacttcaacatatgaatttttgggggggacacaattcagcccataacatttgataaaagtagctaatgcaggctggcttaagacctagttgttgggttgatcagtgcagcaaaccaccatggcacacgtttactgatggaacaaacctgcacatcctacacacatactccggaacttaaaaaaaaaagtctttgatttgttacagttaattatagtgatataattattctatactcatgtgcctaatctcatgtcgggaaaaacccagagtttgtcatagtggctgacggatggcaaggaggaggtaattattagcagatatcctacacatgctattgaggctgtggaatctttggcatatctgtcttggtgtgaggtaactagggttctgtagatggtacatatagtatgctttgagacaagcaaaggaggggtttttgttttatgctattaaacttcatcacttttaacagtgatgccatgtgatcagtccttcaggtttgcctgatactgtaaaaatatgtcgctatcaggtagatattttggataatacctgagtaggacttcctgaagtaggatttgataatttgatataccggtctaatattatagtaagtaaaactaagcttggtaccagggatcctataacaatggttgtaattaagtggatattatacctttgtgttttaaatgtttattacattataattttagaggcatttattcaagcatattttattttatatttttaaattcaacttttaaatttagggggtacatgtgcaggtttgttacatgggtatattgcgtgatgctaaggtttggggtacgattgatcccatcacccaggtagtgagcatagcgcccaataggtagtttttcagccctttctcccttcttttcctctacccttttggggtccacagtgtctatgggtcccatctttgtgcccatgtgtacctaatgtttagctactactaagtgagaacatgtggtgtttggttttccatttctgcattaatttgattaggataatgacctccagctgcatccatattcaagcatattttaaagtggattatatcctatttttgagttaaaacaggagacttataactggcaattattgtgtaatctagcatgcatgagtagctaactcttgtgtttcatttactcattcatttattttcttcaccaagtattcatcaactctgtttatgtagcaaatattgtgccaggcattaaatatataaaaatgaaaaaatgatggtcagttattgaggtagccagacacacacatagataattgcaattcggagtgatgggccatgctatggggaaaacatgtagcagtttacaacactgtttctactctaaggttacttacgatctgattgaagaattaagatggaacaacactaaaaattagccattcacatgagaatggcacgcaacaagaaacaagtaagtgggatagacgtcaggtgtgattatttttcagagagagtagagattgctacctactagagtgctcaacttgacggcagaaagcaagatttccaaatagagacggtgatatagaatttgcaaaatatatttgtgggatatttaaggacgagcctagctgaagtgagagacatctgggtagctcatagacaatagggttggaggggtgttttggggctatttgcctgggcctttaatgccattctaagtttagactttaccctcaagaggaagcatgtgagggttaagagggcaagctgtagattcagataggttcgagtttgaatcaagtttcctgactgttacatactctactaatccaggcaacttacttaacttctctgtgctttagttgtctcacttgtaggtcttcctatccctacttttttactatataggatctgtggaagattacataagataatagacataaagtgcttagaatggtacataacacatagtaagcactcaaaaatattagttagtaatacagaatgtattacttctctgtattatgatcatttaggtctcagtctatgacagcagaatctttgttggattaccctttgattatagcctatcacaagtcttaaacttttcacatatattcattggaaatattcatttgtcattataacaatctcaccagacttcattattttcttttaaaaaagtaaaaaggctcaggtgagtggacataattagcgcaaagccacaaaattgatgaacagagagaagatctaaaattttccatagttggtgataattaatccagtatttctttcagtccatcaggctgccttctgatgtcaggaaataatgagataagcctgtagatgcatagaattccacattactgaattattatgagccttatgcagagggaagtgcaaatgacttcttgtactcaaagggtttgcctcagagaagacttgtcaaaaacatatctaactgctgaccaaatagctgaataaattctccctaactctagcttagagaaatggacacataaaaatttgtgttttgacagaggaaaacttggttaccatttgaatttattttaatttctgaattgggcttttgtgcacagaatggtttagagtttctggagttttaattgatatccagtaatgaaattgttaaaaatagtttaaactgtacttatatatctaattctcttaaactttctaaatgcccaacagagcagatttgcaaacataattagcaaaacctttctttgagtaagcttatcagctttactcttctttgtattctttcctgagactagtgatggaggagcagatttactgcttgggtggatgaaggttcctgggtctaaagtttgggaccatgatatgtgtcaaaggctgagaaccagtcattgatatgttaaacttaatgtcatacaattagatgtgtttcttgcgggaaagtatagagcaaaaggaccagcatacaactttggtaatgattgtccatttaggagtgaggaaaagaaatacttgcagagcacagaaagtataaagtgtgaggacaggcaggatagtgtcatagccctggatccaagtccagtaggagctacaaatctcaaggcaacaactggtgccaaatgcggcgagacttgtaactagacactaggagaatacactgattgtataaaaatcagtggctttaaacgaaaattcatgaagggttcttgggttgaaataatgaaaagctaagtgttctggtgcagtagtgtattaccttttggggtcatgaatgaggtgattatacttctcagtttgcccaggagagcctcagtttaagcctgttgctgggtataataattgagaatgtcttctttcattctcaaaagtaccatgatttggacaataagttacatgatctggatgatgaaatctattgaatttatctgcaggtaagatacacatatataggcatatgcaaaattttacagttacttcagagggttcacttatatactgaacccaatcctaggatctctttgagggatttataaaccctcaaacgtttgctcttgtgttcaagtttctatgcttagccattctcaaggagcccacagcttgagatttggcatgtaactctccacacttgttttacagcataatctaatctttcttcctggtgagcagaaattttataccctgtactaagctggaaggaatcctagtctcacagccattcaaatcccttgtttgctctgaataaagtcccacagcctaaaattcttttacatcatggtggaggtgtgctttgtagaggaggaggaataaaaagtaatttaaaatgtaataacacctagagttattaagtgatttccccacgaactcttatcttttagaagatgggtatttataaagcagacattaagatctttcttttagaatttgcagtgagtaatctcagtcaataagaattttccatcgaaatgatatgctgctaatgaggttgaataggctacaaacagtgcattaaaaaacaaattgggttcagtaactactttcaccatatatgaaaggcagattttgtacagattaagacgacgtgtccttagcagttcgagtctgaccctagagtcaatattgttagatgataaatacactccttcgggtggagcactgaataaacagagatgctgtcagaagatgtcattcttccttaagcatggaagtgacttaaaaaaaaggcctaattccaccttgtaagacagctttaccttgactaagttccatgaaatttcttctgattctttttttttaaaccttattcctttgaaaactattacatagttattatcaaatgtaaacagttatcttgtggtcatgactagatctagaattttctatctcattatctagtcatctgtatactgaaaaggcaggtgtttcataaggaacattagtaaataaaaaaccaacatattatggaaataataagtgtattacatatcaatattaacttggtaaatatagcacgtggtatactacaacatgtaatataatacttcagtttatgaagttttttctaacaggcaaaaccccccaaattataatattttaaattcacaacagaatacacactttattattaaataggctcaaaagaaaatactattatgattatatttttctcatctttcaaatagtaataagtaactttccaagacctcaccttttgtgtgcatgtaattgaatatatttctaggaaggccaaactactttttctgtgatctatgattccaaacttgcctctagtgaatgggcttgtgcttgtcttttataccagttggttttattgtattgtttctccaaatggaggaattggtttcaaaggtcagagtttgggtaaccttgggttttcaaaaaaaacctgccatattgttacttaaagaagcagaatcacttattgctttcacagattattttgggatgctttaccctgctttttatgttttatccttaatgttaagtaccaatgagagaataacacgtactatgttctcaatattcttctgtttgcaagtgttttccatatgactcattctgtaataacttttttctcatagtcctcagcaataggtcagcctagaaagcaaacagagaagaaacttgtcacatttactttcttcctgatttctttaagtcctcgtcatcatttcaagactaagctttgctatattcactgcattccatttttttttctaacctgtgattttagggaaagatcacacttgttcattatttatgggcttttagactctgtataatgggggaaaatgggtttcaattcagtgaatacttatgatgtaactttatacgtgtctcttagttacagttaaactagttttctattattcccagtttatgttggcttgccgaatgaaaggatcacttagtccaagcaattcaaccaactaattagtataaatggtaaattatttgatgaatttggtgaattttctgaggctgccaatgtggtttgagggatatctgaatgtatccaaggcatgaagtgtagatattttataaggagatttccatatgacatgattaagatcactttgtttaaaaaaccagaattagcactaagacaatttttgttttttaagcaccaaactatagataggaaagtaacttaaaaaaatttcaaacgaatatatggacattttgtttgtgacttaaagactgatctcattagattcatttttactggcctggctcaggctgattttatactgctcttaaatgaaaatattttttctcagggtgctttcaaattacttttatgtgacatgtccaaagtgtatcattttcagctcagattagtttagaaaactgagattaaggacttcctgaacacagaggaaggaaataaagcagaaaagctgtgaaaattgtgttaaaaatttctgaaagcacaccttcgtatatgttttaaattgttattaatatctatagctatgatttctgaagttttattatggtacttgtttattaaccatgatactctcaaaatgtaatcggtcatttatattctgcatttttcaaattatttgtagtgagttggttgccatagttactgcactttcagcactatttgtcaactttttatcataaggtttttctgcataattttgcctattagggtcatttacataatttagtattactagactgtggaaaagttgattaaaggacctaaaatgattgctttgaaattattaagatatgaatttggaagatatttttctataagatgactcatgagtaaaaatgaaatttatatttttatgggttatgagtgttacttttataactattttgaaaagtatacacgactgaattttggcaaaactgccttcctttattgactaactacatgttctgagccagagtaaaccagagaccatgtataaagtaatataatatttattctggcatatgtgatccaagagaaattaaataaaaactagtctccaaagcacattataccagaaacaatagtacatcctgtggcatcttgtcacctgaaaacaccgcaggtttcagtggaactaaagattgagactagcacacaatttctttttaatgacagcttttacatggcagttttgcacatatttattctgaggttcggattttgtggccattttcactttggtaagcactctggaggaacatttcaggttaggcaataacccaacacaaacgtattaagctcagaagaaggaagtgaccaatgcaaaaatagtgcccagggggccagtttatgctaatagctaattgccagaattctagggtgctgggtacacacaaagagttttatattttatttccaaccacaggtcagcatcaaagatatgaccacagaaatgcattgtgtagtctgtcttacctaaagtcggagaaagaagtagttctagagtcatatctggactcagtgcttatttcaaaaggagaataaataagatagtgcttcctccacctcacaagacctggaagaccccttggtcctctatacacccttggcatctgtcccagcagctagactggctatcctcaaagcttctttttcaaggatgcctgtgtattcggtaggcaaagtgctatgttatgaccgaaaaaaaaaaaaaatcgttgggaggccgaggagggcggatcacagggtcaggaattcgagaccagcctggccaatatggtgaaaccctgtctctactaaaaatacaaaaattagccaggagtggtggtgggtgcctgtagttccagctactcgggaggctgaggcagaagaatcacttgaacctgggaggcggaggttgcagtaagccaagatcatgccactgcactccagcctgggcgacagagggagactccatctcaaaaaaaaaaaaaatgtgtaaaccagaactgagtttgttagcataatgccactggggctctagagagaagtattgtgccatctcattgctagaattggggcagagtgttgtcccatctttgacatctggggaaggtttccgctttataaaatgcaaatggaatcacttcaagtcctctcagacagtatctggatgatattccactttcaccactccaaggtgttgacgtggtacactctctacatgttttggtggttttatttttcatttatagacattttgttgggttatttctcagtctacctgtttatttttatagccttctacctttattgtttcttttaaacatttctttaataagtataaacatttaaattggaagtactaaacaaacctatttgttttgcttgttgactctcccttgaggggatgcttttcttggaatggtccatttttttttttatttgtgaactcctcttccttgcggattatttttctgttggaatctggtgtgctgcgttgtagacaggtttctatggagcctttttgagtttgcatctggcaggtgcctgaatagtatctctggtccacagtcatttttatgttaattactttccttaaaagatttcagcacaatgaggatggcataaacttaatttccaaacccacacataggacagacttagaattttgctttatcgcaagagcatgttttattttggttttctctaccaggtctctgaaaaagacaagtttctcttttgggtttcttagtcattaggtggtattttctagccctctttccccagggtccctagtttcagcagagctcacagctttagctcccttccttgaacccaaatcactttttctgaacccacttgacatttccgaatgttccctggaactgtcagttggaggggagtagggataaaagaaaccctgtctcctggaatatccaggtctgaattgatttgtgttaatgtgaactctcatgattattttttttaaatgagtatctgctccctggacaagaagatccagggggacagcttaaagagtgttgtctgaggagcgattattgctatggtaacacgggagtggctttatttaaagttttggtggagccagcaccaggctttactcatattgattggtgagagggagattgaagaagggaagtaggtgaggtgggcagccaggggcaagcccaggccaagtcaggtggtgactataaaggtggtgagcagcagatgggtgcccagagagaggcctggtttagggtgggtgaaatggcaatagcacctcattcttcttgtagaagtggaagaaggcctctatttcctgctcttatgtatttgtccttggaatgagaaatgataacattcaggatatgtgtgctgtagtgtaaacatctaagaaagtaatctcatgggatagggggtaagtcggcagatttcccaggatgtgccatctttattctaagaaaactcagtgtttaataccaagcatgtttttaatatatctaatatactatccaggggtgtgtgtgtctgtatctgcatatttgtgtgcatgtgtatgtgtgtgtgtgtatatatgtgtcatatatgtatacgtacttatatgtatgtgtctgtgtgcatataaccaggtagtatttttggtggtgatgactgattagtaacagtgaaggaaacttcattcaaccaaaaggtaattgtgacatgcccactacttccaggcccttttttaggcacagaagattcagcaacaaataaaacagcaacattcttgggctcctggaatttacattcttgcacagagaggcagacaataaacaaaataagttagtgaaacgcatagtgtgttacatagaagtaacaaggatggagaaaaataaagcaaataaggaggacacggagcgttggtacaggtgtctgcaattttaaatggagtgctaagggaagggagacagccaggcagaggaaaaagcaagaagcctgccctgcgggtggaggaggccatttggctggaatcacatgagctggggcaggcggagtagaagatgcagccagagagatgctgatttcattgcgcggcagacagcctgaagtgcaatctctgtggaactgagaacactgggcagaaactctagtgtctgtgtaaactgattctttggattaaagggtgatgcgggattacgggtgggtgtcagagagggcacattttgttcccagggtcagcctcaggaaaggcagagtccatgaagcgtttctctgaggcccgttttacctacttcagcaggatcagcttgtcctgactcccagcaccattccctcagcatcctgtgctcagctgtgatgcttccaaagtcacctgataaacttgtccctgtacagccaggacctggctgacattgatttaaggtcgtcactcactttgcctctttaagatgcttgaagatgaacaccctttaagactcaaagatagtttaacttgattccttgcacacagaaagttacttttgtacttaactgtgtgtgtggcattgtactaggtacctcagggagatacaaagagggtgagacatgatacctgctcccagggaacttgatgcgtaagacagggatggggaggaaagagactttcacaaccaaccataaacttctgctaatgatagcacttcagaaacggttaacaaccagtgtagaagatatttttcgggagggagaacttgcaatttttaaaacataaggatgccagcaactgcaaaagctggtcttgtgttttgctgtgatcctcagcaccctattttagcctggacagcctgcagcactgttgggtggtgcgaggcagcaggaagagcctgggccggtagggctgtgcctggggtttgatcctgcctactgtctgagggaacttaggaagtttcttgatctctctgcagctcagttttctcatgggcaaatgaggaagaaaatagtagctactgcacagggtgttttagaagaacaagcaagttaacatctgtcatgtactaagaatagtgcttggaacaccataaggcctctgcaaatgttatatagtatcccaagcagcaaacccacttcttcttcctcttttctggccaccaattcttgctagttgctttatttttattaataattgatgcttgcataaacaaataacacaactttttcttccattaggagcaatctggagactttcaagagagaaatacatggagagatcctataaaccctgggggaacaaagttcttaaattttataattgttcagtgttacaggagtttctggataggtgagcttttaaaattaaattttaatgaatgttacttagcagtctttcaatatatttttctttatagcaagtgttttagtaaatagaaaaataattaaaaccatgaatatgtgtatatataaattacaagtaacttctgtgctttccagttatttgtaaattaaaacttagaaattttttctcacctgcatctgtacagaatttttaaagggtctttcgaaggtcttagaatctgtaattcatgacatacaaggaagctaaaaatgtttgatttgttcagaagctattgtaggtgtgtctactcacacttcacatctgtaatctgagaatttactaagctacttgcttatgaataagctgactcacagcacacccaattcatgcttgagtttgtaaaaaaaataagtcttttgtagtggcatagctgctaccaaatagaacttgactcagagtttttctaaaggaacatatgattgagggaggacaaaatatgaaaagtagttggcaaaaaattggggaaatatatgatctatgagaagtaagacagagagagagagtgtgtgtgtgtgtgtgtgtgtgtgtgtgtgtttcaaagcatagtatatgaacatcaagggtttctaaggtacttttacagattctctgaaggatcctgtggaggaagagaaaaactaggcggtcccaaatctcatttagaacaactctcactttttgttttacacagtggacttctgagtgaaaacttcttttgaacaaatttttatagaagcaaaacatttgaaagcccctgttacagaccaaactcttcattgctagctttgcccatcccgaaagggccagtaccttgcatgatgcctcgcacaagaggaattcaacaaacatgcattcagtgaataaagagagatagaaaaatgcatcccatccatttggttgctgcatagagtatgtttaggggagaagtaggaaccaagatttcaaacaaggcagctgcagctgaagcatggaaagacgtggattgccgcactaggggttttacacttgatttggtcagtagtgggaagtacttcttaagtaagcaggggctgggcgcggtggttgacgcctgtaatcccgcaccttgggaggccgaggcgggcggatcacgaggtcaggagatcgagaccatcctggctaacacggtgaaaccccgtctctactaaaaatacaaaaaattagccgggtgtggtggcgggcacctgtagtcccagctactcaggaggctgaggcaggagaatggcgtgaacccgcgaggcggagcttgcagtgagccgagatcgtgccactgcactccagcctgggcgacagcgcgagactacgtttcaaaaaaaaaaaaaaaaaaaaaaaaaaattacataagcaggaagaaattagcctgaggctgtcttcatacttcgagtttctacataataaactgcaacctaacttagtatataaacaaaccgaaacctaatttaggagtatgtgttttgtaacaaatagctaggttttagccagtcacaggtggccaactcatcataccatgcccaaataaggtaagtgtctcatcacactgtaccccaataaggcagatacctagctgtagccaatcaggtgatttctcaactttcctttcacgttcagcctatagaagcttgctgctcccattggtgagcagagctctctgaacctcttttgcttctgagtgttacccagtttctaaattgttctttgctcaaactctattaaatttgcctaaagtttttaacataccttttttaatttttaaagttttaaaatttttagataaaaatgtgttgagatgtaattcacatacaatttacccattccaagtgaataataaggtgtttttattatactcacatgtacatgcaagcaacatcacagtctattttagaatatttttatcacctccaaaagaaaccttgtttcttttagctgttctttcctatttccctaccctcctcctccagacttaagcaaccagtagcctactttgtctctagattttcctgtactggacacttcatataaatagtcacatgtagacttagcacaatatctttaaggttcttttacttagcagagcgtcatcgtgttgtagcataactcagtacttcactcctttttgtgactatcataattaaaacatttagatgctgatttgtaaaaaatgtcgacttttataaacgggggcacgtgttcaggtttgttatatgggaatattgtgtgatgctgaggttggggatatggatcctggcactcaggtagtatgcacagtaccaataggtaggttttcaacccatgccctcttccctccctccccactcttgtagttcacagtgtttattattcccatctttatgtctgtgcgtgctcaatgtttaaaggatatttaagtgagaatgtgtggcatttagttttctgttcctgagttaattagcttaggatgatggcctccaactgcatccatattgctgcaaaggacatgattttattcttttttatggctgtgtagtattccatggtgtatatgaactacattttctttatccattctaccattgatgggcacttgggtcaattccatggctttgctattatgaacagtgcagcaatgaacatacaagtgaatgttccttttaggtagaaggatttattttcctttggatatatactcagtaatgagattgttgtgtggaatggtagctctgttttaagctttttgagaaatctccagactgctttccacagtggttggactaatttacatttccactagcagtatgtaagtgtttccatttctttgcagcatcaccagcatatgttgttttttgactttttagtaagagccattctgattggtgtgagatgtatctcattgtggttttgatttgcgtttctctgatgattagtgatgctgagcattttttcatgtttgttggccagttatgtgtctacttttgagaagtgtctgttcacttcctttgcctattttttaatgagattattatttttttgcttgccaatttgcttaagttccctatagattctggatattagaaactggatcaaaggcaccaagtgctttcctgcctcaactctttgtagatctcattgctctgttctaaagggtcattctactttcttcttagaacaactggcaattttggctttgttttgttttggtacggggtcttgttctgtcacccagtctcaagtgcagtggcatggagtgcagtggtgtgaccttggctcactgcaacctccacaccctgggctcaagtgatcctcctacctcagcctcctgagtagctgggactataggcacgtgccaccaagcctggctatatttttgtatttttagtagagatggggtctcgccgtgttgcctaggctaccactggctatttttgccaccatttcagaaaagcttctgtagccattgtatccaagaaagtaggcttcccttgccatcatctatcattttccccatttctttccttcatagatacttcacagatacttcaatatcggcaagtattttttaaatgtgttcacctgtgtcttcattgtttcctccactatgttgtacgctctatgtcactgttgcacttccagcgctaagcatagtatgtgttccaaaagtatttgctaacggaatatgtgtgcccttttatttgatgtgaaagtaggtgactgggagcaaaagccagtttttagggctttaagatgtgattgggtggagagtaatttgtggaaaactaataccaataactcaagaaatgggtggcaagagagggtgatactttgagggagtagcagggtggataaaggtttattttagagtagaggccatctgagcttgttagagataacaaggaaaggatttccaaggactgcaagaattgaagagacacaacgatccatggtgaagcagtggaaaaacttaggaggaaaggttttccttgacattctgaaagtagagtatcttttctttagcagcaggtaaaaatttggaggacagcaggagggaagctgatggggttcagtatggttgtttttcatcacccatgtagttgggaggtggttttgtctacttaagtaaagttgggtattgcagaaggaaaagacttgaaacagtagctgagatcagagagcctgacttcagacagccagggtttatgacctttcttcagaaaaatcaattgcttttcaattagagaaattatacagtagagattgtggagttaccattcacttagggacttttccttttgttttcttttttttttttgcagtttcatattagtgtgagataagttcacagcatattttatgggtcatttagcagatatttgggataaggggaaaatgacattagagaaaggagagttcctgttatattaaacaatacagtaatttttttttttaatgcgtggcatggggtgatattctatttgagcctttttttcctgctagaattaaattttctttgcatggttagttatacttagggaataaaatttttttttttaaagctaaaagtgttattcaactagatgacttctcacttgactaaaagagtgagaataacattggtcgctaagtttgataaattgtatatgcgttagggcctcagcctctccattttaaaaaagtgtatgatagtaatgaactacgttgggttgctaggaggaaaataaacaatgatattgtaaagggctggctaaatattaaatgctatacaaatacctttggtgctgctatccaggaaggactcatgaccttttagataaagtttattaaatttccgagggaggaacatgaatgaacaacaaagcaggcattgctattggaaatcagtcccctggtatattactgataaggaagactggttttcagttatactttcctgttgaggaaatgcaaacactttagtacatgatcttacaaatagtcttagtctcatgaagcagggggccatttttacaaagaaaagaagcttgatcaaagaatatgtgacttgataaggatcagcaagatggcagatgacaggggaaatttacattaacatctggttctgtaggtaataagtcacatgttccatgattccagcaggcttgcaccaagaacaattcctggtgcctagtaggtgttcaataaatgtttgttgcttcagtgaatattatttttaaaatgtcccattgtctaatcgccagtctgttaatcagtgtgaaatacattctgctttcctctgcaacaatagatttgttcatgattctgggtttcatatgggttttagaatgaggattgtaattttgaggttatatcccatcccccaaataaaataagaagtgatctaagtggacagtcagtctctttcctgagtgttacgtgttactgtttgcagcatacttttatattcattttctctgccaaccctattagggtggaaaaaatgaagtctctaccctagtagggtagtctctatttaactagtctctacttaactttgcttaaccaagcatgaagggtaggtattagttccatttttctgaagagtaaactgaaatttcaagagattattttcctgcctaacgtgttacaattagtactttgcagaaacagggctagaaatgagatctcctagttcatagccccatgtttttttctttcctaaaacaagaaacaaaacaaaacaaatgaatacgtaaataaaacttgaggatcagtcctttaataaaactataaattacagtagcaagaacctgtgttaaataagaataaaatgcctagaagtctagtattattatttttatggaatattatattagctagagtaatagaaatagcaaacactattgccagatactctcataagtgcttaatttagtgctcataacaattctttgatgtaagcacagcgaatattgctatcaaatctattttatcattgagtttgagtagcaaaattggaaaatgacaatatcatactatccaaatcaatttagttcctcattttaagatagcaagtagtaggagtttaaatagcaagatatttattccaatccattttgttcctaaatttagacagtgaggatacttatattattatatttgctttatataagaggaaactgaggccaatggaagtgaagtaacttgccaaaggccacacacagagctttgatccaggcagtccagctccagaataagttcttatttactagactattctgtcctttatcagttccctcaataatgtaccagaaagctcagggccttaagttttgaggagaaagaaaaaaaatagtaaaaacaggggattattacaatatagtcaggaaatgagaagggaggacagctctaatgatgtgggtaggtgaatttggaccagatgacattgacttacgtatggttttatttcaaaacctgggaatcaacagacgcattttctctaagatatctgctgctcaccaaattacattcacttactatggttttactttaaaacctgggaatcaacagatgcatttcctctaaaatatctgctgctcagaaaccctatttatttgaatgttattagaaaagtgattaacccagctgaaattagtattagctactttaccttccttctaggtgtgtgtctgaaattccagctctggggtacatgctgaataggttctgcttcattcagcaagttataccagagaaaacaatttactagtgctgttccctaagtgatacttgctgggcagtatttctaagagatgttctctagaaaaatggttctctggtcaaataagctggaaatcactgtattacacagtgaggatcccatggaggattgcacattggcatatgaaaggttttatgaagttttgcaggaaagaagccatttaactttgcctaaccaagcatttattcagcctatttagtaaaacattttttaaggagtttcattgttgtaattatttgtaaaacatctattgacattcatggaacaaacttcaagaaatcttgaattaatgtaaaaaaagtctcattaaaatagatattttacagacttagaccacagcttagttgacatgtacagttaacttagttgataatgtacagtctattcagagaaaaatacagtacttccactctttaatgtcaataatgctcccgtgtgcacaatttcttttatgtacattatatcatttgactcttaaaaccactacttgagaaagtagggcagatattattccagttaatgtaagaaaaaatgaggctgaaaagggtagcatcaccagctactcagacactcagagatatggtggttgatgacaagacactgcttcacagatgtatcaaaccaccttatctcttgtgatcttgcttggttggggggacttgtgtttagagttgtatttttcataatggttgctggttcatgttgatctagcaacatcctctttggtgattccaattgacggtcattggaaaacatcttatgtaacgtctggctgcgttggaaagagaagtttatggtcatagaaaaatacaaaaataaatattctatgagaaaagattagtatgaatttgtgttccagagaattgaaataactaaaaaatacagtaagaaaaaaattataaagattggttattatggagttgtgttaactttcacaaaaattactggacattgagtaatagcccacaagtcgacaagaattataattacaatgtttttcaagcaagtaagtgtagaggtttgtatctaaaattttttcaatagaattataggattttacatttgagaatggttttacagatcagttaatgaagatcccttattttacaaataaggaaatagaccaagatgagttaagggctctaccaaatacttagtgctttagtgcaaaactagacaagatcccaaatcatctcacccttcaagaaaaggctgcctggaactttgggagcaagatggccaaatagaagcctccagtgattgtcttccccgcaggaatgccaaactgaacaaccatccatacaaaaaagcaccttcataacaactaaaaataagattagtgatcacagtgcttggttttcacatcatatcaaggaaggaagcactgaaaggggtaggagacagccctgaatcattgacatcatccttccccattccctgacagcagccatgtggcacagagaatctgtgtgcttgtagggggagggagaatgcagtgattatgggactctgcttggaactcagtgctaccctgtcacagtgaaaagcaacacaggacagaactcacttggcacgcacagaaggagcatttaggtcagcctaagccagaggcaaatcatccatcacagcagttagaacctgggttctagcaagtcctgccagagtggactacaatgctctggggtcttgaataaacttgaaaggcagtctaggccataaggactacaattcctgtggcggagtggacttgggtacacgtgacctagtgagataccagctagggtggccaagggagtgcttgcaccacctctcccccaaccccagcagtgcagctcatagctccaggagagactccttccctctgttttagaagaggagaggggagagtaaagaggactttgtcttgcaacttggatacctgttcagccacagtagatagggcaccatggtcctgaggcccccattccaggctctagctccaagatgacatttctaaatataccatgggccagaaggtaatgcactgctttgaaaggaatgacccagtcctgggaggattcatcatctgctgactaaagagcccttgggccctgaatattcagcagtgatagctgggaaatacttgctgtgtccttgggtaagactcagagccatgctagcctcaggtgtgacccagcatattctcagctatggtggctatggggatgaactccttctgcttgagaaaagaagagggaagagtacagggaactttgtcttgcagtgtgactatcagcccagccacagtggggtagagcaacaagagggttcctggagtctccagtttcaggccttagcacctagacagaatttctggacctgccctgggtgagagaggagcccacagccctgaagggacagattcaggactggcagcattcactctaagctgactgaagagcccttgggccttgagtgaatattggcagtagccaggcagtactcacagtgggcatggggcactaagaaccatacgaagagattcttccacttgaggaaaggggagggaagagtgagaagaacttttccttgagacttggatggcagcttagttgcagtagaatagagcatcggatagatccctaaggttctctactgcaggccctggctcctggatggcatctctggacctgcccagggctaaggtaaactttctgccctgaaaagaaggacacaagcctggctggatttgcaacctactgataatagatcccttgggccttgggtgaacataggtggtagccaggcagtgttcgctctgggcccagtgctgtactggttcaggcctgacccagaaaagttgtagtggtgttggacacaggggtgctctttcaatactcctccagctccaggtagctcatcacagagagagactctgtttgcttgtgggaagttaaggaatgagagcaagagtctgcctggtaatccaaggaattcttctggatcttactcaagacaatcaaggtggtacttctatgagtctgcaagagcaacagtgatactgggcttggggtttgccctaaagtagatatggctgcagtgaagaaagactagatcacaacacccaagtccctttgaatacctagaaagccttcctaagaaggatggatacaaataagcccagactgtgaagactacaataaacacctaactcttcaatgctcagacatagacaaacatccacctgcaataagaccatccgggaaaacacgaccttatcaaacaaataaggcaccagtcacatatcccagaaatacagaattatatgaccttttagatagagaattcaaaatagctgttttgaggaagctcaacaaaatccaagataacatggagaaggaagtcagaatcccatcagacacgtttaacaaagagattgaaatagttaaaaagaaccaaacagaaattctggagctgaaaaatgcagttgacatactgaataatgcatcagtctcttaatagcagaatttatcaaacagcagaaataattagtgagctcaaaaacaggctatttgaaaatacacaatcagaggagacaagaaaaaaaggaaaaacaatgaagcatgcctacaagatctagaaaatggctcaaaagggcaaatctaagagttattggccttaaggaggaggcagagagagatcagagtagaaagtttattcaaagggataagaataactttctcaacctagagaaagctatcaatatccaagtacaagaaggttatagaacagtatgcagatgtaagccaaataagactacctcaggacatttaataataaaacatctaaaagccaaggataacaaaggatcctaaaaccaacaagaccaaggaaacaaataacatacaaaggagcttcaataagtctggcagcagacttctcggtgcaaactttataggccaggagagaatggtatgacatatttagagtgctgaaggaaaaaaaaaattatcctaggatagtgtatccacggaaaatgtctttcaaatataaaggagagatgcttcctcagacaaacaaaagctgagggatttcatcaacactagatctgtcttacaagaaatgctaaagggagttcttcagtctgaaagaaaagaatgttaatgagcaataagaaatcatctgaagttacaaaactcactggtgctagtaagtccacaggaaaacagaatatttgtgtcaaaaaacaacatatgagtgtaaactattcatatgttgagtagaaagaccacaagataaacctacaaaaataataactacaacaactcttcaagacatagtataataagatataaatagaaagaacaaaaagttaaaaagaaaagggatgaagttaaatagtagagtttttattggttttctttttgcttgttagtttttttttaaaggcaattagtgttaagttgtcatcagtttaaaaataatgatttataagatattatttgcatgccttatggtagcctcaaatcaaaaaaactacaacagatgcaaaacaaataaaaaacaaggaattaaaaaataccaccagagaaaatcacctttactaacagcaagatgcaagaaaagggaaaaaggaaaagaagacaacaaaacaaccagaaaacaaacaaaacaacaggagttagtccttacttaccaataataacattgtaaatggactaaactctccaatcaaaagacatagagtggctgaatggataaagaaaaaaaagacccaacaatctgttgcctacaaagaacacatgtcacctataaagacacatatagaccaaaaataaagggatggaaaaagatatctatgcaaatggaaaccaaaaagagcaggagtagctatacttatattagacaaaatagattttgagacaaaaactgtaaaaaggacaaagaaggtcattatgtagtgataaaggagtaaatttagcaagaggatataacaatagtaaatatatacgcacccaacactggagcacccagatatataaagcaaatattattagagctaaagagagagatcaacctcaatataataatagctgcagacttcaacaccccacttttagcactggaaagatcatccagacaaaagcgagaaagaaacatcagagttaatctttactatagaacaatgtatctaattgatatttctagaacatttcgtccaatggctacagaatacacattttcttctcagcacatggattattatcaaagatagactgtatgttaggctacaacaaaacaaggcttaaaaaattcaaattattgatatcatatcaagcatcttctctgaccacaatggaataaaactgtaaatcaacaacaggaggaattttggaaactatacaaacacatggaaattaaataatatgctcttgaatgatcagtgggtcaatgaagatattaagacggaaattaaaaaatttcttgacacaaatgtaaatggaaacataacatatcagaacctatgggatacagtgaaagcagtactaagaggaaagtttatagcaataagtgtctatttcaaataagtagaaaaacttcaaaaaagcaacctaacaatgcacttaaagaactagaaaagcaagagcaaaccaaactcaaaattagaagaagaaataataaagatcagagcagaaataaatgaaattgaaatgaataaaatacaaaagattaatgaaacaaaaagtaggtttttgaaaagataaaattgacaaacccttagcccaactaagaaaaacagggaacgcccaaataaatcagagatgaaaatggagactttacaattgataccacagaatttcaaaggatcattagaggctactatgagcaactacatgcccattaattggaaaacctagaagaaatggttaaattcctagacacatataaactaccaagattgaaccattaagaaattaaaacccggctgggcgtggtggctcaagcctgtaatcccagcacttttggaggctgaggcgggcggatcctgaggtcaggagattgagaccatcctggctaacagtgaaaccccgtctctactaaaaatacaaaaaaaaaaaaaaaaaaaaattagccgggcgtggtggcaggcccctgtagtcccagctactcgggaggctgaggcaggagaatggcgtgaacccgggaggcggagcttgcagtgagccgagattgcaccactgcactccagcctgggcgacagagtgagactccgtctcaaaaaaaaaaaaagaaattaaaacccaaacagaccaatgacatgtaatgagagcaaagccataatgtaaagtttcccagtaaggaaaagcccggcacccaatggcttcactgctgaattttatcaaacatttaaagagaaactaacaccaatcttaatcgagctgttctgaaaaacagggaagaaatacttccaaactcatttttctgaggctaatattaccctgataccaaaaccaaaaaaaagacacgtcaaaaaaagaaaaggacaggccaatatctctgatcaatattgatgcaaaaatcctcaacaaaatataagaatactgaattcaacaacacattaaaaagatcattcatcatgatccagtgggctttattccagggatgtgagaatggttcaacatacacaaatcaatgtgatacatcatatcaacagcatgaaggacaaaaatcatataatcatttcgactgatgttgaaaaagtattttataagatccaacattccttaatgataaaaaccctaaaaaaactgggcatagaaggtacatacctcaacacaataaaagtcatattcagcagacccacagctagtatcatactgaaaggggaaaacctgaaagcctttcctctgagatctggaacataacaaggatgcccactgtcatgtttgcactgttattcaacatagtactggaagtcctagctagagcaatcagatgggaggaagaaagggaatccaaaaaggacaggaaaaagtcaagttatctttgtttgcagctattatatttgaaaaaacctaaagactccaccaaaaaactattggaactgatgaacaaattcagtaaatttgcaggatactaaaatcaacatgcgaaaatcagtagcatttctctctctctgtttttttttgagacagtttctcactctgttgcccaggctggagttcactggcatgatcttggctcactgcaacctccacctccgcctcccaggctcaagtgatcctgtcacctcagcctcccaagtagctggggcaacaaatgtgcaccatcacgcctggctaagtttatgttgtgtgtgtgtgtgtgtgtgtgtgtgcgcgcgcgcgtgtgtgtgttttgtagagacagggttttgtcaggacagatctttcaagttgtccaggccggtcttgaactcctgagctcaagtcatccgcctgcctcagtctcccaaagtgttgggtttacaggcatgagccactgtgcctgacccagtagcatttctacatactaatagtgaacactctgagaaagaaatcagggaagtaattccatttacaataactataaataaaatgcataggagtaaatttagacaaagaagtgaaagatctctataataaaaataataaaacattgatgtaagaaattgaagaggatataaaggaaatggaaagatactccatgttcatgcaccaaaagaatcagtactgttaaaatgttcatactacccagagcaatctatagattcaatgcaatctctatcaaaataccaatgatatttttcacataaatagaacaaacaatcataaaatttatatgaaaccacaaaagaccagaagagccgaagctatcctgagcaaagagaacaaaattggaggaaccacattacctgacttcaagttatactatagagctatagtaaccaaaatggcatggtactggcataaaaacagacacatagaccaagggaacagaatagagaacccagaaacaaatccagacgtctacagtgaactcattttcaaccaaagtgccaagaacttccattggggaaaggacaatctcttcaataaatggtgctggaaaaactggatatccttatgcagaagaatgaaactagggccccaaaaataaaattaaaatggattaaagacataaatctagacctgaaattatgaaactaccaaatgagaacattgggaaaatgctccaggatattggtctgggcaaagattttttgtgtaagacctcaaaagcataggcagcaaaagtaaaaatagacaaatgaaatcacagcaagcaaaaatacttctgcactgcaaagaaaacaatcaaccaagcaaagagacagcccatagagtgggagaaaatatttgcaaactatccatttgataggagattgataaacagcatatataagaagctcaaacaactctataggaaaaaaaaatctaataacctgctttaaaaatgggcaaaagatctggatagacatttctcaaaaaaagacatacaaatggcaaacaggtatatgaaaaggtgctcaatatcattgatcattggagaaatgcaaaacaaaactacaatgagatatcatctcaccccagttaaagtggcttttttccccgttaaaagacaggcaataacaaatgctggcagggatgtggagaaaagggaaccctcgtacactgttggtgggaatgtaaattagtacaaccactatagagaacagtttggagattcctcaaacaactaaaaatagagctaacataggatccaccaatcctattactaggcatataaatatatgcacccactatgcacataccccataaatatgtgtgcctattatttacccataaaaataaaaaaataaatgctgtgtgttatagtgaaagacagtaggagaattcccagggtcagatctgattgcttttgacatgcaaataaatctccagaacatgaatagaaacctagcctctgtaccagaatctgactgtaagacttgtactttcaattgtcctcttacatcttggaacatttaattacctgctatcctgaaatttgtagaattcccatacctgattatctcttgctttgagaagcttgactcagcatcagtgtaatttgacatcttgttctcctaattcatcgtggctgaaaagatttttctcttgttctgtcttcattgagttttcatagattcattccactctcatggcttaatgactttgggttgtctgttggccttgtgaatctaattcctgttagcaatgtttctctctcttgaactcagtttcttctggcatttcctcctaatgagaacactgaagtaataaattctctcaataaaattctctatacagtcacagtctgagtaagtggagccagacgacttattcaggtgagccaggtaggagcataccttctggcccagacacttgtaaatgagacagttctgccttgcagaacttgttttaagaattaatattaatttttacaagatgtctggtatgtaacaggtacccaataaatggaagatatcagtattattattaacattaggtacagggctatctctttgaaaagcaattacattaatgtaccaaaatgaaatattaatatgataaaagctatcccgtgtgtgtacgggggagctaggagaggggtacaattcagtgaagtctaagtgccttatcttttgtgatcttgcttgacccagggctatattaattctttgccaaaataggcaccttgttcttcagacaatcagccataagtattattttcctcagtgtaccttctgattaatatttagtgtgagactaatggctattagggggatgcattgagtattgactcatgttaaaatcaatactcagaacagagggaggttgaagctgagatacaacttacatcggggaaagcatggctaagccattagcaatttccacctaaacttaaaagaatgagacctttttcctgacttcctataggttatgtgaacaatttttagaattccattttgactttatctacagcatttttgagtgtatgtctttgtttagattttctagtggttgctctagatactacattctatctatctatttatctatctaatcttaacagtttactggcactgatattttaccagtttgagtgaagagtagaaaatttacctccctttaagtctctttaccttctcctttttaagatagagttgtcttaaatatttcctgtctgtatcttgagcaccacgtcatataatactataatttttgctttagctatcaaacataatttggaaaactcaaagaagaaggcaaatatattgtacttccctatatgcttactctcgctgctgtcttttcttcctgatgttccaaaattccttttttagcatttgcattctgtttcaagaattttctgtagccattcttttcgagtgtagatgctgacaacaaattctcttaagtttcattaactggaggattccttgagtctccagatgcaggatgctaccaggttcatagttttttctttcaacattagaaaaatgttgtccctgctcctgtcctccagggtttctgatgagaaatctgctgtcttttcaattatttttccctatatgttatacattgtttttctccctgctttttaagtctttgtctttagttttcagaaattttattatcatatcttaaatttctgtaggtttctctatctggattgtgtggatttctatcttttgtcaaactgggaatctgtcagtcaaattattcttttcaaatactttttcagtcccaacatctctttctgttccttcacagatgccaatgacatgaatgctaaaacttttgttataatcccacaagcccctgaggtgtgttcattttatttttcatcatattctctattgtttagatttagtgattttttttcttctacttcaagtttgccaattctttcatctgttttcttcatttctctattgagttattattatttttttaatttcagttgtactttcccacttcaaaatttccatttgctgagactttgtaattgttaaatttgctttaagcatgtctgtaattgctcattgaggcacgtttatgatggttgctttaacatccttgccaggtaattccaacatctgtgtcatccccgtgttgacatctgttgattggcttttctcgttcaagttgagattttcatggttccttggtatgatgaatgttttttgtttttgaatatattctggacattaactctgagagtggtgaaagtccttgcttctcagttggtcttcttgacaccatcaccagtgggaggtggtgcctcattatccccaggtggtggtggatgtcctggctttccacttggcctttgctgacaaaagtggtagtaaagccataacttttccaacaacgtttggttggagtagtgtggttattgtccaaaagtttttttgtctttctgggctgtgctctcttgtttctttggttagaaagagcgtgactttattggagcttattttgtctgtgcccattggaagtttcaggttgccagcttcttctgtctcgattttagaatatttgaggcaaacaacaacaacaaaaccaaaaccaaacccagggaactcaccactgtgttatttctccagtcccaaggtctctggtttgccttcttctctatctctaagagtcttcttatgtttgttttatttataatacccatgatttttagctgtccttagtgagaagaatagaaataagtatatctactccatcttgtctaaaactctaaaagtttttctctgagatttttatccttgcaaagacggaaacaactcagttgaagactaaagtttagaattatggagaaataacacaaagaactttaataatattactccaagctgttgaatgccaactgtgtgccagaaatgtacaatcagttatttctaatccttacaataatattataaagcagttattacaattccaattgtatagatgaggtaaataagttcatagagatttgtaatttgtccatgatttcttaacgactacatgttgaaaccaggaatcaaacttctatctgattctaaagactgagcttttattcataagttaaaatataaagatgagtgggtgtaaccacccagcaggttcacctagcccactgcctagacagagccaatttatcaagacaggggaattgcaatagagagtttaattcacacacagctggctggacgggagaccagagttttattgttgctcaaaccattctcccccaaaactcagggattggggtttttaaggataatttggtggatagggggtgagaacatggggagtgctgtttggtcaggtcagaaatgaaatcacagggagtcaaaactgtcctcttctactgagtcagttcctgggtgaggatcataagatcagatgagccagtttatccgtgtgagtgttgcggttgattcacccagtgcaaggtctgcaaaatatctcaagcaccgatgttaggttttacaacagtgatgttatcccgaggagaaatctgggaggtttagaatctttcagcctccagccacatgactcctaaaccataatttcttatcttgtagctaatttgttagtcctggaaaggcagtctagtccccaggcaggaagggggtttatttcgggaaagggctgttaccatctttgtttcaaagtcaaactataaactaagttcctctcaaagttagttcggcctatgcccagaaatgaataaggacagcttggagattagaagcaagatggaattggttatgtcagatatcttttagtatcgtaattttctcagttataatttttgcaaaggcagtttcagggagaatggaggttgggcctgcagatgaaaaatgagagtggttattcccaagtttcaagctattatcatgatgagatgacaatacaaatattctaagatgccctcacttacagatagcatgtgctggactacatgtatgggctgtcagaaaatattcctattagtggtggttaaaatatttcctctttttatactggggttgttgcggtgaagagttcaaaatatatgaagattaggagggaattcaactcaatttattcaactcatgattctttgcagctcataatggtaatatcagataaatatttattgaatgaataattactacttatcaaacactcgttaggttctaagtttggggttttgctacattatccctcttccttaaaacaatctgtcaagtgggtgctattattaataatacaattatataattatttacataaagcaatggaggttttgaaacaaattaggtgatttatctaacataggttaaaaatggctgaactggaatttgaatctagcccctctctaacacctgggttcttggacacaacacaccctaccaacaagtgctgagagaaattagaggaagcctgactgcagagatgagataggcccaacagagagcagaaacattcctgtaaatgctgctatactgaagccaggaatcagagtatgttgttaattgacacctattggttagagccacctaggtagatacttcaaattcgcccttttagaatggttggtactttgtctttgtactaagatccagtgacatttgcccctaatttatcttcgtgtgttagttctgtctggaaagctccacagtcactgcatgacccttgaggagaggataccattatttatattattatttttctctggttccttttgttcttttaatccaaacctttgtcattgatgagtctgagtatttaggaacagcagagggaaaaaaagttaactttggtttgaacacttttaatgctgcaactccataaatagttaagtgccagtttgaaatagtgtcttttgtgttgctctgatgtcatactgtcaattatcattattttggactttatgataatatatatccagctagctgacattaaactttgattaatgtttagaatcaaatgcctttggaaaagtgagtctatgccaaaaaatggtgtaaataagatttcaagtgggaacatttacttatttaagacaacaaactaattaaaaacttgagtagttataaaaccaaatagcattaggttgcaatcactctgtccatacagtttatcttacatattaaaaacagaccatttttatccattcactaaagtgaagactaacagaaattggataagctagatccagttactgtctaaacttgaaggtaaactatacttatttttaactagttcattttgtattacttcctgaagtacaaatgagctattcactgagaatctagggaaaattccagatctgttagccaattcagcagtctgcacagtggttgactgatggtgttgattggtgtctgcgagattttgagagctctgaaagtatcaaacagaacaacacacacgaaaaagtagggtatggattggaagacctgggagtgtttctaacccaaaggactttctatatactttagcgtctaaaaaattcttggccttctataaagctgtccccagcagcagatgagggtggccttctgctaactagttaccttcccccggggtcctagttgtagttccagatcagagattggaaaactagttcagatgacctcctactcaacaatggatttgaatttagaaacttaggtgcaaatgaataatgatgtttattccaaaagagagtgtttttcctagttttgaagataagttgaagattataaaggatggaccttcgagtagtcatcatttactactgggtgaatgtttatcagtgttagggtctgaaatttttacttcccttttcaggcattagtctgaagcagccagtgtatttaaataagccaggtagcacttgattggcctctggtgattctatttaagtccatccatcctgggtcagatgatctagaggtaactgcagaaacagatctcctggtaattgttgctagctgcagaaatattttaactgctggttttctttaaattatgatttactccatggtaaaatggtaaagttggcactcttaattccaaattttgaatctaaaggttaagaaaaaatcagggtctcagatatagaagcttttggaatagggaaggatttaaaccaaaggtaactagctttaggtaatatagaaagacagttaaaaaaaataaccccaaaacaagaacgactcccaccacccaccactgttttatttcttggctcactctactttgtatgtgtgtgcacttgttcacatttaaaattactctcaaatgtattcaagtaataacttgattttaaaactagtcagggtgattttggcattttgttataagacagtgttatgtaaactcttattgggtaaggcttcagaaaagagtgtttttttcccttcttttaaatagtcagaactagcttatttgtggaaagaatgtagcttaatattcttaatttgcttttggattttctgcttgcgtgtctgtacattaagagttggtcatgcttctcaatttaagaaggaaaagtgttttcctaacttcagcaagatgttaggtaaatagccaacttcataagagagctttatgcactacttggatggaagcatcagtatcagattatcttttataaagttttataatttgtttcgtgctgtgacacatgtttaaaatactcaggattccttctggcttacatatcaaactacaacaaaaatccctttatttgactatactgaaaaaaactttctaaataacaaaatcttactagctcaataaaatactctatcatctgagagaaagtggaaagggcatgttaatctagacaatatgaaaaatgtaggctggacctggtggctcacgcctgtaaccccaagcactttatgaggctgaaatgggcagattgcttgatcataagagtttgagactagctgaggcagtatggtgaaacctcatctctaccaaacaaaaacaacaacaacaaaacaaaaaacaaaaattaacaggatgtgatggcatgggcctgtagtcccagctacgccggaggcggaggtgggaggatcttttgaggcccggagggggcggttgcagtgatctgtgatcctgccactgcattccagcctgggagatagagtgagaccccatctcaaaagaaaagaaaagaaaagaaaagaaagacgcaaatctaaagatgtccctgagggaggctcaggtcactacctaaggagaagtcaaagaagaataaagaaaaatgaaaaagtctgctacgttaaaagttctgaaacattttcctgtaaatgtctatttttttaaaatggcaatattaagcttcagaaacattggtttaacatctatatttattcttccagccaatcgatgcagactacttcagatgtgtatatctattacttttttgtctttattgatttctggaactccctctcaatatttatttctttttgttgaaaatttgtgttttgtcacattaagaaatcttaagatatctgctatccacccgtttcaaattaattaattttttttctcctggttcataatcctcacaaaaatactcaaagttaacctggccctatttcaaactctggccagaagtgtctgggttatttttaacttaagtatcctttggaagaaaattttataaacaaaccaaaagtagcctttgataatagaatgtgcatgaatttgggatgcaggtagaattggttaaattatttagactgagctttagctttcttatctataaattggagggaaatatactaatttcataatgttacaaggatcagatatttaaaaagtgcacattccactaaagctctttgcacatgagtgcacaataaaggaccactatttttaaatcataagaattttacaatttagtcctgaaaaagaacagaatgcttacaaatagagttgtttttgttcattttctaggcacatgctagcttgactgaattattctccttacctagtttatgataagtcctggttatctatatatctgaaaaaacctttattttgtttgttacctttgcactgcctaatttgagaagtggctttgaaaaatatgtgatagtccattctctttcaaagtatagaagcctagcatgctttcaatagttctgaatgaattgttgtgtttaggcaatggttatttgactcttcaaaattaagtgcatcctcaaattgttttgtcatatggctgtgccgttagaggtagtcatctttcaggttgacttaaaagtttgtctctcactgtctctcttactctccatcagattgtgttttctcaatagcttgcaacaatatccttcatttcacatgctcctctttcaatgtgacgttgacactccttccatttgaaatgtgggtttcttgtgtcctccttataaatctggtggtactgtgtgacactatgtgacttccaacacaaggtcataaaagcaataagacttctgcctggctctcttgggatgtctgctcttggaacccagctgccatgctgtgagaaccgaaactagtccacattgggagaccacatggagaatacacaggtatgttttctggctgacagaccagctgaggtccctgctgacagccagcatcaactgccagacatgttagtgaagactgctggagatgattctaatcctcagccgttgagtcacaccgtcctctccttgccttcaagtcttcccagctgaggcctctgacatcaggagctgtgctctgtgtgaaatactgacccacaaaaatcagtgaacattaaaaaatcgctcttttaagatacagaactgtgtttagagatggtttgttacttagctgtagatctggaacactttcttttccttttctctgttcctccttccacgggcatgtcaatggaacttaattctgcattactgagatgcatattttgaatagacgtgcagtgatcaaaatggcttgccttttctcagagcatgctatgtgctaggcaccattcgttgtgaacactgtatatatatatttaaatcttccaataatacgacaagagtactactattacctgtattattttccctacctacaaatgaacaaactgagtcatgaagaatttgtataacttgtcaatgtcaaatatctattaagctttggctccaaaaccctcacttgaacattgtaaggtatagaggtaagtgaaaataatattaaaattccaggcagggagagttcagtttactttttaggtgtatagattgaaaatgttaaattccaaatatactaaaaactttatttatttatttattttgagatagggtctcactctgtcacccaggctggagtgcagtggcacgatctcaggtcattgcaacctccacccgccccgggctcaagtgagccttccacctcagcctcccaagtagctgggactacaggtatgtggcaccatgcccagctgttttttaaaagaaacattctgtagacacggggttctgccatgttgccctgcctggtctccaacaccttggttcaagtgatccacccctgtggcctcccaaagtgttagagttacagttgtatcccttttttttagtagcttaacagtttagtaacttaatccacagtttctgggatccaggaaactgtgaattagtaaatctaagcttagaaatcaagattagctttcagttctgtcttttacaattatatttcttctatcctcagatgcacatttttttcaacattttgccaactctgaaatgagaatgccttttacaattggtcatgtttcatcatcgaatttaagtcatttttggtgttatatataaaataatgatccttcttacaatagatgctgtcttattttggtaaaatgcatatattatacatttttaacctatctgacatatactattgttgcaacaatggcatgcatagataaggacaggacaaataattcaagaaccctcctaagtcattgctgcaatgttaaactgaatagtgaaagagtgtcagagatctagcaggctctaaaataaggccagtgttagcatccattgttacctcgaaagtatatgtatgaaagcccatttccctcgggtaattgtcttcacatacagacacttgggaatcaatatttaacaaagtcactgctagaattaggtttcacagggatacagcccaaacccagcccaatttacttggggaactgctggtgttgccaattagtctattcttccgtacataaaggcagctcctgcatcaaagttctctggtacctcattttattctgacatttttcttgtaatattttttcctaaattgattatcttatatttagctttttccaaaatatcagagtaccttgcaagctttcgtatcaacttacagtttttttcatcattggtagtggtgaaagtgctaaacattgctgattcttgttttcatccaccgtatccaattttcagagttcagtcatgttcctacaggtttaacttagtgattttcatgtgtttagtgattttcatgtgctggatcgggccagttcaaggtcctgatattcattaaaagaatgatcacattgtaataagagttgggattcttttaggtagtgcttataaaaggaaagcattgtagtgaccaaccaggtagtaaatggttgatctactggggccattgtagccataatccctgactcaatagctccacatcttttggtttacattctttcttttagtcaggctgttgctcttacaactgactttctggtccgctgaggaagaaaggtttcaagagattggttctatactcctctgagaatttccttttgtttcgaagggaaaaacagcaagtaactgtttttagattaaatgaagcatctatttcagttcgtaatgtataaattgtagtaattaaaggtagaatgactttttaagtaattatattgcatgcgatacaatcccaaagagatgtagtgctttctaagactacctggttagatggttggtgtgtacaactgccagggtttactaaagccaaagaggcagtgttctgagtttagatgagagaacaaaaggaactagtcgtttgaagagctgcctgggaaaaagtgtttcaggcaggagcagcaagtgcaaataatctgaggtaggaaagagattctcagcgtgatagaacaaagtaagcagccggtgtccctgacatcccaagtaagcaagagagagattgatactcaactgatggagagaagagcagggaaacagaaatggatcataagcatttgacctgctaggaatcattgatattgttagttgcctccttaacctccgttttcctctatttgatgttccctactttttgagttttaccttcctttatgcattggtcatgtacttcaagaggaagctgactgctctccatttccatgattgggtcctggttggcttgggcctatcagcgtatttcaactccatggtcaagacattgtttccagggaaaactagaggaccctttctccttccttttggacatgaaaacaacttgttgtcctgattgcattttgtagacatcttatgagctgtcattgggagaaattcaacattgtggatggtagaagaaagtagaaaacgggactttgatgacaattttgagctctggatttttaaaatataagttaataaatgtccttcattgtttaagccaacttgatttggatttccttgttttggcctgtagagtcacagtccattgaaaagtaatggttttatgccagggaatggcattgcccttgtgccatttttaaaaagtttattctagtttaaataataaaggtatctattgactcacaaagggaaaaaccagagcatggagaaagggtaagatgtcattgtagtaatgtatgtaagggagtagtgattaaacctaggctagtgacattgcaaatagagaaaaacacatatagaaaaaaatatattttggcactagcaccaacaggacttgttaaagggttgtttttaggaaacgaggaatacaaataatcatggatgacctccccaaaactgtaggaaggttttggtttaaaaaattaagatgatgccatttactgaaatgggagtagctggtttgggcatgggtggaaaacaaggatttcagttcccgatatgttaaagtgtaaaagaactgtttttctttgatgaggatatgccaattatatagttttatatatgagtgtgtgactcagtggagaaatcaaggctgaagatatggtttgcgagacatcaacatgtaattgggttttaaataaatgaaatgagatgaagtaatccatggagagattgtagataaagagttaaggagagcctgggatagagctcatgcacttcaaagtttggaggttgactagaagagcttgggacgagattagggaaaattggccagaaaggcagttgggaaatggaggatggagagttacagtaacaaaaagaggaattgtttcaagaggggtattaacactgtggaatcctgatgagagtttgagtagggagtgaaagatatgtatataatcaaagaataatttaatcatgttttatatttaagacagatatgttctaatatctatgctttgaagataatatttcatgaatgatgaatcataattaagcagaatgtcatttatatgtccatatatttcagagaaaaataaataaataaataaataaataaataaataaataaagtaagcagaacattttaccaaagtaatgattctaattcaactaactctcaggcactataaggctctatccaataaaaagaattgaaaatattcccatatttacttgcagttctcaaagaacattaatggagatctatgccatagttcatagcctcatttctcttaagtgtctttccttttctcctttaattctctcaaatttgtagaagagagaggggagaggggaacaatgaatgtgtgtgtatacacgtgtgtgtctgtttgtccctaatatttttcccacatctcttgcagatacccatctcttttgtttctcttttattccaccttcccccatgtcttaccacactgccatctccccgtggttgctgagatttttggtcctagtgccagccattggagaccattctcggaggattaaaagacccaattatttctctggactttcctcctggagggaaatgcaagaagttccttggaaagtgtgtattcttctttcactctgattgatgtttccttgtagagaaactcagaggaatcaaattatctttcttcttaaatctaatttgctagctctgttggatgagagagtttagggttcaaatggcttctctttttgggggaatattcattttaaataaattttcctactcattaattccaaaagtcaaaatgccaaattttagaggacttaaaacattcactgaatttgtgaaatagtttttcattccagtgattgaatcttgcttttcttttgttgctgctttggagaaggttaatgtgcttcccataatgtcatcactctgttgaaatccatctgtcccatagctcggcagtggtgcagccctttcaagttctgcagggaaacaagatcaaataaaaatatccagctcttcgacaagtatatgaaaaacaaaaagaaaaagcccataaagaagagacagagcagatacccttgccctaaaggtgtaatgtgaaactaatgttttgttaaacctgttgagcattactcagatttcttcatgagtacattcacacctgggggaaaaaaatgacccctgtcatactatggaaagaaacaacagaaattactagaggaaggaaagtagataggctccattttctggttccagttggaaatttaacttgaatctttttgttagagctaaaatatgcttatactgtacatttttaagagttctctcaatgggagaaacatagcagttcctgaatataactcactatgcttgtgccttccaaacattttctttcatttttcagggcaggtttgaagcagaagaaaaaggaaagataggagtcgcggcttattcactcacttcctataatgttcaaatgctgaggtgtcctaaaacttctgatattctttggaagctaagctgaagaatttttttttatttattctggtccagtgcaaatatttgtccattgagcaatatacggcacattagaatcataaatccaccatctgcttaaaatgagccaacacccacctgtaaggagacggttacaggctggtattgtgttcctctagtgcttaagtgaaggccactgacgctgtggggccctgctttgtttgagctgccctgtgctaagattgcctgataaaattccaaaagggtgtgtacgtttgctgcaacccacaaagattactttcaggttcccttggagaaatcttttcacagtaatgggggcagaaagaggccaaaatgccatcagctttggatatgtgggtgcatttgtggattctctgctctgatgttctagtgcaaggaatgaaatgaatgaataggtcatttggcattccgcggttatgtcagcaggcatgactgctgtcacattaactgagcaagaaagggatcttcatcaccttactcctagcaagtactgaaagcagggtagaaaaaaagacactctgctcatagtagtttatcttttactttttattgatttatttaatttattttttgagatggaccctcactttgtctcccaggctggagtgcagtggcgtgatctcggctcactgcaacctctgctcccccggtctcaagccatcctcatgctagtttatcttttaaatgaccgtaagtccccattttaaactgacagacattcgactgatactataccttagaattctccctgaaatatttgttcttgccactcaacaggaagcttatagaatctggaaaatgaatttgtagtgggggcttgttctctgaagtagctattatcgcttttaaaagaagccctcctggctgggcatggtggctcatgcctgtaatcctagcactttgggaggcaggggcgggaggatgacttgagcccaggagtttgagaccagcctgggcaacatagcgagaccctgtctttacaaaaatataaaaaattgtctaggcatcgggctatgcacctgtggtcccagctactagggaggctgaggtgggaggatggcttgagcctgagaggtcgaggctgcagtgaactgtgattgtgccactgcactacagtctgggtgacagtgagaccttgtctctaaaaaaaaaaaaaaaaaaaaaggctctttagaggacaaaagtttcagattcaccataacacatcaagcgttcccctgaagggcttgcctctgagtttattctttgggaaaaccctaatacaaaatgaaggcaagaaatccactagttatcgtattttagattttgaaagttggttgtctaagactcctgggtgatttagacaaatttctacatgttatttgccgaatctaggtatgaaagcaaatcaagcaaaacctgttcgtttgaggtatagtgctttagtctgcaattttttattattttagattcagggggtacatgtgcagatttgctacatgggtaacgttgcatgatgcagaggtttgggcttttaatgatcccatcattcaagtagcaaacgtagtaccccatagacagtttttcaatccttgcctctcttaccttttggagtcctcagcatctattgttcccatctttaaatccatgtgtacccaatatttagctcccacttataagtgagaacacgcaatatttggttttctgtttctgtataaatttgctcaggatgacagactctagttgcatctatgttgctacaaaggacatgatttgttcttttttatggttgtgtagtattctatggtgtgtatgtaccacattttctttactcaatccactgttaatgagcacctggattgattccatgtctttgctattgtgaatagtgctgtgatgaacatatgagtgcagatgtctttttggtagtagatttattctcctatgggtatatacccagtaataggatttgctgggtcacaaggtaattccatttttagttctttaagaaatctccaaactgctttccacagtagctgaagtcatttgcgttcccaccaacagtgtataaactgtcccttttttccaaagcttcagccacatctgttattttttgactttttaaaaatagccattctgactggtgtgagatggtatctcattgtggttatgacttgcatctctcttatgattcgtgatattgaatattttttcatatttttgctggccgcttgtatgtcttcttttgagaagtgtttgttctgttcatgtcctttgcccactttgtaatggagttttttttttttctttctggtgtgatggttaattctgcaaaaggcattttatttaacaggcagcatggacttcatacacatacattatcagtgccttgaaaaccaaagaattttaaaagttagcagtagcttctagtttctgcatgtacaaaaaaatacatatttatttatttatttatttatttatttgagacagagtcttgctctgcagcccgggctggaatgcagcggtgtgatctcggctcacagcaaaccccgcctcccgggttcaagcgattctcgttcctcagcctcctgagtagctgggactacaggtcactgtaggccctgagtctgggctggccacatcctccacaggccaagagctggtctgtgaagaagggtgcttgttggttgaaaagggtggtagagtcctttggttctggtgttagcagtgcagtgtctcgaaggtggctcattttaattccatatagatcttcatgccccgtgagtaggcatgaagcctcttctttgccagaattgacccataacttgtaacctctctcagggccagctatccttagcattggtaatgatatgttgatatcttcattttctgtatgtgaatccattactgttatagttttagaataggcataattctcaatgtccttggtggagattttgagggaaatgccctttgggtcgtccttctctttctctagattgatgtatctctgaaggagagagagctatttgtccttctgatctggagaactgaaagtggccacaaagttcactgtgagtcagcccagagccaaggatttcatggaattggtgttgccttctgccacttcatccagacagcttgctgtccatataccagttaatctaattttattttgtatcttacagttatgttgtatttgagtttggccacacctaacagatcattgaataggaaaagctgctcctcctgtctgtgcaggcctcttccgagttctacctggctgtcaatccgcagagtcctattggagcacacaaatgatgacagaattgcacatgtgtgatgctagtggaaggactttccctgggttaaagtttttgcaggactttatctgggctaaaagctgtggcacttctcctttctgttagtgttttcttcttccagggctaagcgcacagtcaggcattgctggccctgacgacttcggagctgatcctgctgaagggccgcactcacctaggccactgcgggggatccaggggcacgctgaggggtcggggaacggggatccctcccctccagcctggtgcccccactgagggaggagtcggggtgctgatgaggcgggaggcagctggagatgggagggaggctgccgggtctgctcagagagagaataaggccctagatatggagaacgaggaagcggcgtggggggctggggggtttcgggggaggtggcagcagggctggccctgaggggcgggaaaggtcctcagatgacccttgcgggcgcgcacctccaacgtcaaatcccagtggcttcagcctcgcgccctgagtggggtctgcggctgcggagggcacgggctccactcaagcgtcctcaccggcttccgcggctctccccacagagcctcctgctggggcacatcttaaagcaaatcccagccccgaaggaacctaggcggtcgggtctgtggtggcagaaggcgcggctgccgtgctcaggtgggcacagctccccatgtgggcagctgcctcctgcaggggcctgtgtgtcgccgtgccctgcatggcggggtagaagcggttacagcggcgaccgccctttgtttttttcttgttgatttgcttaagttccttgtagatcgtgtatctcagtcctttgttggacacatagtgcacaaatattttctcccattctgtaggttgttttcaaatctgttgataatttcttttgttttgcagagatctttaagtctcatttttaattttatcgtatttgcttttggggtctttatcataaattcttacgatttttttttttttttttttttgctagcagagttctgtcattaggattagtaagattcttaagtgttccatacaggtaataaaatcagaagagtatgacctcaatatggtacaatatccaggttttggtagatagaagtgattttagagcgtactagtccgttttcacactgctataaagaactacctgagactgggtaatttatgaagaaaagaagtttaattgactcacagttccacaggcttatcaggaagcatgactgggaggcctcaggaaactgacaatcatgccagaaggcaaaggggaagcaggcacctttttttcacatggtggcacagtgagtgaaaggggaagtggcacacacttttaaaccatcagatctggtgagagctcactatctggagaacagcatgggggaaatctgagcccccataatccaataacctcctacaaggctcctccttcaacaagtggggattacaattccacatgagatttgggtgggacacagagccaaactgtatcatagaggtacttgaacgcctcacatactctctttcatcacttactgttggggcctggaacttctgaagttttgatttcctcagctttccactgttaaatatggaaatacaggtgggaatactgttaattgcaaataccttacagaagatatttgctactttaatcatgaatgatttctaaggggaatctagacaaagggcagataaggttttgaaagatattggggcggtggggggtggtgggcaggaggcttgaggaaaagcaaaagagactgaggagagcaaaagatcccaaagtaagagtttacctagagcaagtgtggaggggagggagttgagtagtgagtgatgttaagagggcaaggaatgactagggaagaggtctgaaagaaagttaagagtgccaccaaagatcacctgtcttcttaaaaatttttttatgggtaacattgcatagcattatagagtaagaacactggggcatttagatcagggatttttaaatgagggtgcatgtgtacgtgatattaaaacaatactaccttgtccctcccctcctggcccccaagtctctcagtttgaacatcacagctacactgatccaccaaaaactgacagaaccttgccctttggtttgttgggcagcagagtggaaactcggggctggggaaagaaggattgcctacgattttgctataaaacataattaaaatcgatgttaactgcctttctttaataaaggatatactctaagggttttcagtcattgtgagagataggactagctggatttcctaggccgactaagaattcctaaacctagctggggaaggtgactgcacccacctttaatcacagggcttgtaactcagctcacatctgaccaatcaggtagtaaaaagaaagctcattaaaataccaattaggctaaaagcaggaggtaaagaaataatcaaatcatctatcacctgagagcacagggggagggacagtgatcaggatataaacccagacattcgatcagggagtggcaaccccctttgggtcccctcccattgtatgggagctctgttttcactctattaaatcttgcaactgcacactcttctggtcagtgtttgttccggctcgaactgagctttcactcagagtccaccactgttgaacgccgctgccccagacctgccattgactttcacctctccagatccagcagggtgtccgctgcgcttctgctccagcaaggcacccattgccacttctgatccggctagaggttcgccattgtcctgagtagctaagtgcctgggttcgtcctaattgagctgaacactggtcactgggttccatggttctcttccgtgacccatggcttctaatagagctataacactcactgcaggggccaaggttctattccttggaatccatgaggccaagaaccccagatcaaagaacaaaaggcttgccgccatcttgggagcagcccaccccatcttgggagctctaagaacaaagacccgttggtaacaattgtacagtgtcaattttgattgtcttctagttttcacagtatgtaaaataaagcagaatagtattaactcaggagccagacttgctgggtttgagccctggctccactcattagctgtgcaacctttttaccaagttattgaaaatcttcagtccatagctaactccttagtaaagtgagtataacaatatttcacattgatagtaagatattaatcagataatccatgcaaagacctcagcacagtgactggacaatagaaaaggttcaatatatgttggctttaataaaaacaaaaataccaaatatagtaattagctctttgttttttgagatggagttttgctctgttgcccaggctggagtgcagtatggtgatctcagcactctgcaagctctgcctctcgttcaaacgattctcatgcctcagcctcccaagtagctgggactacaggtgcatgccaccacgactggctaatttttttttgtatttttagtagagatggggttttgccatgttggccaggctagtctcaaactcctgacgtcaagtaatccacccgcctcagcctcccaaagtggtgggattacaggcgtgggccaccacggctgatggtaatgagctctttctctgagaatgactgttgcttttggattaaaactacagcattgactttaggtatttcttagacttgattaacttaataaaactctttggtacagaaataatacttaatagggcagaagtttgtttggaggatagaacaaaaacctgacaaacttattgtgagaaatgattcttccattctagcatagctccttttgaagtgtgtgataggaagttttggtgtttccccacccatcatggaaatcatgtaaattggagaggcaaggaaaaagcatctgtattggtttgctagagctgtcataaaaagcaccacacattgagtggcttaaacagtcaatttattgtctcacagatctggagggtagagatctgagatcaaggtgttggcagggttggttccttccgagggctgtgaaggagaatcttttccgtgcctgtcatccagtgtgtttgctgacaaccttgagcattccttggcttctgctgcacgatcacactctgcttcctgctcacatggcattccttctgtatgcatgtctctgtatccaaatttcttctttatataaggaacccagtcatattgggttaggggcccattctactccagtatgacctcatctaataacattttcctttagaaaatttaattgacacataataatcatacatgtctatggggtacataatgttatgacacatataatgtatagtgattagatcagggtaattcacatatcgatcatcccaaacatttatcattccttgtattgggaacgttcaatatcttctagctatttgaaactgtatattgttggttactatagtcatcctacagtactataggacactaaaacttattcccatttttaatgaccttatttccaaataggaaatacctccattctgagatactgagggataggacttcaacctataatttttttttgtgaaagggacacaattcaacctgttactgtatcctatcctggaaagtaactatgatatacttctagaagtttcagtaatcactaaacttctagaattcattccagaaaagtgaattcattccagaaaagatgttcagaaactgaatcactgctaataccaggggagccaagtgtttaatggcctcctattgtgggtgctctccacaattctgtcgccctcctaacactcacacaacttattttgtcagattgtgtgtgggcatgggtgtgtgaaagagaagggggctggggacagggactttctgctcccaaggactttccatttagcgaaaaaggcagatgttgcgcaaaaaacaaattttaaaagaagaaaagaatgcttatctttctttactcagtaaggaggttcatgaatatacatattgcatataattgctttttaagaagtactacttgtaaactcaagtaatctatatgtgtgtatgaaatcaatgggtttaaaaagtacgcttccctgaggcttggcctactcttattaactctaatctaaaagtctgaaagatcctaccaagaaaactttgtatacttatgtattgtaagattataccaatgaacaataatttcttcatcccctataatatacctgattttctattttatcatgttgttttccatgatggtaaaatacattctcctttcattcaggattcatgggtactgcatcttgtgtaaagcctgatggttctactagaaggttgagctgtttctctactgatttcacattattttattaggttatttagtaaggagttatttcccaccagtgatatatcgtaccactagactgtgaatttcttttatccagtctatctttggatccacaatatcaaagttagtatctggcagagtgaaaattaatcattgaataattgggaaagattaaatgctagaaaataatttaggttttattttgatctcagaaattgagagcttgatctgaatagaaatgttgctattttaggaaaacaaatgggaaggaggacaaggaagaggtgaaggatctagtgcagtaattctaaactagtattgacaatattagcaaataaaaatacaggtcacccagtttactttaaaatatcacataaataaccaatacattttagtgtgtttcaaatattaaacaggatatgcttatattttgaaaatgttgtttatcccttatttaaatttaactggatgtcctgtactttatgtggcaacgctggactttatctaattaatcccttttgaatgtacaacttttttgactgttatctctttgaaatgcaaatgaaaactctgaaagcctgcattaaaatgctttgcacatagaattgtgcatactatttcaggtagttgatgttggtaacttttttaaaatgttggctgtgttagggaaggaataatttcttagaggttataagggtaaaaacaaatggaagtaaaattatacacatacacacacacatacacacacacacacctatatgtatacacacacacacacacacacattcactaagcatagtcctacatttccaaagtaggggtaacctaagaaggaatggaatccaaacaattaattttatgagaagatgtgcggtagaaatatcaactacaatatagaaaggttttttttttttttttaaacacgttgtggtctcactatgttgcccaagccagagtacagtggctattcatagacttgatcatagctcattgcagccacaaacccttgggctaaagtaatcctcctgcctcagcttccccagtagcacatgccactgcacccagcgaggattatagagtttgttaaagtgggtagagaaggaaaactaaattggttacaagattacagtgactaaaactgattatggaatatttatatgtaaaatatgtgcatattaaatgttggcatacatataattatatgcataataaaattatatgtataacaacatagaaatatatgcatattaaaatataaaggtatatacattttcattacaaagaacaatttatcatttagtaacatttttatgctaactgaagaaagataagtgaatgttcaatgttatttattaattcttaaaaaaactaaattgtcagctgatctcttttatagtccactgcaaataactgctaacatgttgttcctctgaactatttatgcaaccatggaatcagctatatttctttagtcttcatatgttaaactattaaatcagagaatgccagtgcattctgatctcttagcattcattaaaataaaagctctagacttttatctaaaaaatcaaaataggctgtaatataaaaattaaaataggatatttaatattcttttgtaaataaataggatacatgggtctctagtactgataatcatgtaacctatttatatccaaatagatcaatttactacaagcttgcttaaaattaacagaatagtgatcaaataagacccaaaggaaacctttttttctctgactcatcaaatgttgaaattacaggtgtctatatcatagacattgcatatctatctcatataaaagtatagttttatatcacaaagcaattcaaattttgctaaatgcaataaaatcctatgagttaggaaaatttttgcccatctaaaacattttctttttttttttttgagatggagtttcactcttgttgcccaggctggagtgcaatggaacgatcttggctcactgaaacctccacctcccaggttcaagtgattctcctgcctcagcctcctgagtagctgggattacaggtgctcaccaccatgcctggctaattttcgtatttttaatagagatggggtttcaccatgttgaccaggggctagttagtctcgaactcctgacctcaggtgatcctcccatctcagcctcccaaagtgctgggattacaggtatgagccaccgcacccagcctctaaaatattttctaccttctgataattactcccagctgattttaggatttctattagcaggattttttcttcttgttgctgttatttaaataaatagaagacatggtattaactctctggaggcttcctgtaaagaactgagttgatgattggatatttgatcatttcagaataaatataatcctttcctaccagttaattggagaaattcttcatttttcctgaagtagttacacttttcttaaaattattaaaagttttaaagtatctacccaataattaagaagaacatgtagctggatgcagtggctcgggcctgtaatcccaacactttgggaggctgaggtggtagatcacctgaggtcaggagttcgagaccagcctggccaacatggtgaaaccctgtctctattaaaaatacaaaaattagccaggtgtggtggtacacacctgtaatcccagctacttgggaggctgaggcaggagaatcgcttgaacgggtagcagcggggacgtggaggttgcagtgagccaagagtgcgccactgcactccagcctgggcaacagagcaaaactttgtctcaaataaataaataaatgtagttgaatttttaaaatataattaggttttaaatgtctaagtgtaaagtaagaaaagaagtaagtggttagtgctgaaatatgtagctaaaagttaaagtcacaagtggacagagatttatccacttgttttggtaacatggagatcatttatgacctgggttagcaggtatggtacaggggaggagacagaattaaaattagattagttggtggttagaccaggaacagtggctcaggcctataatctcagcactctggcaggccaaggttggaggattgcttgagcccaggagtttgagaccagcctgggcaacatagtgagactgcatctcaaaaaaaaaaatttagaaaattaaaaataaaattagattagttgatggagtgaaggagaggtgaagaaatagagacaaactgtataggcacctcttatttaggtcttcttgtctccactataactcttggcaggctttctttgctactgatgaggcagaaataaaactatattgtcagtctcagatttaaaaaacatttattttaataagactattgcaaacacattaaaaaaactaaatagtaatattacaaaatctatatacttgcacatttagtatttgtcaatgtgccagaggttttcttcatgaaatttgacttctttgaagtgaaggcttttttccatcatctcttatagctctgactgaataagtcttaatgctttcttcatgttttctatcactgaaataagagttaatatatattatgctattaataaatgaaagtacaaatgctatgatctattaactctagaacctgaaattggcccatttaaattaatagctttgaacatgggaattcgtctatgacattaaagaatatgctaaaagtgtacatgtaaatttagggattagaccattgagagctggttggtcaactttatgttgaacaatttcatcagaggggttttgaggagtacctctttttttttaatgcatcactttgtattagtattgctagatcttacaggcacagttgtcttattaaatatagttgataatgaatgttgtaaaaaatagatttggccaggcatggtaggtcatgcttgtaatcccagcattttgggaggctgaggtgggaggatcacttgaggccaggagtttgagaccagcctgggcaacataccaagaccctgtctctacaaaaaagaaaaaaaaaggattaaagtcctaggtaagactgtacctccttgcttataggcattaaagaaagatgaaatgattttactatcatttgatgaaatcacatgagatctttgatactaggagaatggactgtctcaagtttgtgtcattttaatgtgtactatattctttttagtgagctcagaatttagtaatcctaaaatcccttagacatccctgttaaaatagattctgaggtacccccaaaattctgattttggtgggagctagaagttggcatttaaacaccaccactagcctcagtgactggtgtgtagaagcactgatgtagggcttcactagcccttaacaaatagtcaggggtcagctatgaccactgtttgagatcatttgtgaatacttacataggggtaaatcccgaggctcatatgtgtacaatctgttagagtatcttccagctatgtcagctctaactgttaaagaagggtctgtcaaggaaaaaaccaagtcacgaaagtataatttagcatgttcttttctttactcttgtaaaaacttaattattattttatatgtgggggttatgtgtacaagtttgttacacagatatattgtgtgatgctgaagtttgggcttcagctgaacccaacaccctaatagtgaacatagtagccaacagttagtttttcatcctttggctccctccctccttcccccgttttggagttcctattgtctatttttcctctctttatgtccatgtgtaaccagtgtttagctcatatttatatgtgtgaacattcactatttggttttctgtttctgtgttcatttgcttaggataatggcctctggctacatccataaaacgttcttaaaatcatttttgtttcttaatctaaaacaaatgtcaaaccaatttataatctaaaacaaatgtcaaaccaatttataagcaaaattagttttcatacatgtcagttcatgaattaacctgaattctccttttagtgtgtcataggtctctgtcaatctagtctggggcactgtgttgaaagtacattgggatatagatttaatagcatacatgctttgaaaaaatatttaaaattttcaaattacagatatagtggattttgattgtagaactaacaagagctgatattattggattagaaatgacttctctttaaaaagaatagtacttgaactagcatttaaaaataaaagcaagaatgctgatttctactaattttgtagatctgatgaaatgagatcacatacatacctacaaacatgattctaggcacatattgcccatcaggtgataaattcttatcagtggtttcatgctagcaggagaagaaaaaaaaagaatgttattggattcatttgtttttgatagtttcaagatgattttgtgtgactgtcagtaaattctattttggccttttataattccatacaactttctgtattaaccaatatttagctctttgtgctttaaaaatagaaaaaaaggaggctgggcatggtggctcatgcctgtaatcccagcactttgggaggctgaggcgggtggatcacctgaggtcaggagtttgagaccagcctaaccaacaaggtgaaaccctgtctctactaaaaatacaaaaattagctgggcatggtggcaggtgcctgtagtcccagctacttgggaggctgagacaggagaactgcttgaaccagggaggctgaggttgctgtgagcccagattacgccactgcactccagcctgggtgacagagcgagactctgtctaaaaaaaaaaaaaaaaaagaaaaaaacggattcaaaatttccatgaaattatagtattaagaaaacatcacaaagtttatgtaccataaggtttagcatgatgaacttattctgagccatttcttgtatttcttcattttgggcaaatactttctttagtgctataggggaaaacaaaattgccagttagttttaaggatcaagagacctttaatgtaacatagcaaaataaagctaatatttagcatttgtttgcatatataactcaggtgtaaatattaatagttcattggcctattgccactttgtccctcattggaaagcaatgagggacagtctgttcaaggagacatcaaaggataatcacagtgaagacactagtttttataattttatgtaactcattgactcattggttaagacaacgactttttttcagtgtttctacaccttctcagctcacccctttcttttcatgggaagaagaggaatatgtaattcccaagggaatataatagaaatattcagtagattggtaacaatcattgtggtctttaagcaccttagtaaaatgatggtactctggcagttgtctattttttttaatgggatttgctgagcgccttcttagctattattaccaggtcacttttcctattttatattggaaatattatatattataataagatatcaggggctaaaattaccttgagagtattgacaatcctccaggtgatgaataaccattaatggcttcttactaaacaaagaaagtatggaattaagtcaaatgattaactttgggtcaaaatatacagtagagttagatttaaaattttattagcttcaataaggcttacagtagtaatctcagatttacaaatcatagcactatagtcaatagcagtgttactctatttgtggcctcagaactgatagtatcagtatcactaggtagcttattaggaatttaaattcaaaggctccgttcccaaatcaggaaagcctccattccaaaattagctgggcacagtggtgtgagcctgtagtcccagctgctctggaggctgagacatgagaatcgcttgaacccaggaggtgaggttgcggtgagccgagatggcgccactgcactccagcctgggtgacagagcgagactctgtctcaaacagacaaacaaacaaaaaaccaaaggcttcatcccagacccactcaatcagaatctctggggttaggggtggtttcaggaatctgtagcttaacaaacttattaggtaattcttatgtactctatagtgcagttagagaaaatcaattctgtatccagagataaagggttattatgaacaatgtattcatttccaatgaacacttagtataagatttcaggaaagtcaaagacttttacatttagttttttaaaaagtttttacaaaaaagctgttaatatttggctattttcacatcctttcattcttgcacgttgcagaatatacaaacaacctgagtgggagttccctatttcatacatttttggggggtcattttgattttaaccataaaaagttaaaaagataaaaattcttcctcctactgctaacttctataactatgctgtattactttttcttatattttctcccagaggttttcaggtcatataactgaaaatctatatgaatatgtttatatattgtatatacccagatgcatgttcacatttatgtgtatgtatttctttttaaaaaacaaaaatactagcacacaagtatctacattttgcttttaaaatataaatcttagatatgccactgttcttttatattatattctattatattaatattttatcttattagtctccccaaagatggatatttaaattgtttccaatctcttgtgtttagattgttcctaaacatttacatttgtacacttatttgctaaacatgctttttttttaaggcacgcagtttctttacacccataattgcatcctaaactcttgtatagttcatatttacagccccccataaagtttttgcattctgaattagtccttcacattttgatatttggcataatgttcaaacacactttatacacactgacctctccttaaaccactcatagatttaataaatcctacagaaaaacattcagagattacttgaaagcttgatcttctatttacttcaaggtgacagaagagttagtttttcgtgatgaaagactacaggaacggagaattaacaaactgttgtgtaattcatcagagaagtatattaactctgctgaagtaccactgaatgaaacaaaaatgaatctgtgaagtagcaatctgattagcaggctggcttctatgtcccatcactctcatagtcttctattattatattttcttccacgtctccttgggctgaaaagagctgaggctggctggcaggcagttcactggcactattctgactcagaggaagagaccaggtttccagctctgtgtcctgtgcgggttcacccagagattcctctgcagaatgtcctccgttaagctgggcttcatctccactgtcagggtcgatcattccatgttccctgtcagtcagggcttccattttcagtcttccgaagtgttgcttcagagggagccttccaatatcttggataagagaaatctgagcttgatttctcattggaatggttattagagcaaggtatggcagtagctgagtttggaggcataaagctggtaggcagaagtcaggaaaaagtgcttttgctgccaggcaattttccccatactttttatgtattagaaaccactgcggtgtgtgcgagggtcaaaaacttgatccttctccttggcaatgagcatatcctccggctttgttggaatgtatcacacctcttgtagctatagatgtcctatatttcctgagtaaagagcgtgtattccagtcaccactgaggatacctgcaaaacttagaaattcactggctctcacaatatcatcaatttccatgaagaagtctatgtagttttggtgaagatataaattaaataagtctcctggcatgtgtgacatttctactacctcctcaggttcaacaagtatgtatcctgttcatattctgataaatgagagggcaaccaagatgagtctgattctgttaaagatgctcttttactgtataaaattttccccaaagctcggaagagaaacagagaaacgtctttgccaccagtagcttggacctcttgactttcaaaaaccctatcagttttttttctttgttttgattttgacagcgtagcatttgattttaaagacattctttttttccttggccataagttgttttctccttttgaagaagaaatctggaggctgtttattgcacttctcatatcaccagaacatccttgacagagcacctctagagaagttttgtcagggacagtaatttttcctccattcttgttagcctctatagtcactattcgattaagaaatttcatcgtaattgttggtgccacagggttgaaactaatatttgaggtagaatgctcttcccgaatttctttggggaacaagaaactttgattatttttaccactgagactgtcacagattataaatataaaaggatatcgaccaatcttcacatacttccttagaacttcatgtaaagtatgagaatccctataaactggttaggtaaatcttcaaccagaattatcttcttatcagttctcagatgatctccaagcatttgtaacttgttatactttgttgctcttagtagaaactctttgcaaactgctatctgagactgatagggaaacatatggaagcttgattcagtatgaaacatttccttgaaatcatctttttggaaatctggtaaaactggattaatccactcttgtacttgaataccattctcctttgatagcgtttttttggtcgttgtctttccacatccaggaggacctgttattaataaaatagatccatcctgttttggttgcctttctaagacttgagctttttaccaggtttcaacttcttcaattatcttttcatgcacagccaagttcatgctaactttctggtttatatttatctacccatggttcattttcagacagatagtcttttgaattttctaaaccatatatctgttctaaggaagacagatttcctatttttctagctggaaatatcttactttctaatgtagaaggctcatttttttctctatgacttgagttattcacacctaatgatgtggcagtaatagtagagatgtctctatactctagaaaatcattgaatgatgggtcaatccagtctgttacctttgtggaagatatctttggtctaagaaaagtttttgacattataaactgtaatagttcccatccatagtataggacctgtagtacattaaactataattcacctcctttaaaaagcaggtaactgtccctgaagatgccaggttcctgaaatgagagaccatgctgttgttttaaaaaatgattttgcacataggtgggtatgtttgtgaatacatttccagaagtagaatttctgagtcagagtgtgtgcatttataattctgatatatactctccatagaagctgtaccaattcatattctctctggtagtgtgagcagtaattgtttttgctattctcactaaagctggttattagtttaaattttttttatccaacaggtgaaaagagggaaacgaatgtggtttgtctttcttataaaaaatagtcaatcttatatgtttgagttacttatttttctgttctgtgaacttccatattctttgctcatttttttctgttgacttgttgacctttttcttgttaatatataggagtacgttgtatattagagaaagtcacccttctaatatgtgctgcagttttccatttaaaagaatatttttcctttgtaagtttttggttatccagaaaattccgtgtaattgaaaatattagtaatttctttttagactttttcttttatcttctccttttctttgtttggctatgctcaagcctagcagacagcactagcatgaggccaggggagcatctacaggactaaaattagaggctttatttttgtaccccaggtatctttcttgcctcactataatcttggctctcccctattccaagcatttaaagaaataaaattttgcagtggtatcttctagcaccttaatgatttaattttcataattatatctttctaatttatttttgcataaatgtgagatatggatacaaatttatttgtttttcccagatgactatcaacttctgacactaattattacataatctgtctcccctattcctgatttaaaataccacttcctgtattaaaaaattcctgtagtatctatctatctatggagtttgtcaactacctatcaataatctatttatttatttgacaagtaaaagttgtatatatttatggtgtacagtatgctgttttgatatatggatatgttgtacagtggctaaatcaagctatttaacatattcatcatctcacatacttattttttgtggtgagaatatttaaaatttactgtcagcaattttcatgtataaaatatattgttattaactattattcccacaatgtacaacagatctcttcaatttatttcacttaactgaaatgtgtgtcctttgagcaagaactccccatcctcacccccagactttagtaaccaccattttcctttgtttctatgagtttgacttttttagattacacatgtgagattacgtgacatttgtctttctgtatctggcttgtttcactcaccataatgttctccaggttcttctatgttgttgcaaatgacagtgaacatgggagtgcagatatctcttagacataccgattttatctttttgatacatgcccagcagggaattgctggatcatatggtagttctatttttaatttttttgagtaatctctatacattatgctttccataatggctgtactaatttacattcccaccaacagtgtaaaagggttctcttttctccacattcttgccaacacttgctattattcatctttttgataatagcctttctaaaaggagtgaggtggtatttcattgtggtattaatttgcatttccctgatgattagtgatgttaagtattgttttcatctacctgttggccctttgtatgtcttttttttttgagatggagtttcgctcttgttgcccaggctggagtgcaatggtgcgatctcggctcaccacaacctccgcctcccaggttcaagtgattgtcctgcctcagactcccgagtagctgggattaaaggcatgcaccactatgcctggctaattttgtatttttagtagagatggggtttctccatgttggtcaggctagtctcgaactcccgacctcaagtgatctgcccaccttggcctcccaaagtgctgggattacaggtatgagccacggcgcccagcctgtatgtcttcttttaagaaatgtctatttaggtcttttgtccatttttaaaacacaaattccatttttgttttgttattgagtttcttgcatatttgcttcttttcagatgtatggctttcatatattgtcttctattctgttggttatttcttcactctgttattgtctcctttgctgtacagaagctttttagtttgatgtaatctcacttgcctatttttgcttttgtttctcatgtttttgaggtcatatgaaaaaaaatcattgcccagactaatgtctgggtatatagaatgatttttaaataccgctttaattttaagtggattgtgagcatcaaaggagataggctctttggatagctattcaggatttccttcatttcaatggctgaatagtattttattgtgtacatataccatattttatcaattcatctgttgatggtcagaaaagatagttgatataatttaagtcttcttaaatttgttagacttgtttcatgtgtcatgtgatctgttctaaaaaataattcctacgctatgagaacgtatcttctcttgctgtttgattaaatgctctgtatatgtttgttaggtccatttggtctaaagtgtagttcaagtccaatgtttccttattgactttttggatgatctattcattgttgaaagtggggtgttgaagtcccttactattattgtgttgtaatctattcctcttttcagatctattaacatctgctttatgtatttaggtactgtgatgttggatgaacatatatttataattgttataccttcttggtaaattaatctctgtgttattatataatgaccttctttgtttctgtttacattttttgatttaaagtctgttttatctaagtatagctactttgttttgttttgttttgtttccatttatatagtatatattttttgatcctttcaattgcagttaataaacatccttcaaggtgaagtgaggcctggcatggtggctcatgcctgtaatcccagcactttgggaggccaaggtaggaggattgcttgagcttaggagtttgagactagtctgggcaacatgatgaaaccctgtctctaccaaaagtacaaaaattggcccatgtggtggcacacatttgtagtcctagccacttgaaaggctgaggcaggaggatcgcttgagcctatagttggggcttgtgagtttgtttttttttttttttttttttgcagggggcagggggaacctgttttttaatccattgagtcactctatgtcttttgattggaggtccaaatccatttacattcaaagttttatttctatacttttattatattttatttatttacaagtaatatactgtttattattgctttgtaaaatgtttaataatgattaaggcctaatccctattgctctcttttcagaatgttcctaactatcctaactactcatgtctattattttttcatttcaactttagaattatctttttaaaaaatcttatcacaatttattgtgatcatcttaaaaagttttttaagtatagagagaattggcatttttatgatgttaagtctttctatccaagaatataatatgcactgccattggtttggaaatttcttttttcttttcagtgtatttaggttcttatagattttgcatatcttctgtcaagtttattctggggtattttcttttttgtcattgtaaatgaggtatttaacaagtttttttggatgtgtttttctatatataaatgcagtcaatttttaaatatcaatttattctcatctaattcaacagaatttttgttattctgaatatttaaatttttttagtttttcacgtatataaattatcatttgcacataaagataattttaacttttcctttctacattttctactttttccttctataattgtgttagtacttcagaaaaatgttagtaattgttgtggttgtagatatacttgtcttatccacactttaatgggacacttctatttgttttcccagtaagcataatgttggttttttgttgttgttgctactgttggaatgctgttgttgggattaatttaaagaaattaatattgtcaaatacaaagtcttaaaaattcaaatatagatgttttattctataatgcattttcagaattggtggagattagacatacttgtatgaattgtctccttataaatattaaattattttaattagtacatttcttaatcctaaaccactctggcattcccaggctaaatctcaatttgtcagggtatatttttaaatgttctgctggtgctccttactaatatgttgtttgtttgttacaccgatatttggaagtgagattcttctgtagacttctttcttttctaatgcttgtccaatattgaaacaatagttaatttggaatcttaatttatctttaaagagtattgcaatagaatgttctttagatatttcattcattcttggggagcttttaataatatgtttctcagcttcattcccaaagacttagtaggtctttaagaataaaaatggtatacttggttattgagcctagaacagtgtctggtacatagcagtggacattcaaggaatacttgactgattaattataaatttggatttttaaaaaagctactcaaattgctctaatattcaaacaggcaggccttagaactgctgccctaaaccagttttctgtctaagcttgtatactgcctaataaataatactgctttgtttatacaacatactcaaaagcttgattgagtaatgaagacattaatacagaggtatttagagcttttgtttataaaatgtattctaatagcaactattagtccctttggcatacaatagcagagcaaatacttgtggcatccttttgaaaactaaaatgcttttttttgattcatcaatgaggtatctatatgatctgttaaaattaacggagagtggaggatacaaaatcaacatgcaaaaccagtagcatttctatacaacaataacaaactagctgaaaaaaagaaacaagaaagcaatgctatttacaataaccacaaaaaggccaggcgtggtggctaacgcctgtaatcccagcactttgggaggttgaggtggacgtatcacctgagatcaagagttcgagaccagcctggccaacatggtgaaaccctgtttctactaataataaaaaattagctgggcatggtggcatgtgcctataatcccagctactcaggaggctgaggcaggtgaatcactggaacctgggaggcagaggttgcagcgagctgagatcgcgccactgtactccagcctggtgacagagcaagactccatctcaaaaaaacaacaagcaaacaaaaaccacacacacacacctaggaatatattaaccaaggaggtgaaagatccctacaagaaaaactataaaacattgatgaaagaaattgaagagaacaccaaaaaatggaaagacatcccatgccatggattggaagaatgaattttgctaaaatgaccataccaccaaaggcaatctacagattcaatgcaatctctatcaaaataccaatgatatttttcacagaaacagaaagaaaaaaatcttcaaatttgtatagaaccacaacagactccaaatagttcaaagcaatactgagtgaaaagaacaaaactgcaggcatcatactacttgacttcaaaatatactgcaaagctatagtaaacaaaacagcatggtatttgtataaaaacagaaacctagaccaatggaatagaatagagaacccagaaataaatccacgtatttaaagtcagctgatttttaacaaaggtggcaagaacatgcattggggaaaggacaccctcttcaataaatggtgctggaaaacctggatatccatatgtagaagaatgaaactagactcctaactcttaccatatgcagaaatcaattcaaaatggactaaagacttgaatgtaagaccccaaactataacactcctagaagaaaatataagggaagcccttcggacattgttccctgcaaaaaaatgtatgggtaagatttcaaaagcacaggcaacaaaaacaaaaatagacaaatgggactatgtcacctgagaagcatctgaacagcaaaggaaacaaaagcataaggggacaaactgtagaataggagaaattatttgcaaactattcattcgacatgggcctatatctagaatatacaaggaactcaaacaactcaacaacaaaaaaccccaaatgatttgattttaaaatgggcaaaagatctgaatagacatttctcaaaagaagacacacaaatggccaaggatatgaagaaattctcaacatctctaatcatcggggaaaggcagatcaaaaccacaatgagatattatcccaccacagttagaactgatattatcaaaaagacaaaaaataacaaatgctggtgaggatgcagagaagagggaattcttatacactgttggtaggaatgtaaattagtacagccattatgcaaacatatagaggattctcagaaaactaaaaatataactaccatatgatccagctttcctactactgagtatttatttaaaaaatcagtatatcaaagagatatttgcatctccatatttatggaatcactattcacaatagccaagatatagaatcaacctaaatgtccatcaatggatggatggataaagagaacatgttatatattcacagtggactactacccagacataaaaataatgaaatgctctcattcacagcagcatgaatgagcctggaggatgtgttaagtgaaataagtcagatatagaaagataaataccacaaattctgactcatatagagtagcttaaaaaaaagttgtactaatagaagtagagagtagaactctggttattagaagctggggagggttcagagctggaaggataaggagaggttgattaatagatgcaaaaatatagctagataggaggaataagtttgagtagtattctacagcactatagggtacatacagttaacaatagtttattgtatatatttaaaaagctagtagagaggattttgagtgttcccaccagaaagaaatgatatgtttcaggtgatgcatatgctaattacactgatttgatcactacacattgtgtacatgtatcagcatatcactctatattccataaatatgtacaattattatgagtctactacaaataaaaggaaaaaaatgagctgagaagcatgttaccttttttgagcataaaagagaccttcttcataagtttgtacccaagtgatgtcatctccccatcctgaaatagaagagagaaatcaatgcagtaacccagaactagagaagagctcggaaatgggtatctaataatcagatatctacctacagatatttaactaagccatcaagctgttggctgacatatggtgcagaggacacacaattttcacaagatatggaggtgatttccctttagattgcagtactgaggttttgctactgcatttcaaacctcgaggcccatggccttgaacccagtaagtactcaatacatgttgttatgattagagctgattgaaaggacatctttggataatgtaaaagctgtggctttaggaacgcttggaaagtaacagttcatctttgcatactttgtaatattattaggaatcctttcggctgtactctacaatgccctcctattttgggtcccaagagatgttgacctcttctaagtcagtatacgttgtgaaataagggaattccaagttttgctttgaattctgacatggaaaaaattcttgtgtgggaatttcatggccaagagacataataaaacgcatgtgttttggaaacacccaaaagaatggagagaaaaaacagaaagcaatgaatatagagagaacccattagccttaaagaaatggtatgaatagttgggaatgtgtataagcaattaaagataaaatcatcaagtagaagaatgtgcagaacctccaaaaacattactgagtattttcaggaagtgtctcagtctacgaatgagagagattgaattaatgtgaaaattagcaatatttggaagtcagtttgggcccaggttttcttgtacatttcaaatgttgtcagaccacagtttctggctttaatatcatggtaaatatgatagtaatttgataaatatgattccatgatttttgcttgtttttcatgtttgttttctggcgacagctttattgaaataaaattcatacgccaatacaactcacctattgaaaacgtatacttttggccaggcatggtggctcatgactgtaatcctagcactttgtgagaccaaggtgggtggatcatttgaggtcaggagttcaagactagcctggtcaatacagtgtaatctgtctctactaaaaatgcaaaaattagctgggtgtggtggcatgtgcctgtagtcccagctactcgggaggctgaggcaggagaatcgcttgaacctgggggtggatgttgcagtgagccaagattgcgccactgctctccagcctgggtaacagagcgagactccatctcaaaaaaaaaaaaaaaaagaaaaaaagaaaatgtgtgcttttttcagtatatccacgaagttgtgcaaccatcatcacatcaattttagaacattttcatctcctcaaaaagaaaccctataccatttagctatcacctgctccccattttcttcaaatgccacagccctaagaaacccctaatctactttctgtctctatagatttgcttatgctggacatttcatataaatggaatcatacaatatgtaggcttttgtgactagattttttcactcagcataacctttttaaggttcatccttatagtgccatgtattattatttaattcattttttatggtcaaatattattccattgtatgaatataccatattttatttatctgttcatcagttaatgatatttgggttgtttccactttttgtcttttatgaataatgatgctatgaacatacatatacaagtttttcagtggtatatattttcatttatcttgggtatatacctaggagtggaactgctgatcaaatggtcactctgtatttagctttttgaggagctgccgggttattttctaaagtagatgcatcattttatatactcaccagcaacatttttgttttttgtttttttttgcctgatttaaaatcttaacattgaaaaacatctcttgttagtttaatgccacatcttaacaggaactcttgctctctgtaataatcctgaaagattctctttccaactttggttgaacacatgcaatatctatacatcacattttgcattaagtaaaagttattctaaaacagcaagtgagacgaggcctctgctgaattttccctcttctgttgcaaatatcattcaatgatggagcattagcagtggggaaaatttctattctctgctcctgctcaatttagttccacaaacagtaaaggaacatctgctgcataacttactccacaaagcagtgggaatacaaacatagagcaatataatccctattctcaacaaattgtccatagctctgtagaaaagccatattgcattataatgattttttatttactctgttataatcacaataggtcaaagctgttacacagtttaaatgcacttcatggcttctgctcattactctaattctagccctatctctatctctggctatattttcttgtcttttgagattttattcatttatctaacatatatttattaaatatttactatccgccaatcactggactaggtactcagcaattctgattcaaaggaaattggattttttttggatcattctatgtgtgtgtatttttttctccctgaaccttcttctacctttttctaattaatcttccttttctccttactgccttctctacttaactagtgctgccctgtgctctaaggggctccatatgccactctttatactgtatccagacttctcccactcacccctacctttaatcttcattcattctgagcctcattctctccattatctcccatgtagcaatagatggtaaaagactttgccaaatataaaccaattctcaataatggtgttctcagctaatatcagtcatcttctgtgttaaattagtttcttatcaattgaaataatagaacctttaagttgtttaaaatagggcatacaaatgtaatatattttttcaaaacattcaacaagagttttaaataaatatttagaagtgagcacacagaatgttgatgccttgacgtatagttatcacagtgctgcttaatgcagacatggaaaatctttaagggcaataactagtttagtctttgtcactttagggctactgagctcattgttttacaacagttatgcttatacagagagatagagttatgtttaggaaaatatttcaactttttcattcctttcttttgcaaaaatatgttgactttctgtatatatagattgtgtgtttgttaaactgaagtagagttaattagcttaggtaaacattgatgagcacttggctggcactcaatacatctgttaagaaatgaatgtacttgggaagcaagtcagtgttttagaatttgaaattatataatatatatttataattatagcatatatttatatataatttattataatataacacaaatgtatactatgatatatattatatataatatatagtatatataatatataatttgtatgttataattatatatattttatatatatatcagaggtaggaacagaattatttgttcccacttggttattcaaaactagcagtattactccaaggcacttgactactatttgcagtggtaatatgaatggagcaaacaaatggtcaagtactttgtggtaatactgctgattttgaatagctatatggggacaaataattctgttcctacttctgttacttagagatatagaaactaactttgagaatattttcttggccgggcgcggtggctcacgcctgtaatcccagcactttgggaggccgaggcgggcggatcacaaggtcaggagatcgagaccatcctggctaacacggtgaaaccccgtctctactaaaactacaaaaaattagccgggcatggtggcgggcgcctgtagtcccagctacttgggaggctgaggcaggagaatggcgtgaacccgggaggcagagcttgcagtgagccaagatcgtgccactacactccagcctgggtgacagagcaagactccgtctcaaaaaaaaaaaaaaagagagaattttttttaataaaatgtttctttacagatgaatatatatttgtttcttgggccaagtaaaacagtaagtacaaaaagaaatgtttctaaacatgtagccaccggcaatccttgattatgtctaaaaccactgtcttccagagtcaatatagcaaagacttagttaccccgaattctcagagtttggggtatagtataattttctgggaaggcttatataaaattattccaatttttttttttttggaggactgggaaatagaggactgggaatttgagcaaattttgaggaatcttaaattgctattaggacaccaatatgacgcagcaatcaatcattattttctaggactctggttaccaaagttatagacagcgagccaattctccattattttggcaaaagataatgcaaatttatgttattgtttgctagttgatttgattcactgcctaaaataaactgattccttctgttttaaaaaatccattttgaagtcacacacaacaaaaatcattcagttagttgaatttgctttataattagactatgagtgaagacaccagatattttaaaaagcaatccaaatgactgagtttagaaaataaaatgagattacagcacctcttgagagtgtctgaggaggcctcttttccttttttattgcaatggcaaggttggaagaaactgtgacgagtaagaggcagagacccaaagctgagtgtagcatcatgtcttctagagactctctcagaagaagctagatgacagaaaggaattctcagaatccagtgaattacttcaagctattattagaagatatttgctaagagttggaccaatactgtgatgacagactgttcagcttttttggtttgacatggtataaccaaccacatagaactttcattcacattttatttttaaaatacttaatcaactcagtacatgctcagttggtgagaagtcatgttctgagcctcctgggcatggtgctgtataattaaaaaagagctggatcagggcacacgaagcctgcttctgaaccgccctgtagtgttcacaccaacaagacgaaactcaaataagatcatgttgtttgatgtcttgtaaactatgaagtgacttttagcatgcagaaatattctttgccttttgattctccttcatctaataggtcaaaatattttaactctatactaagataagattatacatgaataaatattgcttaaaatagaaatcagaggaaaaatagaatatggaggattcttgtccttcagttcctttatagtttcttacctttctcatccttccaacaattactcagacttttgcccttcagtttatgatacagctctttataaaaatcaagtactatcatattactataaattagacatatgtatagagaagaatagactgtcatgattacattctctcctggttagctagaattcaaactgattcttaactcaatgtgcatcttttatactttgcacgttaagataaaaactgaagtccaaagttgggcctgatctggtcataaaccacttgataaatatattacaggaagtctttaatacttgtgagatgtttagttacagcattagcatataaaactgatttgaaaatggttgactcatgcagttttgaaactttacctcaaaatataaaataaatatacagacatcattcacattgatttgaagttcctttaagacgtctttcctattggcttacattatttagtattgaactcatcaccaaaatagtaaaatttccttagccaaaatggctagtgactgattctttagtgattctgttcaaacaaagatgttgctatattttattgtagtaggcattgtggaaaatgaaaagatatataagacacaatgttttggcattggtaaaacatttggcaattttaatcacctagttattgtaaagtagcaaccgcagtcgtggaggagaacaacaatttggtggtaaagaagtttacagattctagatttctccagacatttcctcattcctcccattatactgttttccccttcccagtggtgtatctattgcagcccctctatggactgaaaatagttaccactccaggttaaccttactttatttccctccctaatccccagttgtccctccctccttcccttccccttccttccttccccttccttctttccccttccttccttccttccttctttccttccttccttccttcctctttctctctctctttctttcttttctttctctctcctttctttcttttttttttttttttgctcttgtcacccaggctggagtgcagtggggccatctccactcactgcaacctccgcctcccaggttcaagcgattctcctgcctcagcttcccaagtacgtgggactacaggtgtccaccatcatgcccggctaatttttgtatttttagtagagatggggtttcaccatgttggccaggctgatctcaaactcctgacctcaaatgatccaactgcttcggcctcccaaagtgctgggattacaagggtgagctacatcgcccggactcctttcctctcccctcctttcccctcctttcccctcctttcccctcctctttcccctcctctcccctcccctcccctcccctcctctcccctcctttcccctcctttcccctcctctcccctcctttcccctcctttcctgtcctttctttccaggcatataaaaaccctgttaaacaattatcacggtgcctgataagaatttcagtttaagttctcataacttattaaaccataaaacatttcagaatgtcatcttgtaccttaaggccttggtcatcttgtactttaaagactgaaacaaatacagggtggattttagtacaggacagggacagttgactctggaacacaaagctcaacccagggaaggcagccttagttagacaggttgggagttgcagtggaggaactaaagcaaccacctaggacaggatcttaacctggatccagcaggcttctagaaggcctgtggctgagctacagaaggctcaaaacccctggaaattgtgtgcaaaattttatctgcctctgttccttttccgtgggaatagggtccaaaacgtcattaaaattcttccagggatcttggatataaagaagagttaagaaaagtcaatctggaaggaatctttagaaagatttttctatgttagctacagagacaagcaggtggaatctgcattttaaaaaagaaaaagcataacctcatcatttttgctattttaaagctgcgaagcttagagttaagcgggaaccattttttctttaaaatttcaagtctttatgtattattgtcaaatactttctaattaaaaaataaaaatcttggttttctggttttacattgataaattataaaatagatattaaatatattctgtgacaaagcagtacaacttgtacactgtagattttgaataaataacgctttccttggtaaaatatagtgtaaactgctgagggtcctttagtatcagttgcaaggttaagctacttgggggaacacagataaatgtggcatggttacaggcctacagcagcttaaaatgcatttgggaggcacataaccatatgtcagcaattagattgtataaacattggtcaattagcattttatgacattagtattttatttttcaaaagtaatttaacgtaagtaactgatattataagttcctatattttaaaataaaacaagacttaaaagaatataaagaagagctatcattacttgtagaatacttttcaaagagtcgtttttgtggttgacgtcaatttattctaataccattaatataaatagagataaaactatgaaaccagcaaaggaaatccagttcagtaaaagaagaaaaataaaaattcatttcactttcctaccctttactgaaagcttcacttttaaatagcaaaaggtgattatttaaatatagcaaagcttgaccactgattaagtaatctggaaaatttgcttgcttacctgacttggccagtgctcttgttggaaatgtattctggatgtttctggttaaaaatgggtgtggatttatagacacacacacacacacctgacctacaacctcacctgcatagaaacaagagcatagttaccggaaaacaaacttagaaaaataggctggtctgaaaaactctgtacttctttccagttctcatgcttctcacactaaaaaagctctattctttttctctaaattaagattgaatgtcctcataaaataaggtcaaataccatctttgtgcttctttctcttttaccttttatttcccaaggtagtttaatgtttggctgaagttcagcacaaaaaaaaaaaagaaaaggaagaaagaaaacggaatgaatttaagaactgtgtgcatgccattgttcaaatagaaattcctaagggttactctgtttacaggaatataattaacagctaaagagattgggtccttttttttttgagagagaaggaaataaaaattctgttttaaagttgaacattttcataatttgattattctttacaatttttctataaaacctttactgcacaaaaaattagaaaaacaggccattagataagtttaaatttatctaatagttagatactgttgaattaattgagagtaattatttaattactgttaaaataacgtaaggcagtgtgtcatcaaatttggcatacctgttttttgtacagcccaggaaacaggaacggttttgacatttttaaacggttggggaaaaaaacccaaaagaatcatattttgtgacatgtgaaagttatatgaaattcaatttcagtgtccttaagtagagagagatgtggcggatggcatgcagccatgtgcatttgcttactagtgtctatggctacttttgcactgcaacagcaaagtccggtacagtccaggacagtggataccaaaatctgtgcacactcaaagtcccatatctggccctgcgtaacccacagatatgaaaagttggtcctccgcatatgcaggtttggcatcccgtgaacacagtatttttgatccacttttggttgtggatacagaacttgcccatatgaaggaatatattaaaaaaaaatccttctctaagtgaacccacacaattcaaatctatgttgtttaagggtcaactgtgcttgtgacagggactgtatgatctgcaaaacctaaaatatttactatctttagtaaatgtttacagaaaatgtttgttgaaccttaatccagggtattgtttataaattccttccttccttctttccttcctttcttcctttgcttcctttcttcctctctccctccctcccttcctctcttcctcccttcctctcttcctcccttcctctcttcctcccttcctctcttcctccatccctccatccctccatccctcccttctcccaccctttttttgtttcttttttttgtggggaagggtctaattgctctgaatacattaacaaatatactgtgcaagaatgggagtgatgattgtcttgctcctgatgttaaagcgggtgtgcttccagtattttaactttagatgtagtgctggatttggctgagttgaccatgttaagaaggtaaccattattcttaaactacatctcttaaaagcaggactgttggattttgttctataaagatgggcatatggattttctcatttgttatagaaaattttactgttttcctaattaaactttccattgtcctgaaagaaacttcatgtagctaggttgtatattctttaactgtactgctgatttgtgtacttgtctaactgtgctttcttccttacataggattctcaaagggacccttccctggaacatgctattcaaatggaatccttcttgctgaaggttatgaaacttgacatataattttaattttaaatccagccagcctttgcaaagcaaagaaatggctgggcaataatccttatatttctctgttagtgaaaagtctgggaaagctttcaacttcttgttgactgagagtggttacggaaaaatctccaaatattctgcatccctgttaaacttctcacataatattcatttaaataaattataagataagagtgagaaagaggaagtcgagtacctgtggggtagtgaaactagaccctataatgtctgagctgatcagtgtcttttggtctctcccactagggtgataatgcaatgtgtcctctaacccaggacaattttgaaagtaaaaggaggtaataaagtcattggaattatagcatcttaaaataatattttgaaatatatatttgtcatccaaaatttgttttattgtgtaatagatcacaaatggttctatgaaagattattcttagaagtaaaattatttaaagtatattcatgtacatgatggcaaattatacaaattattctttgtatataattatgttaatcattttcttaactgtacctatctgataccaggtggctggtatttttctggcattaactgtctttattttttcaatgtgacctcatatttattttttcataaaattgcctgcaataatcttcaaaatcaatcttacggttaatggatttggaattgtcaacagcttcaattgactcttcctgtaggtcatattacatcctatttttaattaagaaaataatttttctatagccgatgggttacccagtaatttgagaaagttcagttcactggaggacagttttaattctaattttaatcttactgaaatattatctcaaatattgtcttttagcctctgcttagagtaccttcttcaacagaaaattttacaagataaaacaagtaacataagtcatcttgccttataattattttaaatgtttcattaaatttccaagctacaaaattgtagggcctctctgtttcattctattcaggaacagaatataagtgtgtctaattatatactcttttaataataaatcaagctgttttgctcttggagttgattcttttgagggcattgttctatatttttacaagtttaattggtcacataaatcattggttaaatataggattaggattacctattcactttgtgtgtgtgtgtgtgtgtgtgtgtgtgtgtatgtgtccatctgtttgtctgtatttcagtttatcagtctcttactaagaaaatatatatacattttaaaaggctgacagtggaaagtaggtattcctcttgcccagtctatgggtcttcttgaggcaataacggtttatacatctacctatttatgtttgtatattaacacaaatggtgccattcaatgaatacttctgaacctcttttttatgtaataatattgaagattgtaccatattaggacaggtatttgtgaaactattcagtaaatgaaagagaataatgtcttgcagagagcatttatgtatcactgttttctaaatcctgtagaggcaaatagttatttttaaaaatattgggtttggagaaaaaagactctttgggttaaaggaatagatacctccagaattcattattgagctgtgcaattttataccaaacatttaaatgcatagtgtttttataagcctctcataatcaatgtctgtaacctacaggttcttgctctgtcaaaattagttacacttcccattgcaaaacaataatgttttatttccattaagcataaagtctctgaacttgcagggtattacatctaaacacttgataaacctgtggtatttttacaatataaatataaatgagatttattccttggtatttgccctgtgagctaagtaagattaagtagaattgtgcatgtagcttttggattagagattcaagtccttcaatcaggctcttacctgtagcttgtcgtgataactttgtactttttcccataaaaatgcttttatatcttaaacaggcatatcattttttcctgccatggtggagatcagggactcagcctggccagtttcctcagcccaggtcagggagggcctgttttggaagacatgaataaaattaaaatggattgtgcagagctgggaggcagccatggtaaatctgaagtgagatccccaaatagttctcaagtagatgaagaatagatacagaaaatgggaagaagaaagcagagccagagagtaacagaagcagggaaaggagggagacaataacgggtgtggggaggaaagagtggtagggctcttgagtgatgtgtggggcatttggctccgttcaacaggctggagaatatggatgtggtcttaccatgagattagaggataaagaacatttttaagatggcaaataaggtgttataatgtgatccgagttttaaaagttatgttttaacatgaaaaaataaatatattcataagttgcagacataaaagcaccaagccatagaataaagtatgtttctagggaaattatgaatctttccatagggaatcattttattttgatagcttcaaaaattctaatagaagattatctcctgaaagagaatatagcacctctagttgatcttcttcttaagggctaaatattgtatatacaaatccacaatgaaaattagttttcaaagatgtatttctaaaagtcaactaaattgtatattcttgtaagtacaaattgacattttctgtgcttgatgattaaaccatacactgacagtcctcagtcctgctaaaactcttcattcatttccctcttgattttatttatttatttatttatttatttatttatttatttatttattgagacagggcctcagtctatttctcagcttggagtgcagtggcatgatcacagttcactgcagcctctaccttctgggctcaagcgatcctcccaccacagcctccagaatagctgggaccacaagcacgtgccacccatacccagctaatttttgtgttttttgtagagacagggtctcactaagttgcccagcctcccaaagtgctgagattacaggtgtgagccactacacctgacccctcttagttgattaatacagaattttaagttcatatttttaccattgctatatattgtttttaaagaattactgtacaaaatattgttggttgtttacttaagactatttttctttcatatagctctcttttctgaaacactgatttggttcagcttttccctttctaccgtgctgttttatatttaaggtgggccccatagccagactcaggggctagattgattagtgtattccagtggttcttaaccagggtacatttggcaatgtctggagacatttttgattgtttcaattggggagggtgctataggtatctagtgggtagagagcaaggaggattctaaacaatgtacagaatagctccctccaacaaagaattatccatcccaaaatgtcattagtgatgaggctgaacccctggtctatttttacccaatcatggtggtcatctttctaaatcactgttggtttaggcataaacatgtgatataattcttgctgatgaaataggggaaatataaggaaagtttcctctcgttaataaaaatcaataaatgtaaagaaaatggctcccatttccactgatatagtcagatctggatgcaatgtattgaactctgacagccaccttagtttcatgaggatgcttaggaagaacaacgttgatgtaccttaaagagactgagagaaagatggagagaatctgtgtcaggctgaaggctggttaaaatattagaatcaccattttaaccagcctccagcctgaaactgtcgtatcttagggctttttctaagaaaaaaattttcttcgtattgtttaagccagctgagtttttgttacttttagctatcaggcagcatcttaattgataacattatttagcatttgcttatttcataattaaatatttaaacttttttgacatttagtttcatttttgattgaaatttcttttatgtcatatctttatcattatttattttactttactaataggctgggtaaaatttttgtgtgtgtataattttagaagaagggtacattggtgatattaattaatctttgtaagtctaaaatgcctttttgttcatctcatgggaatgagagcttgcttgaatgttggattattcatagttcagtacattttagatatagctgttgagggttctgactgtttagtgtacaccatcttctatttggtatggaagaaaggtttgaggaccatctgtcgttattgtgtgacctatctttttttcttgtctagaagcttgtagaattatttgcttgttattaaaattaaaaatgttaatcaaggccgggcgtggtgggctcacgcctgtaatcccagcactttgggaggctgaggcgggcgagtcacctgaggtcaggagttcgagactagcctggccaacatggcaaaacccagtctctattaaaaatacaaaaattagctgggcatggtgttgcacacctgtaatcccagctactcaggaggctgaggcaggagaatcgttagaatctgggagacggaggttgcagtgagccaagatggcaccgctgcattccaacctgggcaacagagcaagactctgtccaaaaaaaaaaatgttaaccaaggccatttccatcacagttatggcggctaacactagtaccagctccttacagctgctactgctagagcttgtagacaaatgtaagaatcaaaaattctcattgtgatgaaaactgataaggaaattgttgatactcttctaggatttgataactttgtcaatatggtactgcaagatatcactgagtttgaaatcccaccagaagaaagaatactaaattagatcagattttgctaaacggaaataatataataatgttggttcatggaggaggaggacctgaggtatgaatgtgtttccttgacttatgctggattctgttttgtcttgtaatgaaaagaaaatagattttttttttttttgccttttagtgtttagatcctgtaaagctaagtttcctattaagggaaatgttttgaagatgtatacccatttttgtaagttaatcatgattatcttggaaaagaagaaaagagtttcttcgaagactaaaatagaagtgttttggttaaaaaattcatcaaggtattataaaatataaattgctacttcttaattttgcctaagactcaataaatgtgtctaattataaacacccaaggctgtgttcagtttctagaagtgtttcttcttatcatctagctggttattgattttcattatgatcaactctttatttctgtaaaacttgttttccagatttgagatgttccttgacttacggtggagttacatcttgataaacacattataagttgaagatattgcaagttgaaaatgcatttgatatacctaaactactgaacattgtagcttagcctagcctaccttaaatgtgttcagaacgcttacattagccttcaactgggtaaaatcgtttggcaacacactgcactgtagagtattgatttaccctccagatctcatggctgactgggagctggggctcgctgcctctgcccagcacaagagagtctgctactacatattactagcctggaaaaagatcaaaattcaaaatttaaagtatgatttccactaaatgcatatggcttttgcaccattataaagttaaaattataagtcaaaccgtagtaagaccatctgtattggaaatctgacattattatctatgtgtcctttataatttgcatctctttagtctgcctccacagaggcctgaatttctcttttttttttttaaccgatttgatccttgtagtagtcagtttattctttattgttcccattacagtaaaaaagttagcaatcacacttttcagtttgaaacctcttttctagcttcaaattgttttgtttatgactacagatcttgtttttatatctgtatgataagatgcttctgtaaggggtttagccagctattaaacctccagagtgacctcatttcctaagccagcacctttgtcaggtttacactgtggttgcctttgtagctccccactgcatgaagactccaggttttattgtacttcctggaaatgccagcagaatgaacaatttctcccacaaatcattgcatgacttagctttattttcaggccccactgcaaaccttttggaggcaggtgctgtcccttcccttaagccctgcaggctgtcttttatacgtattagattatgggcatgtcagtcctcacatctgtctgtgctgtcttagagagatttcttgaattttcagtttgactaagtacatctatctgtcatttccaagtgggtataattgtctccttactatattcaaaatagaagaatgtgggctgagtttggcatcttgtatagaatgctaccatttactccactttaaattgaacctaacataggttgagtgagttgtccaaactcacagtaagtagcagagcctggtcttaaacttagatcatttgaacccaaattttgtgttctttccactatggaagtcagtatgcatagtagttaagagtgggagtcctagagaaggagagtagacaggttctggcatctggaggagtgggcccataggggatcatgacaaggaattgattctctagtcaagcatgaacacgaaaagagaattttcttttcacaccttacttcacagtgtgaccactgatttcaatcccaccttttgtgatacttcctctaacattgttgtcattgccttaacaattgtcatgacttgttagttatgcgaggagaagtgatcatggggccatttgccctgagcatccagcctccagtggtccttctattctggggctaggatgtctgggttccaatcctgctcagtagccaccatgaccacagagaaattactaatgcaaatagaaatgttgataatatttatcgcacagaagtgttgtaatgatgaaatgtgagagaacatgaaaagtgacagaaagcaggcagtaccttcccaaacatgtgggcctaccctagagcaggctctttggtagttaatgaagataagacagcaaatacaaaggtcaagttgctcccttttttggaagagaaaataaatgagtatttaaaaaatgatagttgatgagttcccaataaatattagcttctcttatttattatataactattattcaagtgagcccactaagcccaggaactagtgagaaaactctcttagcaataagatggactgatgtattaggtattttcccaaaacatgattttttagagggtagacttctctcaagaggagaaggagccagttttgaaaattcatgattcaagtactaattgcatttcaatttaaacaagtttaattcagttttgttcatgttttacttggcccaacaaattatcctagtgagctgtctgtctgccgaggaggtgggtttacaacctgaagagtcaatttggaaactgaacaggagctgagctgagctactctctgactctgacattagatgtcactacaatcaaaggaaagcagagcgggcaacctagcagtgaagtgaaacttgaacatggtagaggaaagagacatgtttagattgtggtgcaaagttcctggataagaacttgtgatatgatttgcctatccaccttgccatggggaaaaaggagaattttaatatatgtatgacagctgcattcattttcctaagacattgactaggaacaactcctaaccactttgcacatcttggtatttcttcccctaatagataatagaactgatagaggcccccaaggattttcagtgcagaatattcctaataggttctaaacgagaattttactggaccagatcactaagtctagttcttctaatgagcttaatgcttaaagcttaagttgtctttcaaatattcttcaattataaactttatcaggtgtttccaaagtttctttgcttaaagatgtgaagaaccccaggttactggtatttgtgtgttaagagtagaattaccaggtacagtcacatttgtttacttaagcaaaatatctacaaacagctggagggcaggggacccaactaatgtttccatttattgctaggcaactgggtgaactgaaaagtccatcctcccaagggatattatattaaatatatctttttatgtgtgtgaactggcacacactattggaatagattcagaatatctaacaattgatgcagcataggtaccaatgaattaaatctagcgatggctagggcttccaggggaaaataagggtgctccatatgggtgtagggaggacctgatggggaacaactgctgcagtacctatttatcaactcctgagggaagtactttgacatattaataactgggatgactgtaccagtatctattggttgaatatcagcctgtgtatatataacttggcttatcaagagcccacaagatctctggtttaggttccaagtacaagtatcaaagttcattctcattaccctcttgataatggtctgggctgctaatttttacattgctttagtgatgggaaggtcccacatggagggaaattttatgaaatatgcagagagaagcttggtctttacatgtctacatcttcttttttcaagctgtgatgaaggccttgattctgatgggcatcaagaggcagatacagctcagaagattcagaaaggcagactcgtgtctaacataactacattaccttggtgatcccaggaattagtagactgatactggggataggagtggggttctcagtattggtgacaaagtttgttttaaagtgtcctgatttttttcctttgctctacatgagaattaatgcaccagtttgcaatatatgtaaactgtttcatgtagatttgttgaagaagaaagactggatttcaagggcctaagagcaggcagttttcatgttcaaggtgttttcacatcgtatgcagtgcttagattactgagcccatagtagttacctaattcttatttgatacttgattgatatttttgttttctgtagattattctcattgagaagaaacggacctatgactgatttcagaccagtgattttggtaatgttttgaatttactgtaattatttaagctgttcttctgaatacttgtaccattttcttggtgattcagaacgaaacttacagctaaattatctgggttatattaatctttgcatgcattaaaactgctgtttttataatggaaagaaagaggactactacctatgtatatctcaatgtgtctgtgccacgctgttttaattatgccaagtgttcactgacaaaagtgtgaatggagcatacaatttaaaaatatgaacatgttattaatatttggcactataactgtaacaatcactgattatcatcatgattggggaccttgtctcaccaataccagagacatattgatgtcacgatgaactgtatttttctactattatgtgaaattactttcttttaattccactatttctcattgtttggccacttttacttaggggttttctctctatttcattgttacatgtatttttttttgttcaaatgtcttaaaaattccaattcttaaggttgattccattgtacatctttgaatttcacagtgtatagttagattgtagtcttgtcaagatgagaaattaccatgatgccatgatagcttctaacaatgctactgtttcagaagtcaggatccaaggtctcatagaccaaattaagacctcaaactatgtggcttattgagtcagaacacagtgagaagcaaaggacaaagagtaatgtaacttggatgggatgcaaatgagaaggagggactacaatacttaaatctagagctgcatactatccatatatcctgcccctttccacttcattagtattccctgttaatggtaggcaaatgatgactgagtgcacatgggaaaggaggctcggcagaaagaaggtgctcaaagtcaccttggtatatctgagagaccacagggcaaaatgaccagtagctatttttatatagcaatgacttttgtctgtatggggcagaaaacatgaggagccagaatgagtgtcaacaacaggtgactgacttaactatgatgttactgaaggtggcatgatttgaatctagaaaaatatacaaatatatatatatatacacacacacttacacatatatacttttacatctttaatgatatttaatttgaataaaatgcattcatttaaaattacatttctaagacttttgaagaaagtcttatgtaacttctagcacaattaagatacagaatattttcatcagtttccaaaatttccttgtgccactttgtagtcaatggcccaccctaaaccctagacaaccactattctttctgtctgtatagattaattttgtcttttctaaataaaattatatagaatgcggtctttcgtgtttagcttcttatgctaaccacatttttgagattcatccatgttatgtcttgtattggtagttcattccttgttattgccgagtgttattccactatataaacagatctcaatttctttagccactcacctattttttttctgatttttttcttttctacttttttaacttttattttaagtgcagggttatgtgtggaggtttgttacataggtaaacttgtgtcatgggggtttgttgaactgattatttcatcacccaggtattaagcctagtacgacttagttattttttcctctcctctcccttctcccatcctccaccctccaataggccccagtttatgctgttcccctctgtgtgtccatgtgttctcatcatttagttcccacttagaagtgagaacatgtagtatttggttttctgttcctgtgttagtttgctaaagataaaggcctccagctccatctatggccctgcaaaggacatagtctcattctttttagtggctgcatagtatttcatggtatatatgtaccacattttctttatccagtctattattgatgggcatttaggttgattccatgtctttgctattgtgaatagtgctgcaatgaacatacatgtgcatgtgtctttataatagaatgatttatattcctttgggtatataaccagtaatggtactgctgaatcaaatggtatttctgtctttaggtcttgaggaattgccacactgtcttccacaatggttgaactaatttacactcacaccaacagtgtttaactattcctttttctccacaaactcaccagcatctgttactttttgactttttcaaaatagccattctgactggtatgagatggtatctcactgtggttttgatttgcatttctctaataatcagtgtcactgatttttttttccaaaggattgttggctgcatgtatgtcttcttttgaaatgtgtctgttcatgttctttgctcactttttagtgtttttttcttttcttgtaaacttgtttaagttccttatagatgctagatactagacctttgtcagatggataaactgcaaaaattttctcccattctgtaggttgcctgttcactctgatgatagtttcttttgctatgcaggagctctttagtttaattatatcccatttgtcaattttgactttccatgcaattgtttttggtgttttcatcatgaaatctttgcccatggttgtcctgagtggtactgcctagattttcttctagggtttttatagttttaagttttatatctaagtctttaatccatcttgacttaatttttatatatggtataaggaaggggtccaaattcaattttttgcatatggctaaccagttctctcgcaccgtttattaaatagggaatcctttccccattgcttgtttttgtcaggtttgtagaagatcagatggttgtaggtgtgtggtctcatttctgatttctctattctgttccattggtctatgtgtctgttcttataccagtaccagtgttttgggtactgtagccttatagtatagtttgaagttgtatagcatgatgcccccagctttgttcttcttgcttagcattgtcttagctatttgggctcttttttggttccatatgaattttaaaaccgtattttctaattctgtgaagaatgtcagtggcaatttaatgggaatagcattaaatctataagttactttgggcaatatggccattttaatgctattgattcttcatttccatgagcatggaatgttttcccatttgtttgtttcctctgatttctttgagcagtggtttgtagttcttgaagaggtccttcacttcctttgttagctgtattcctaggtattttattctttttgtagcaattgtgcatgggagttcattcatgattttgctgtctgcttgcttgttgttgatgtatagaaatgctagtaatttttgcacatagattttatatcctgagacttcgcttaagttacttatcagcttaagaagcttttggggttttctagatatagggtcatgtcatctgcaaacaaggataatttgacttccttaattcctatttgaacacactttatcttttctcttccctggccagaactttcaatactatgttgaatagaagtgatgagaggccgggcgcggtggctcacgcctgtaatcccagcactttgggaggccgaggcgggcggatcacgaggtcaggagatcgagaccatcccggctaacacggtgaaaccccgtctctactaaaaatacaaaaaattagccgggcgtagtggcgggcgcctgtagtcccagctactcgggaggctgaggcaggagaatggcgtgaacccgggaggcggagcttgcagtgagccgagatcccgccactgcaccactccagcctgggcgacagagcgagactccgtctcaaaaaaaaaaaaaaaaaaaaaaaaaaaaaaaaaaaaaaaaaaagaagtgatgagagagggcatccttgtcttatgtcgattttcaaggggaatgcttccagctattgcccattcagtatgatattggctatgagcttgtcaataatggatcttattattttgatgtgtgttccttcaatacctagtttattgagagttttaaacataaagggatgctcaattttattgatggccttttctgcatctattgaaataatcatgtggtttttatctttagctctatttatgtgatgaattacgtttattgatttgtatatgttgaactaaccttgcatcccagggatgaggtcaacttgatcatgatgtttaagctttttgatatgctgtggattcagtttaccagtatgctattgacaatttttgcatcaatgttcatcaaggttattgagctgaagttttctttttttgttgtacctctgccaggttttggcatcgggatgatgctggcctcatagaataagttaggggggaagtccctcctttttgattttttggaatagtttcagtagaaatggtaccagctcttctttgtacctctggtagaattccactgtgagtctgtctggtcctgggctttttttttggttagtaggctatttactactgcctcaatttcagaacatgttattggtctctcagggattcaatttcttcctggttcagtctttagagggtgtgactgtccaagaatttatccatttcttctagattttctagtttatgtgcatagaagtgtttatagtattctctgatgattgtttgtatttctgtggggtcagtggtgatattccccttatttctgattgtgcttatttgattcttttctcttttctcatttattagtctggctagtggtatattttattattaatatttttttcaaaaaaccagctcctggattcactgattttttgaagggttttttgtgtttctatctccttcagtttggctttgatcttggttacttcttgttttctgctagctttagggtttgtttggtcttgattctctagttctttcagttgaaatgttaggttgtcaacttgacatctttctagctttttaatgtggacatttagtgctatacattttcctcttaacactgatttagctgcttttcagggattctggtacatcgtctctttgttctcattagtttcaaagaacttcttgatgtctgccttaattgtattatttagccaagaatcattcaggagtaggttgttcaacttccatgtagatgtgtgattttgagtggatttcttaatcttgagttctaatttgattatgctatggtctgagagactatctgttattatttcagttcttttgcatttgctgaggcatgttttactttggcttatgtgatcgattttagagtaaatgccatgcagtgatgagaagaatgcatattctgttgtttttgggtggagggttctgtagatatctatcagattcacttgatccagagctgaatttaggtactttgttaattttgtcttggtgatctgtctaatattgtcagtggggtgttaaagtctcccgctattactatgtggaagtctaggtctctttgtaggtctctaagaacttgctttatgaatctgggtgctcctctattgggttcatgtatatttaggatagttccctcttgttgaattgaacactttaccattatgtaatgcacttctttgtctttttttttttttttttacctttgttggtttaaagtctgttttttcagaaaccaggactgcaacccctgcttatttctgttttccatttgttttgtaaatttttctccattcctttattttgagcctgtgtgtgtctttgcagatgagatgggtctcttgaagacagcatactgatgagtcttagagctttatccagcttgctattctgtgtcttttaattgcgggcatttagcccatttatatttaagattagtattgttatgtatgactttgatcctgccattatgatgctagctgattattatgcagacttgtttgtgtggctgcttcatagtgtcactggtctctatatttcagtgtgtttttgtagtggctggtaacagtctttcctttccatatttagtgcttccttcaggagctcttgaaagacaggcctgatggtaatgatttccctcagcatttgcttgtctgaaaaggatcttatttatcttttgcttatgaagcttagtttggctggattaaaattctgggttggaaactattttctttaagaatgttgaatattggctccctaattcctctggcttatagggtttccattgagaggtccactgttagtctgatgggtttccctttgtaggtgacctggcctctgtctctgactgcccttaatgttttttcatctatttcaatttggagaatctgataattatttgtcttggggttgatcttctcatggagtatctttctggggttccctgcatttcccgagtttgaatgttggcctcttgtgctaggttggggaagttctcctgaatgatatcctgaggtatgtgttccaactcggttccattttccttgtttgtttcaggtaccctaatctgtcatgggtttggtctctttacataacccataattcccagaggttttgttcattccttttcattcttttttctctattcttatctgcctgtcttatttcagaaagatagtcttcaagctctgaagttctttcctccacttggtctattctgctattgatagttgtgactgcattgtgaagttctcgtgttgtgtttttcagcttcatcagctcagttatgttcctttctaaactggcttttctgactataaggtcctgtattattttatcatgattcttagcttctttgcattgggttacaacatgctcctttagctcagaagtttgttattacccatcttctgaagcctctttctgtcaatacaaccatctcaccctcagcccagttctgtgcctttggtggaaaagtgttgtggtcatttggaggagaaaaggcattctggctctttgagttttcagctttttttttcattgattatctctcatctttatgggcttatctaccttcaatctttcaggttgctgacctttgaatggggtttttgtgttttgttgttgttgttggtggtggtggtgttttctgtttgatggattttccgccttggcagggacctgggggtcagagtatgtaaaacttctaggtctctgcatgcctgagtggctgctctgccaagactccatacagctctgtgtattggacccaaggccctggtggcctgggctcacaaggggatctcctgattcacagattgcaaagatccataggggaagtgtggcttcctgggcggggttgcacaatcacttaccacctcccctggctgagggtgggagttctcttggttctgtgccactcctgggtaggccgctgcctctccctgcttctctttgttctccatgggtccagctgcttgcctatttatgcaagaacctggatacctcagttgaaggtactgaattcactcatcccttttctttcctctctgtgagtgccgtggaccctagctttctaattagtcatcttgcctccacctattttctcgtccaaacatgcccccatttctttattttaaacatgtagtagaattcaccataaagacaattggaactagagttttatttgtggaaagtttaaaataaaaaaaaaaaggcttttattttgaaataattatatattcacaaggaattgcaaagatagtccagagaggttctgcatagtcttcagcagttttccttattgattatatcttacctaactacaatacaataacaacgccaggaaactggtattgccacaaaatgcgtatatagttctgtgcagtttttatgctgttaatatatagggctattccatcatcacaaaaatctccctcatactatccttttatagtcaccccatcctcttccctctttcaactctaagccatgacaaccactaatctccatttatggcctttaaccttcctcttcttataatacaattatcttaaaaatttactctatataaattaagagctacttcagtgttctaatgtttgcttcaaccttgaaacataatttagaaaactcaagaagttaagtctgttgtatttacttatattcttactcgttctgttgttcttcctgatgttctcagattctatcttttattatttccattatatttcaagaacttcctttagccattctttcagggtaggtctgctggcaacaatttctctttatctgattttgattccccatctaatttttaaagggtattttcactggatggaattttgtattgataacttttttctttctgctcttgaaaaatgttcactatagtgtctgatgataaatccgctgtcatttgaattgttgtcacaaattaattgataatgtattttttccctttaggtaatgtataatttttctctctagatttttttctttgtatttagttatttagaattttttattatgatatgtctctaggaggagttctctgggtttttttccgtttgagattcactcagaatcttaaatctgtgaatttctgtcatttacatttttggaaatttgttagccattatttattttaatattcttctagccttaccttccttctcttccaaaattccaatgacatggatgttagatcttttgttatggtctcacaggtccctgaggctctgtttattttttgccagtcaattttctttttgttgtttggagtgggtcatttattttgttctatcttcaagttcactgattctttcttctgttttctccattctgctgttgagcccatctagttagttttaatttttgttactgtatttttcagctctaaaatttccttttgattttttaatagcttctatttatctattgagactttttcttttctgtcttttttaaaaagtttgtttttatcacgtttgtaattgctcattaaaggatttttattatcactgtttaaaaatccttgtcagagaattttaatatttctgtcatctatcgattgtctattttcatgcaggttgatacttttctgggtcttagtatgatgcatgattattcactgaaacctggacatttttggtgttatgttatgagactatcttaataaattttctgttttagctgtcctcctctgattccactcttgtaagggtagggaattaggaaataatgcccacttatttttgggggaagatgaaattccagtttccccaaatggcctcagttggcacctagggcgggagtactgattccccactatgccttgctaataccactctgcctgagaagaataggaggactttgccacttttccccattcagcctccatgaggccacaggggagatgacctcattaacactgagtgacggtgaatgtcccgactttctactaggtttctgacgctaacccggaggtgaatgaaaagagtactttgttatcacctagtgggtgtggaagtctaggctccctgtgtggtcttcacagacactgtgagagtagacctcactgtgacctcacgaatataaaaatccaggtttctccttggccttctttgacatcactctgacaggtaagttgaggtgattccttccagcctggcaatgataggaatctagattgtttatttgacctgtgttagtgagcgtgaatttgtaggggtttttcttctacggtacttaggtggagtagagtagatattgtctaaaaatgttctgtatttctaggttgtccctttcctgctctttggttacattaactgacttttgttgaaatttcttgttgatcagctcctgctggtgtttttgacttgctgccttcttcaacactaagtttgggatataagaggataaaaaaaattcccaaaactcacgagcataatctttttcaagaccagaggtctctaacttgtcggctttcttctctccatgtttcagagtcatcgtatgctagttttatatataaatgtcctgactgtttagttgcacttattgggaatagtagaaaaaagtactacttctactccatatgtgcagaagtggaatgaaaaacttctgattatggaattcagtttagttaagttgatattctatgcagcttttctctttctccttgggtcagttattgtaatatgaatattttaaggaatttgactatgtcatgtatatattcaaatttgttggaatatagtttttcataaagttattttcttatgcttaaaatctctgccataatgtcgctttttctctaatattggcaatttgtttctctcttttttctagataagtctatgttgtagtttataaattttattaatctttttattgaaccaactttggtttcattgatttttctctattttcagttatatattttaccggtttacactttattatttccttatttctgattcctttctatttaatttgctcttcattttctgacttcttaaggtaggagtttaggccactgatttcacatcttcttttctaataaaaagatttaattcacagatttccctttacacactattttagctgcatccccccaaattttgaccttttcaaagaattttgattcagttcaaaatattttctaaatttctcatctttttttccttttttacacattagttggtaaaatgtgttaatttctaaatattgagaattttttgggtatattttgattattgatttttaatttcattttgatgttttgaattatttctgacaaaaaatctatgataatacttagatttattcttttttgggtgtgtatatatataaatatataaacatatagatatatatcacagatatataacaaaaagatatatgttttgttgttcttgggtaaggtggtctataaatattaattagattagagtggttgatagtgttcagattttctatgtccttatttgtattttgcctacttgatctatcagtggttggaacagatgtgttgaattatatttctacatgtttaaaccccataatacattgaattatttttgctttatactctcaattactatttagagaaattaaaacagatttaaaaaatcctacatacttactattttaagctttattcactcctttgagtagaaccaagttttcattgtgatcattttccttttgccaaaagaatgcccttaactacttgcttgagtgcatgtttgtggctgataaattcttttcactcccacttttgaaaaatgtctttattttgccttttgttttttaaagactgtttctttaaaagtggatttagaattctagatagacattcttttctttcagcaccgtaggatatcattacattgttttttgtgttaaatcgtttctgacacaaaatttatgacaatacttagatttattctttttaaaatattgattcctttagttctgtctggtttttataattttttatcactatttttcagaaatttgacttgctgtgattgactttgagttcttcctgcttgggataaattgagtttcttgtatactgaatttaaaattttaccaaatttggaaacattttcagccattatatcttcaactttttttttttcactttctttcctgtctctcttctatcattttgtgaatgtttatataatatataaatatatttgtatttggcatttcttagaattgtctgtactccagtatgcatagtttctgttgttatatattgtcgtttctcatttttcctgaagtgtctaatgtgctgttaatcataccccatgaaattcttatttcagatattatattttttatctccaacagtttcctttgattatttttatatattctatttccctatttactagacttatgtttttctttatattcttaaaattatcctatttatatttataaaagcttgtttagaattattcttcgtaaattctttcatcactgtctttcttggatctgtttatattgattgattttttcctgtatagtggttaaattttctgcttccttacatgtttggtaatttttgattggatgacaaatatttaaatttttacatttttgagggatttaaaaaaaatttatttaaaatgtgtatgatcttttcatgacagtcttgattattacaggccatgtttttaagctttttgaaggtggtcctggtatagcttttattctagggcagtttagtctcactattaaggtgtgacccaagggatttcttgtgaatgttcgtatgttcaatgaggtctcttcactctggctggtggaaactcaaacaattcccagccctgtgtgaactcagtgaattgtttagtttacagattcttgatatttgttctttcccagcagtagttcttctctggcctcctggaatgtcactttatgtgtttgtaaattggcattcagccaaagacttaaggaaaaccctatgcatatttctgtagttctttcagtatgtaaccctttctatgcctaacccatcctctggtccacaatttctaaccctcgtggtctccctgaacttgaatctttttcccctcagctctgttaatattatccttgcttgtgctatggtccagaaattacctccaggcaaaaagctcgggtgatcgtagaactcacttcattgtttatcctctcaggaattacctcctatattgcctattgtataattcatgaaaaacagttgtttcagtatttgtctacttgtcttgttgtccaatctcgtaacagttactcctttatgaaaagaagtgaaggtttgtgccttatgcatagttaatgtttaccttatccttctcttcctctttattcctaaataatgctcttgggtttttttcccctcatccttttaaatctatgtaaaaatatcatatgtgctacttgcttatttcatttattctatgctaacatgttttactggttacttacttacttgctacctatactggacacatcttacacatatttcccaccacatttttttgctctttatagtaattctttatatgtttgaggtttaaaattttcaagtacttattaagaattgtctggacagctagtttatgatagatttctccataaatatacacatgtggttattttcttagatataaggaaagaatatctttaaaattttttagtcaaaaaggtccctggtacatgatgagactcgttcatttttcatttttggtcaagcattattggcatgatctcttcctacagtggttcttcaggtcaaagttactttgtaatattgttctgagtctttttttgtgtatataaatgattttctcaagctgattgaaattttggaaaaaatgctatcctaggtattttattatgtatttactaaatctctttggcctggctggatgcaattgtgagaataaaactaagcttgagttacccttttgctattatactctaccttcctttacagtgatctgctggcctccctgagttctgatccctttttttgagatgtttaaaactctctttgcttattttgttccttgcaaagtaaaattctgacttgggttaagggtgaagttttcactgggctattgtactaaaggagtgaatgttttggtgaagctcaaagaggttaaaagcttctgtttcttcatggtgtgttctgtttggctactcctctcaaagggtttacatgaagcagacatgataaaacagcccaaggtgcttttttcttgggagagccttatcaaggagattgtggtagctggcttagctctgtttttctcttattgaaattttccttgagtttatatatccttgattcttcctgatagagtggaaaaatgcaaagggtcaagatatgggtgcaaatttaaaggccaaaaacaccattagttacaaatggccaacaaatatatgaaaaaatgctcaacatcactaatgatcagggaaatgcaaatcaaaaccacagtgcgataccactttactcccggaagaatggccataatcaaaaaaccaaaaaaacagtagatgttggcatggatgtggtgatcagggaacacttctacgctgctggtgggaatgtaaactagtacagccactttggaaaacagtgtggagattccttaaagaactaaaagtagaactgccgtttgattcagcaatcccactattgggtatctacccagaggaaaataaatcattatatgaaaagatacttgcatgtgcatgtttatagcagcacgattcacaattgcaaaattgtggaaacaacccaaatgcccatcaatcagtgagtaaataaagaaactgtagtatatatacaggatgggatactactcagccataaaaaggaacgaatttatgcatttgcagcaacctgggtgaaattagagactgttattctaagtgaagtaactcaggaatggaaaccaaacatcatttgttctcactgatatgtgggagctaagttatgaggatgcaaaggcataagaatgatggactttggggacttggggggaagggtgggagggggagagggataaaagactacaaatagggtgcagggtatactgctcgggtgatggttgcatgaaaatctcacaaatcaccagtaaagaacttaacttgtgtaaccaaataccacctgtatcccaataacctatgggaaaataaaaaagtaaaaaggtagaaaaaccagtgaattaaaaaaaaatttggtaataaataccaaggaactcaaaaaaaaaaaaaaaaaaaaaggcttagaaaagtctttaccaaagcagttcagtgtctcaccagagctggctgttttacataagattttgacttcaatgccttatagtactgaaaacatacattgtcttgagtgtccactttctgaatcttcataaactagtgctggtggtagcaggttgcctgaagctttagcattccttaactttgtttaccttaacttttcttttactatgaagacatgggtaaattttagcatagtttgacagattgtagttagaatgttcaagatccacatatttaagaaataaagttcctcataaagtttaaaactgacatcaggagcagcttctgctgttaatactacaacttgcaagtattgtaagtgctaggtgtagttagtaaaatctggactgatgaaaatagtgattctgaaattttaggtcaaaattccacgtggaaaaacaagtttgacaatagagaatatctttatctctgcctcttgctagtagaaaactggtactagctaattattttgggggacaaaaaatctcatctcaaaacaggcagcactttaatatgttacactttggattttggattgatggtgccatgagtggtggattgtacagaaattgatcaccaggattattttctttcagtttcagcttcaattttccttatgtgactacaattggtatccacctgtcaacatctaggaccaaagaggcaatcaaacaaggaataaattcctaatttctctcattcctcaacaggctattaatttaactctgatttatttcttagatattctctaatttctgtaattgtgtgtatgattatatccaaagagaggaaaaaaatgaccaagtggtgccgatttgagggattgacatgagacacccaaggcttttatttttggtcagggatcgtcagtggatagtcatgaagtcttactcccagttgtcatttcaggaatttagaatagaggtcagtcactgctggaaacaaacggaattagagattagtggtgtcaccaatgcaaattctttaaaaaagaatttgtgtgtgcatagtaggtgcatatacttatggggtacatgagatattttgatacaggcatacattgtgtaataatcatctgggcaaatggggtatccatcatctcaagcatttatcctttgtttattgttacaaacaatccaattatacttttatttttacatgtacaataaattattgttgactgtaatcactctgttgtgctgcaaattctgactttaaaagaaaaatagtttatttcagatgccaatttctcacctctcaataaaattgctctctcagataaggtgaatgcaagaacagagtggtagcatttacctctttttaagaaaaaattcaactatttatttatttgttttttaaatttttgtgggtaattataggtgtatatatttatggggtacatgagatgttttgacacaggtgtgcaacgtgaaataagcacatcatgaataatggagtatccatcccctcaaacatttagccattgagttgcaagcaatctaattacactctttaagttattgaaaaatgtacagttattattgactatagtcaccctgttgtgctatcaaatagtaggttttattcatctgtcaaactatgctaaatttacctgtgtcttcatggtagaaaaaattaagataaacagctctttatgttcatgagttcagttgtgatttttagatcccatatataaatatgggataacatacattgtttgtctttcacaactggttgctcatagtaaccaccaatgatgctttgaatttcttcgatatcagttgtaatgtctcctttttcatttctgattttatctatttagacctctcttttttcttatttagtctgactaaatgtttgtcaattttgtttaacttttcagaaaaccaacttttcgtttcattgatcttttgtgttgtttttttcaatttcatttatttctgctttgatctttattattacttttgttctactaattttgagtttggtttgctcttgcttttctagttctttaagacacattgttaggttgtttatttgaagcttttcctctttttttgatgtaggcacttactgctatgaacttccctcttaatactattttttgctgtatcccacaggttttggtatgtttggttcccattgtcatttgttttaagaaatttttcaatttctttcttaatttttttattgacccactggtcattcaggagcatattgtttaatttccacatacttgtatagtttctaaaattcctcttattaatttctagttttattccattgtggtcagagaatgtacttgatagtatttcaatttttcaaatgttttaagacctatttgtgatctaacatgtggtctatccttgagaatgatccatgtgtggagaaaaagaatgtattctgcagctcttggatgaaatgctctgtaaatatctgagatccatttggtctgtagtgtagattaagactgatgtttctttgttgattttttgtctggaagttctgttcagtgctgaaagtgtggtgttgaagtctctagctattattgtattgaggcctatctctctctttagctgtaataatatttcctttatatatctgggtgctccagtggtgggtacatatgtatttaaaattgatatattcttttgctgaattgacccatttatcattatatagtgaccccttcttcttatagtttttgttttgaaatctgttttctctgatataaatacagcaactcctgctcttttttgctttcctttagcatgaaatatctttttctacccctttattttcagtctgtatgtgtctttataggtaaagtgtgtttcttgtaggcaacagagcaatggatcttgttttttcatccattcagccagtctatgtcttttgattacagagtttagccatttgcattcaatgttatcattgataagtgaggacttactactgttattttgttatgtgttttctggttgttttgtggtcttctcttccttctttctttcctgtcttcctctagtgaaaatgattttctttggtgatatgatttagtttcttgttttttattttttgtgtatccattgtatgttttttggtttgaggttaccatgaggcttgcaagtaataacccattattttaacctgataacggtttaatactgcttgcataaacaaacaagcaacaggaaaactataaaaactcactttaactctatcccccacttttttaacatttgctgtttctatttgtatcttattgtactgtgtcttgaaaagttgctgtagttattatttttgattggtttattgttcagtctttctacttaggaatgttggagtagttttcacaacacagttacaatgttatagtattctgtgtttttctgtgcacttattattaccagtcagttttgtaccttctggttattattgccaattaatgtccttttcttactgattgaagtactccctttagcatttcttttaggatgggtttggttttgatgaaaccccttagcttttgttactctgggaaagtatttctcctttatgtttgaaggacatttttgctggataactattctagggtaacaaatttttttccttcagcacttcaaatatgtcatactactctctcctgagagtctttagtaagtaaggtttccattgaaaaatctgctgccagatgtgttggagctctgttgtttgttatttgtttcttttctcttgctgcttttaggatcctttatttatccttgtcctttgggagtttgattattaaatgcattgagatagtcttccttgggttaaatctgcttggtgttctataaccttgtacttggatattgatatctttttctaggcttgagaagttctctgttcttattcctttgaataaattttctacccctgtctttttctctaccttctctttaaggccaataactcttagatttgctcttttgagggtattttctaaatcctgtaggcatgttttatgattttttttcatttttctcttgtctcctctgactgggtattttcaaattgtttgtcttcaagatcattaattctttcttctgcttgatccattctgctattaagggactctgatgccttcttcagtatgtcagtagcatttttcagctccagaatttctgcttgattctttttaattatttcagtctctttgttaagtttatctgatagaattctgaatttcttctctctgttatcttgaatttctttgaattcctcaacagttactttgaattctctgtctgaaagttcacatatctctgtttctccaaggtcagttcctggtatcttatttagttcatttggtgaagtcatgttttcctgaatagtgttgatgccagtagatgttcttcagtgtctgggcattgaataattaggtatttattttagtcttcactgtctgggcttatttgtagccatcctccctgagaaggctttcagatatttgaaagaacccggtaacactgtggttcttgcagacttgtagtggtgccaccttaatggtctcagataagaattaggagaagtctctggattaccaggcaggaactctcattctcttcccttactttctcctaaacatacagagtttctctctctattgtgagccatctaaagctaggggtggagtgacacaagcaccactgtggccaccaccactatgactgtgctgggtcagacctgaagccagcacagtgctgggtcttacccaaggcctgctctaaccactccctgtctactgtccaggtttgttcaaggtcctgggactctacaatcagcaagtggcaaagtcagccaggactgtgtccttccctccagggtggcgaggtccctcaggccctgggtgggtccagaagtgccgcgagtcggggactagagtcaaaaaccttagaagtccacctggtggtttattgtattgtgggtgagctggcacttaaaccacaagatggggtccttccctctcttgccttccctttccaaaggcaaaggagtctcagcccatagcaccaccaccctaggccatgaggagtactgccagactaccaccactgttcccttaaggcccaagggctcttaagtcagcttgtggtgaatgctgcatggccttggcctcacccttcagggcaatgggctcccctctgaccccgggcaggttcaaaaatgccatccaagagtcaagtcctggaattggggaccccaaaatcccacttggtgctctgctcccttgtggtggtattgatacctaaaatgcaagacaaaatcccctttacttttccctctgcttttctcaagcagggggagttttgccccataactccacagctggtaatgtgctgagtctcacatgaagccagcaagtcccagaggctcaccgtggcagttgatgtactatctgggtatcgctgttggttattcagggtccaagggctcttcagttagcaggtgatgaatgctggtagcactaagtcctttcctacaaggcagtgggttcccttctgtcctagggtatgagatccctggaaagggggcctcacgactctgaccgatatcctatcctgttgtggctaagctgatatctaagatgcaaggcaaagtcatctccagccttccttctcctttcctcaagtggaaggaaggggtctcttttggagctgtgagctgtgcagtctagggttgggggggctatgatgccagcacttccttggctgacccagctgatatctcagtatgtcgcgtgctcccacagtctatagtctctgggcctagttcagcctaggactctccgaagggttgcagtccttatggcccagactgcctttcaagtttacttagacaccaagcacaccttgatcctcagtggtgaggtttgccagcactcaagtttggacccctggggtgaacaattcccctctggctaggactggtttaaatgctccctctgtgggtgtcagctgagattggtctgttttttctttctgctctgacaggacagcactgagttcagtgcctcacaattgctgtgttctcttcccccagcacccagagagctctccgcaccacactgctgctgctgctactgagggagaggaaggggtcacgtctgagattcaggattgttttatctgcttcttcagtgcctgtttcagtgatatgaagttaaaaccaggtactgtgagtgctcacaggatttttggttcttaggatgcgtttccctgtgtcgatagttgtattaagccatcttgctctgcttcctcctcttttatttattttttaaaagatttatttattttaaaaaatttttaaataatttttatggatacagagagttgtatgtatttatgggggatatatgtgttattttgatacaagcgtacaatgtgtaatgatcaatcagagtaattggaatacccatcagctcaaacattaatcattttgttgttttaggaacatgccaatttcactcttctggttattttgaaatatacaatgttattgttagctaccctactatgctacagaacactggatcttattcattctctttaactgtatttctatacctattaaccagcccctctttatcctctgcctcccccgtttctggtaaccatcccagattctggtaactgtcattctactctctgcttctatgagatcagctctttcagctctctcatatgaatgagaacatatgatatttgcttgcctttctgtgcctagctcatttcgcttaatacagtgtccttcagttccatccatgtttctacaaataacaggattttatttattgcttgatagtagatttctccaagtccaagctcctttaagtttatagatgaaagactgtgaaaaactaaggtttcttgtaaaaatggcaacagcaaaaatacagtctttcttttaatcttcaatttcctcttcctgatattttaggatgacagattccctgccattgtgtatatgtggctcaataccctgcatctagatccgtgatggtaaatatgctacatcaatgcaatcactcctctgtttcataactgtgcggaccttgctccctgatcatagcctctgttggtgtcagatgtcagggaggagccctctggctctgagcactgtgtggctcatcaagagacctggtgtgcttaggctcacttggctattttcaagtgttcattggcttgcgctatttatgttagcattttaagcattctatgatcaccagaagatatttttgaggtacaacgattctcaagtccctattttaagattctgattgttagggggttaaattattgaggaagaagatctgtgagaagtattataaagtatttagcctatgtagactttagtgactattatttgacctgaaattaagatgctccttctattattcccaagatgctggtatgcgttatgaagtaaataaaaatcataagggcctgcaaaccgcagtggcttcagtcttcaatatgttacttcagcaatttccaggaagccataattacttactacggggaattatagaactagttaaagcattatcacaaaatgtgtgatgtaacatacaccctaccctgcaggtacaaaatggtccagaacctgttctgcaacactagaaccctagtatcttcatgaatagaaagtatttagatgggctttcagtgctgattgtgaagccaggagagttggttaccccagggcttattgcgagtgatgagtaatgcatggttgtttcttgtggtctagatgtggaatgtactggcagatgcaaaggttttctactattcgcatgaggacagtgagatacagaactttcacgacaagtcaggcaaagcaaatttattattcactgatagacagcaaaaacacatagtctaggatccatggtgggctggtcccccggggctcaggaaagctctccagtgtggatagagtcttgtctgtgtgtgtcccatattgtactgaagctgaggtacccgcaaagcacatcatcttgtattttgcgccttgggtatcatttgctccctaagctcaagttttgcagaatatcctgctctagaaggaacatagttctggctattctagcctgtttctttttttcttatgttaatgcattctgcagaaattctacagtaattctgagaactacaagttggagaggggagagctgggtcgaaaaaggccacttgaggacctgccctcctacagcagggacatttgtatctaaagagtgctgcctataggggagcagcaacttggaagaaaaggcctaatacttaagggtcaaggaaggagttgcaagtgatcacccagcctggagaagcatctgcccgagtcaaggaaactttacaagagaaatccccagtgtgcacccctatgaagagcctacaatggtatgtctacaagagtgagtcatccttacttctgccagacccagatagttgcaagctgtctttgctaccatttcaggtaagatatttctcatctaatttcaatgctttgctctttctcatcctgtacccagcccttcactccattcaggaggaagaacaaaccagctaggaaacagggaaggagacaggagggagaaaagtacaagcaggagaaatacaaaataatccatctgtgcctctttctcctattgtaggtttagcctgaagccagcctgagccaagaaaagggagaaggttttgctgtttaatcaaagtagttttgatttatattttgtactgaaagttttattttttgaaattagtctgttggcaacttccaatgtatgtagaaatgtatgtacctaagaatgagcagaaaaagcatgggacatgctgtttatcctggggcaaagaaagattacccccactggatatattttaaaaggcgacaggaagcaaaaaataaagttgtgttttgcatacaacatgagttgtgcttagtcaacacaccataaatagtattaaagggaagaaaactgatgggccgtggtgctaggagttgggcggggggcagcgcagtgtgaagaatgaataaattggaagcgatgcttttgtgtgttggggcctcttggggttgcttttgtccttatgctccctcccatgtgacctgtgggatctgccatgcttaggagcttaggaaggcctctctgtcctggggatgcctgagagagctttctctcatcttaggtctgtcctgatttgctgtggaaaaggtaaaatgacaagggctaatgttcagatgtggcttccagtaaagggactctggtttttgtattatgccagagaaacaacatagtctagtccagtccatgacggttgatcctaagtgcctgggaataaaatcttattgaatttattaaaaccatcatcatgtgcttgaagtgttccttctcctcctgagggtgatggtatcaaatgactgaatgagaaaatggagcaatgggttctgaccagtcctcaatttatctttacttgtgagatggctaatgactttttttagagagaagaaaaaactctcatatagtgttaaatttgttaaaaacagataacctttatagatccttacgtaggatgtgtctatcagaaagatttagaatacttaatgctgtgctgtacttcctttttcttcaacttttgcattatatatcaaactgtttactcagaatagtgtcataacagcaaacgactatctgttcatggaaaggtcaaatttcaagtacgcaaataacctatttctttctcccttctttgctgctgaagtttagcttccttttgtttcacacagtaaatggagttggcatgatttctgtgttgcagggtgcctttctgaatattgtgcaaagtctttgtcctagacagtttgactcaatggaatatcacctttcactcttaacttttcccatacagaaataaggtcaaacttgttttaagctttgactgaattctgaatacaactggtgcttaggagttaaatgaacttacctgtctaaatggcttgaatgagggccacctgcatgttcagtggtttcaggttatctaccttgatattcatctagtaaacctgtctttgaatgtctttccaaaatgctgggaatcctagggcactgtggcactatgtgtgatgtggggtgacatggctgaggatgtgggccttggagggagtcaggtctcagtggatcctggttctactccttgcagagatgtgtgagttgggcagagaacataacttatctgttttctcctttttaaaatgaaaataataccctttaaatttatcgagattaaagagaaagctgatgtgagggtgtagtaaagtgcctacccatagaaaataccctatccatgttagttaataatgaaggtaatgttttaaaagctgtttccgtgagttaattgaattaaatttcttaggatttcagaaccttaaacatacccgactaatgccaagaatagtaaaatgtatttcaagcatgaagtggattcaaaaagtgaattattccgtatttcctatataataaggggcttgaagaaaatggtcaggcagcttttagatttcagagttatgttggcagcgccacctgctgttgaaaataaaaacacttctggaatattttgagaagcaagaaatacaattatgagttcttttctacttttttcagcaaaggtgggccaatctgtcatttctttaactgagaaatttaattttattgaagagctaggtgacaaatacctgtaacattcttttgaagtatcagtcactgtctttaaagaaatgattccctaatgatgtcatcattaacttcttaatccacttagtgactaacccttattatcaagggattagtttctttattttaaggtatcttgatctcacattaaaatgttgaaataaaagactcacatcactctaaatgttgcatagtttttctcgcttagcccagaatcagattaatcaggacacgacattggttggctttttactccattttacaaaacaatctataagttttaggcccacatgaaagaacttttgagtgtgacactgagaacacatacaggtatctgtgtgttatataccctagattgtacccttgctaacaaagggataactcaagccctaaagccacttggggcaagcgcagcatttcggatatctaaccataagttgaaatggttatataataaattctctatcagtcatgtggcaaataaaggaagatctcacatgaaatacatttcccatcatcttttttattgtggtaaaattcacatcgtataaaattcaccattttaaccattaaaaaatgtacaattcagtagaatttagtacatcaacatgttgtacaaccatcaccactctctagttccagaacattttcattaccccaaaaagaaaccctgcacccgttaagcatttactcctcatttccccctcaacccctggcagccacgaatctgcattatgtctcgatgaatttgcctattatggatattccatacaaatgggatcatacattatgtagccttttgtgtcttctttcacaaagaataatactttctaggttcattaatgttgtagcctgtattagttcttcctttttatgggcaaataatattccactgtgtgtatatacatatatactaaaatttgtttatctattcatccatctacagatgctttagttatctccatcttttggctattgtaagtagtgccactgcaaacttttgtgtgcaagtttttgtttgaacacctgttatttaatttttgggggtgtatatgcaggagtgaaattcctgagtcatgtggtaattctatgtttaacttactgaggaaccatcaaacttttctgtggtggctaccctattttgcattcccagcagcaatgtatgagagttccagttttgctgcattttcctcaaagctcttttgaggataaccatcctcgtgggtttaaagtggtctctgcatgtagttttgatttgcatttcctcagtgaccttgataatctttggatgagcttgttggccatttgtagatcttctttggagaaatgtttattcaagttctttgcccccaatgattttttaaaatagcattataaggataagacttgagaggagagaatcgtggttaggctcttcaaagctgttaaaaacaggccgggcacggtggctcatgcctgtaatcccagcactttgggaggctgagatgggaggatcccttgaggccaggagtttgagaccatcctgtccaacatggtgaaaccccaactctattaaaaatacaactctattaaaaaattagctgggcgtggtggtgggcgcctgtagtcccagctgctttggacactgaggcagaagaatcgcttgaacccggaaggtggaggttgcagtgagctgagatcacgccattccactccagcctgggtgacagagcacaacttctgtctcaaaaataaaataaaatagagttgtaaaaatcaaaacctactctggtcatctcaggtgtgtagtgattattataaggctgcatggggaaatatggaagcacgagaaccaatcttagcagtaacgcagtggtgtctcatgaagaaatggaacgcactttactattgttcaaatgttcagcagtcatttgagggcccctgtgcagggttatggtaggcactggagccgtggagaagtgtggcggcctggtccccagaaattggtgtcccttactccctcttctcctgactccatcctattggccccttagcttttttctccattttccctttctgtcttttttgtacttcctgttcttttccttatagttttattgccttgtcaatgtcttgcactgaaaagtctctgggagagaacctgattcctttggttggtcactgtccttcttgaagtgtcttccaaggcggactttttgcaacaggcttcctcatagccataggcctgtgtgtgtagctatagggggtccaatcagatgtagccaggccgatggacagcttattcatgaggaacgactgatcactgtgctcaaacagcagtggaaagcaagacagatgttgagggtgtttcatgggctgtctgcagtgatatttcaaactttcatacatttgcaagaaagttgctactgcaacaagtgtttgccccatacttagtggctacaaacaatacaaatttcttgcctcaaagttctggacgtaagaagcttgaaatgagtcttacagggttaaaatcagggtagtagggcatctgattccttctggaggctccagggcagcatctgtttctggctcttccaggttctagaggctgctgtgttccccggattgtgctttcatcacccaagtctctgcctccatcgtcacattgccttcccctctgcctgaccttcctgtattccttttataaacacccctgtgactacagggccccacctgggtaatccaggacaatctccctatcaccagatccttaacttacccacatcagcagagtccctattgccatgtaagaccacatccagttctcgggattaggatgtggacatcttcgggggagttattatttagtctaccatagggcatactaaaaagcaaacaaacaagcaaacaaacaaaaaaccaaatagcttaggtcaagggattttagtctttaaagcactgaatagaacaattcaaagaagtgaatgtaattgaaagtttctgctatttcttttagcattttatttatcagactgtggtttgcaaacagtgttgttgccttaatgttaacattttggaaatgagccatgaaaggtcgaacacagaataagtattgcttggcaaaattaatgaagtggattacttacaggaattaagcagttctaaaagcaattaggccactccaggggttctttccagcttgtgggttcattaatatttaacaaatcatgctgcaggaggcacagtggattcctccagagcagcatacattagaaggccctctctttctgaaagagtatgcggtatttagtcttagaaattaccttccatagagagttcatttcttaagccattcatttcccacatgattttctgttttcaccagataggcccagtccccaggccgtgaagagatggggtcaaattgtacagttgcccaaggtgttagactggttagaccttttctagagccaagctgtcttagagaaatggggtggggtgtctctacaagagagattaaaacacatcttttttttttctgtttgtttgaaatatttgcctagggagtaggcaggaaatgtcttttacatgaaacactagtatttctctagtgaagcattaatttttatttctgcttatacatcaccccatccccattcccaggaagtacaggacttctaacccaatgtaaatgtttttttttaaattattattattattattatttaaacacacacacacacacacacacacacacacacacacacacactttcttttgtgatcggtcacatttcttctcatcacaccttcacctacttagccccaaacctgttcatgtggaactttcctttcctttgggaggtcgaggtgggcagatcacctgaggtcaggagtttgaaatcagcctggctaacatgatgaaaccccgtctctactaaaaatataaaaattagctgggcatggtggttcgtgcctatagtcccagctactcgggaggctgaggcagggaattgcttgaaccagggaagtggaggttgcagtgagccgagatcacaccactgcactccagcctgagtgacagagcgagacttggtctcaaaaaaaaaaaccaaaaaaaaaaaaaaaaaaaaaaaacccaaaaaaaaagaaagaactttcctttctacatgctctaataggagaagtggttgggtatttggtcgggttcctaatccccatcatgaaagcaaatgaggcctggtggcctcagcctgctaacaatttgagcatgcctcattgtaaaatccgcattttaaaatccttgctttggctataatctatttctccctaatcaatacaaatcaccctttgaaaaactctcagcccattcctcacttcagcccaaagctgtcctagctattttttcactgtatacagtttggtaataggggtctatctcacatctaagttcaaatttccatttctggtgaagaagtctttcagtttctatctttgccactatcttttttgagatctcaaatatattcagtcagagtataagttcaaggcactgactttcttcactctttcagtctctgtttgataaacatggcttttaacacctagcctgagagtgagcttgaaccccacctcatcttcccacccactgtagttgataagcggtcatggcagtgtcatgatagttgccaacatttgtactggaaagaggcctagaggagtgtctccagtgactggcttcctggccatttaacgtaagtttcactgttactgtgctttgggatgtagtcttcagctctgcaatgtcagaaatttggcattatccttgaagctgggtttgaggggactgattcacaaacagaactcatgaaagacaaatatgtaaaaccagaatactagtttattactttaccaaggaaaacaaattactttccagtaaggcaggttaaaggaattacctttagaatcagaccacaatgcctctgagtataacaacttctctaggtattgggttagtcaaatgggaatgagtataatacttacattatggggttgtgtgaagaatgttggacagaatgtaagcaagcggtttgtttggcgtaaaggaagtaactgttatgatcatttatatcattttacaatatgatgtagagagtaattgattaactcccaggtagcagaatcgagctggaaccaggttttctgacatgtgtttctacaagagctttgtgatcatggatctcagcagtttgcttcacactgaaggttctttccacgtccagggctgcccgagattacccatcacactttgccttatatgaaagtgcaaatctcaccttcagaactgaccattcagcagttgtgaagaagtagttctggaatttttatctctcttaagtcattttgctactagatataaaatcttctgatacattgccattttatagggcaacatattttttcttagttcaatatttgtgactaacacgatgtgtggcagttgtctaagttcatggatacagttttagaaatccccacctctcccttctttattgctttccaactaatcttatagacattttttctttaaagtctgcctttttttttttttttttttttttttttgacaaagtctcactctgtcacccaggctggagtgcagtggtgtgatcttggctcactgcaacctctgcctcctgggttcaagtgattctcctgcctcagcttcccgagtagctggaactacagtcacacgccaccatgcctggctgattttttgtatttatttatttatttatttattttttgagaaggaattttgctctcgttgcccaggctggagtgtaatggcgtgatctcggctcattgcaacctccgcctcccagattcaggcgactatcctgcctcagccccctggtagctgggattacaggcccctgccaccacacctcgttaattttttgtatttttagtagagacggggtttcaccctgttggccaagctggccttgaactcctggcctcaggtgatctgcctgccttggcctcccaaagtgctggcattacaggcatgagccaccgtgcctggcctaaagtctagctttaaagtctgacttcagctttgagtcttgcaatagatgacttaggatctcgaaggtggcagtagagaatagtaggaagaaagcaagtgaggattcaggagatatggttctactcctagctccaactattctgcaccttgggccaattgctttctctctgtatggccaatttctttacttgttaattaggaaagatgtttgctttacccatatgggagaaataaatgaaacactatagtgtgttgaaaactataaagtcaatgcaaattattgcagaatgaggtaaccctggcctggttctagccctcagccactcagccactaccaaatctttactctttctgagagcataatcacagtctctaactttaaagggatgatgtgcactctacattacagcatttttgtaaggttcaaatgaaggggacaaaaggacctgaaagcattttgtaaactgcagaataccacatgaatgcaaaggtggcatcacaggactttactgcttccttgctctgtgtcctcaggcaaattgggcacctgtcaggtctccagttctttacctgagggcttatgcaacttttaatcaccgcctattcagaaatctgtttaaactgactatgtatatatatttttatgcaacttttaatcactgtctatttagaaatctgtttaaactgactacgtatgtatatttttcttttgtaaaaaattttaaggcttgtcaagtgtatttttaaaaacaatagtgatacttctgactcttaaatacctttcaagtgcgttatgacaggcttcttctactctaatggcatttgttactaattgcttcatgaaatcgtaatcctttgtttattacttacagaaatgatttccagtcaacattctttgaccctaaagtaagttaaaattcctaaaatattgaacagatcttgaccaattataatttgttttttgtttgtcagaatgggagtgagccatgacttggatggacagggctagggatggaggctctggaagacgttctttgaagtatcactttcagcttactcttctcaccaaaggccatccagcagccctctcctcttccccacagcacacattttgcatttgtaaccagagaagggaatgatgacgtggtagcattgtcctttgagtctcatcttctcaaaggcagaggtcacattttctagtgttgtacctaacctagtttttgtatagttaaaaaaaaaaatcaggcaagttgtcaatgtgaaaaatctttcagcctcgtgtttgtacacataggagatgagaaatgttttaatgtgaaagtaagaatagtggcaattcatctccttcctgttcctaggttacagctgctcagtaaagttgggttgcatctcaggaacagagagcaatttatttctacagctgtgtgaaatggggccagcttgcatccatggaggcagagatgccctcaagtttttggcttatttttagttcccttatatcaatgtatacacgtgtgataatatagtgtagtgcatccaacagcattttttaggccccacatttgggatttcagatggcagcagcaattcttattttttggttaaattttgtggaagtctaacaaatggattctctgagtcattgaaaggtatgcttaaaaacaggtactctgtataaaacagctggtcaagtttttggattagaacctttcaatcaagtaacatcttgggagactgtaggagctgtacaggccacttggtggtgctcatgacagggcagctctcttccaaaggatatgaatcttcacagttgtaacattttagttctgctttactgaacagaaagcggttccattccaaatttgatcctaaatgcgaaaccacagtgtgctataaaacattgaacattcctgcaaaaacagacagaggtggagtttgtttgcacagatccagaaaagtcttctgtcaacaacctcttctcacagagaatcgtacatctaatgtgtggctaaaaggcatttggatatgtcaagtccaagcaaaccgtaactagcattctaatgaccttctattgttagataaatgataacattatagaatgaaggtcacaagggaaaaggaacatattctcttcctcactcagtaaatttatgacagcaaggatccagaaatcctagggaacacaggccaaatacaccttttgcatgaggggtctatttaacaaaatgaaatgagcacagcagggaagtttttttaaaaaactttgctttatttataagtaaacattggacaccaagatttatatatcatgtatgacctgtacataccttgagggctgtttactgtaccttgtctgtctttatgttgttagttaaacagtgagtcataaaaatgccccaataacacattttctatcaactgtccaggaaaatctagttcctttaccacacagaagcaaaagtgatattctttaaaaggaaaaccagataatgtccttaaaaaatggcttcccaatggtttatgatgaaatccagactcgattaggctgacataacatgcctcttgctcatttctctgccttcatctctcagaatgcttctctccattctctgggctccagggtcctgatttcttgaagctcctgcaacctgcctggcttcttctggctgcaggatgtagacacacgctcctcactcttccctggtttgccttgcccaggtctgtctctgaaccatcctctttatcctccagttttcaggtgaagtgtgttcttctcatagaagtctttcccgttgaccttatcttaagtggttccctcgttatttctggacctttatttgttttattcatagtatttatccagtcattaaagtttgtcctttgttgttgtttacttatttttaaaaggaattttatctgcttgcattcaaattgtgactctaaatattatgaattagggactctgaaaataatgtgacttctctaaaactcagttttctcatctagaaagtgagcttactatttacctgatagggttgtttgtcataaagaattaacacacgaaaacaagcaaagtgtgtagaacctgtcctagtacataataaaatatcaatgcatattaactattattagtgctattttaatcaacactgcatctgggtggtagaacattcctcccttgctaattgcaccttcttctcttttccttcctttagggagggcttccctgactatgcttcataaactcaggccaggccccctagtattccattccctgtcccattgccctgcttaatctatctccacagtatttaaaattttttgtatatatttatctgtttttattgatgatatctctttcccactataatttaagctccatgaaagaccctatatttcaagggtccagtagaggcagatattatgcactcaatgaatatctgttgcattagtaaataattgagaaatcattgtcattatcaccatcatcatttttcctctctaaaaagtaagcagggattgtacctgcctaccttatgtgtacattcctgacgtgaatcatagttcttggcaaaaagtcctctgtcaatatttgtcaaaggaatgaattttttcttttttctttttttttttgagacaggactcttgccctgttgcccaggctggagtgaggtggcgtgatctcagctcactgcaacctccgcctcctgggttcaagcgattctcctgcctcagcctcccaagtacctgggactacaggtgcctgccaccatgcccagctgatttttgtatttttagtagaggtggggtttcaccatattggccaggctagtctcaaactcctgacctcaaatgatccacccacctcagcctcccaaagtgctgggattacaggtgtgagccactgcacccagcctaggaatgaatttttaaaatgtgaaaaaattgtgttttgagactttgccaaaatcatacacacaggaaatcttagcaatcaacacattagtgattatcactctgtattgatggtaattatggtattttgtggttaaatcaattttataaaggactacatcaatttttgaaatcctgttacttaaattttattttgttgcttatccttgcagtccaattcgtatacatataaaggcattccctttctgtcttacgtacttcgaatgagagatgacaccatgcatatggtacttctatcatgatccaatcagattatgtttaccaaggacttggtacaatgtccatacctccatctttattttttttccccttagtttttcaaatctctcaaattgatttgatataagtaataagttcagtcactagacatctgttgaacatcaaacattttccttttcatcttaaagatatcttggcaagtaaaatatacttttctctatcaacattttaagggataccgctagcaccaaacagataccatttccttttactctgcaaagactgatggaagaataagaagacactttctttgccccctagaaccttcagatctattggtgggcattcagatacccacaaaaagagagttaaacatgttaagtggaacactgaaggagctgaagagtcaaaagaggaagtaggtgctaaatagttcagaaaaggaagcagttcactggttctattgaccacagtttgccattcttgaacagggttgccaacgtctagtgtttgtattttgttgtctgactctacaagttccagaacttcttttataaatgatgtatgggcataccttggagatactgaagcttcaggtccagaccagtgcaataaggaaatataaaaagtcagtcacatgaatgttttggcttcccagtgcatattgtatacactatattgtagtatactatgacttcctccactgaagtcttgaacccctcaaaggtcatccatcaaagttagaatcaacttctttcacactcttgttaatgctgatattttgaccttctcccatgaatcatgaatattcttaaaggtgtgaaaataaaataaaatattgggatgccatactcactatgccaaaaggaaaagttaagcttagaaactgagtctccaaaaaaactgcctttccttttgttcctgaacctgcaagatagaagatcacatatcttcccaggtggccttcctcagcctgacaaggtaaattaacagcttatcttcacaggtatggaacaaagacaggtataggacaaagacatatttgacagcttggcttcctttactgtttatttttatgttgtgtaaaatgccgacttactgatgcataagacaaatgtttaattgactgctcctctccctcctcctttcacatgtaacatgtggattcggtaaacacttatcaaagcctcacaacaatgtgaccgcttacctcactttataccctccctttttttttctttcttccttccccttctgcctgctctttcccctttaaatattgaaaccctcaaaatcctctttataaaaagtgtgaaccacagatcctattgtgattttgtgtcttctcccaggtatgtcctcaaccttagcaaaataaacttctaaattaattgagacctatctcagacactttgttttacaaagccatctagcatgctgaatcctttccagaaggtgttcaatttactttgcccagatcctcagagaactcactatctatcgagctacaggcttacaaaatgtatttcttaaataaaacttgaaaatcaaatgattctctgacgtatgggctacagataggatgttgtgtttgcaggcatgaaaacaacattaacctcctcgtgtatctccattagagctcctggataatcaggtgcattgtcaacaagcagtaatattttgaaaagaatcatctttttctgagtggtagctctcaacagtggatttgaaatattcagtaaaccatgttgtaaacagatgtgttgtcatccaggctttatttttccatttgtcgggcacaggccgagtagattcggtataattcccaaggactctaggattttcagcagcacagatgagcattgacttcaagtcatcagctgctttccctcctaataagagagttggcctgtcctttgagggtttgaagccaggcattgacttctctctagctatgaaagtcctagatgacatctttttccaatatatggctgttttgtctgcactgaaaaactgttgtttagtgtagccaccttcatcaattaacctatctagatatacataactcgctgcagcttctccatcagcacttgctgtttcaccttgcttttttatgttgtggaaatggcttcctctccttaaaatctcatgaaccaacatctgctagcttcaaactttgcttctgcagctgcctcatctcttcgccttcacggaattgaagagtgttagggccttgctctagattaggctttggcttaagagaatattgtggctggtttgatcttctatccacaccactcaaactttctgcatatcagcaataaggctgtttcactttcttatcatttgtagattcactgaagtagcacttttaatctctttgaagaacttttcctttgcattcacaacctggctaatgatgcaaaaggcctacctttcggcctatcttggtttttgatatgccttcctcactaagcttaatgatttgtaacttttggtttaaagtgagagatgtgggactcttccttcatttgaatactcagaggtcattgtagggttattaattggcctaatttcaatgttgtggtggcttggggaatagggagggccaaagagggcagaaagacagggaagtggcggttcagtagaacagtcagaacacaagcaatatttgttaagtttgctgtcttatatgggtgtagtttgtggtgccctaaaacaattacaatagtaatatgaagtattgatcacaggtcaccatcacagttaataataacaataataaaagtttgaaatattttgagagttaccaaaatgtaacacagggacacaaagtgaacacctgctgttggaaaaatggcactgatatccttgctcatgtagagttgccacgtatcttcaatttgtaagaaaacacagtagcttcagagcacaataaagcaaagtgcaataaaacaagttatgcctgtagtattactttcttaacttgctctttaaatactttgaagaattaatgcctttactatatttgttgcttatggcattttgattcttcaggctagtcaagatctttcacctgaactatatcctctcttccgaatattctttcccagcatgatgttcctatttgattctcactgtcagacatagctgatatggcatagaaacctctttccggtttttttctaccttttaccttctcttttaccttcattccaagcccactgttgtagtcctaaaggtgcctttccttctcctttcctcatttgagtattttatttctgaatcccatcctttattttttcctaaaaatcttgatctaactgacgtaacttattttactcttactagaaagaaacatcattaaaccctgtaactactaagaaagacaaaattgattcctcttggaagtcaatgcatgaagaaggagaagaaaagtttttggtgtttatttttattcttcaaaaaaaccccttggattcttataggaatctcagttttctgattgtgacaacattttccagatccttgatatgtatcttgcacaagatttagaatttttttttaaagaactagtcagtaatatgaaagaagcaaacattttttacataaaattaaaatattttcaaaatttaactgtattatgtatacttaagatttaaatagtagtattaacatttttaggcataggttgagatagcaaatgaattagtttacttctttagttgagtttacttttcaacattagaaatgatcaacatttctgggtttataagttggttatgattataaatgcttgaaacaatatgaagaatataatttattttttatttaaatagtaccattcagtgcagagtgctttgagtggtttaggcctgtttgcttttagagagaactttgcatttctcctggtattctttgcagctgcttcactcttactagtgagaggatattttcaggctgagctgaatgaacatcttttctttttttttttttttccctgtgtcttccaggctggaatgtagtagtgcaatcatggctcattgcagccttaatctcccgggctcaagtgatcttcccacctcagcctcccaagtggctgggtccacaagtgcatgccaccacacccagctaattaattattttattttattttattttttggtagagacagggcttctctatattgcccaggctggtttcgaactcctaggctcaagcaatcctcctgcctcaccctcccaaagtgctgggattacaagtgtgagccactgcacccagcctgagtgaacaccttgaagacaagtgtgctaccattgctcctagtttgtgcaggctgtccagtggggacagtgatctagattgatggcaggcatcagcaaaggctctgctgtgggttaatttttgccctatacctttttgtttgtttctgccaaattatattaccttggaaataggaactaaaaataaagaattcatttcttcttgacctgtctcagaaggaatttggcttgtatttctcaaggagcagagggtgggttggtttctctgtaagccaaaagataaaaaagaacaaagggacatggctcataccttggaaggccaacaaaaataactaaaatgctcactggattagagctttgtaaagtcatactaactgatttcttaaaattaactacaacttaagatggtgagaccaaatgagaaatgcctcctctgtactaagagccacagggctttttatatccttctttccttcttgccgttcccatgttggtttctgttgtgtctcgacttcgagtaccattgtgatgagactgaactaaatgtgccagttgtgcactcaaagcctcaagtggttttgcttcactgctgacaataaaatgaaacaacaacaaaaaatgcctaaaatactttacattaggcctcttctaggttgtcatctgagccagaaaacattgtcagaacagtggacattttcatggtgccattttcccaagtggaaaaccaaaggggcacacagcagccatttgagatgttgtgagatggggcatgaagatgactgcacttttcagcatctgtgctgtgaaacatctcctccgaggctggtggcttatttcccctgtctctctgttgtgggtttgggggcaggcacagccacttcctctgctccactacctcttcccacaccctttttattccttctgagctgcttccctttttgatatccagcttcctctttctcctggtgcccctacctaagggtaattcctcccttcccccatccataatgtgtgtagctaagtaccgacagcatactcacactttgttaaaatttgaaaatattatttttgttttatcagaatccctccccattatggagtccgctgcttttaagttatttataaagctgttgttgaaatactaaaatgtccggtcacatttgattctaccttaaaataacctatcacttttgttgatccctttttcgagtgtgaaggtaagaggatgtgctgcactcttggctgggaaggtggtgctgcatgttgtttatgcatgtttacacttcaatagtcataaagatcttcatcaaaacaaacttgttttctgcttaaggaagaaaatcaacattttctgataaacaaaaatgcgaatatacattatcctgtggaggattttctcacctttatgtgtggtgaattaattctccctatggatgtacacttgcagtcctgaaccacccatgccccttctagaaaacattggatgctaacccatctggcagggaggaatggattttgccctttgtgtgtgtgtgtgtgtgtgtgtgtgtgtgtgtgtgtgttcatcctacagtaaggttataaaggaaaacaatgactccctaattaaggcatattcttgacaaaacttggacccaacccttaaacccatgggctacttcaagattacactcccatagtggtaactccgctcaaggggcctaaggcactccatccgccagggtgtgcagctgccacaccactccctctgcatttgacaaggaaatggagtggggtcttcctcccagtgtcctctccccccagcacatgggtggctcaaggcatttattttgcatctctgacagtacttacttatgtacaaatattcaagatccagttgtcaccaagggggaacacgttaaaatgcagatgcctgggaggcctacttttaattgcttgggtttggagtaacacccagatgactcgctattaccaagcaccgctgagtgtttgactcacagaccacactttgtgaaaacttgactttgtaaaaaaaaaaaaattaaaaataaaaaatccatcatatttcccagggactaaagagtaagcaaagcaataaggacatatatttaaaatggaaatataatacggagacctcctgtgtatataaaagattataaaaatcaagtaatgaatttatatgctaagttacaacaattccaaacgacaccatgtgaataatgcacatactcacaacatgatcagaattaggagcagtctcaggctagctctgatttttgtaacttccttatagagttcagccttgtaagggctgtgatgatgtaaatgttaactgtgccaagattctgcctctcccaggtgccaaggtcatgccagcaggtaaggacatatttaggctacactttacctatgcttagtctcttgagaggcagggagcaggaagaaagtgctctatttagagagatgtagacaagatatgaagaattactcatctgtagacaatgaaataatcaagttaaagaatacacagcagttgaataactctaaatttacagagtgtgttcaacaagcatttactgagtatttaaaatggttgagcatttcagtgtattttattcctttggggtgctactttcccttttcctgtgttttattttttattttatgtaaagcaagggtctcactctgttgcctaggctgcagtgcagtggcacaatcatagctcactgcagcctcaaactcctgagctcaaggaatcctcctgcctcggcctcccaagtagctaagaccataggtgttttccaccactcctggcaaatttttttctttttaatgtagagatgggatctcactatgttgcctaggctggttctttttcctgtttttctttccttattattattattttttcaaactgaggatgtctgatattgcctccagttctcttggtgtggttttatctctaagccaagccccctctaggagccctcactgggtagatctccattttgtctacaaacatcagcttcctgtattccctgaccctctccctctcctgtcattgtgttcagagcatagagaaaaactatgaggttcctcttctaaaatgtaagactcccagtgtgggtcctctggccctaaattaaacccctctccattctggcattgggaggccttcctcacccaaagatttcctacctgaagacccaaccaaagccagccagttccaagtcgtgctcaggtacatagatttatacagagagaaaagtagtagaggtaaaatctaaatgctaatatttgtatacccaagaaaaggaattcaacacctactgagtagagaaaacctaccagctacttggcaacataatatgagatgtcattctaaatttagaaaacatccaaaatatatgaagaacaccaataccataaaagagaaaaaccgataaaaagaacacattccaatagaaacagagataattcagtaaacagaggataatgtcatacaaaaaaattaggaaactataaaatgttagaggacaagaacaaacttgtagacattaaatatgcctttactgaagtaaaatattctgtagaagagtttgtagataatgctgatgaaatttcttagaaaataaagcaatgagggaagtaaaggtaactagaaagaaaaaacagagacaagtcaatgttaagagttacaacatggagggtccagaaatggaaaacaaagaaaaacggggggtgaaaatcaaaagaaaagaaaggcaaatttcccacagctaaagagagaactgaggcttcagagtaaaaaagctgctgacaaccagagcaaaggaagaggagaaacacttggattcacatttgtaaaatttcctgcactaaggataaagaggtcttatacacttctagagagggaaaatgctttctacatattaggaagaatcgcaacagcataggaatcctgaacaccagaaaacaacagattaatgcgtaaaagctctgaggaaaaatggattgaacctagaattgtatactcagcaaaactattaatcaagtgggaaggcaaactaaaatgtgtcagaaacacagggacttagaaagtgtaattttcatgtacctatgtttggaagaatttacttgaaaatatgtgctaaggaaagaaagagagaaaagaaagaaagcaagatgaatccaaggagtataataaacagtggcactaatccaggagtttggtttgtgttaattttaggatagcagttgtattagcagatctgaaaaactatagttccaaagagtaagtcatagcattttaaaggagaaattttaaatgtatatagttaagatgctggatggttaaagatacagtgacaaaagcgtatgttagtttccatcaacaagaaaataaaaagttcagctccataaaaagcaaagctgtgggtcaagtgtgagggaatcgtaaatggggcatgatgctgagcaagggatgtggggtaagtgaatgttttcttttgcatggcatagaggtaatgccattggacctacaaagaaggaatgtactcctaacacgttacttggctcttctgtgaaggaaatatttataaacaagtaccagtcaggtttcagtgtggaaaaaacactgaatagtcttttaaggagaatgaattttatggcaggggatgaggtacttacataatcatcgaaggggctgaagggtgaagattacggcaccgccagtaggatctttggtcccacttttacaatttggacttagaggtttggcagcttcaactgtctcctagggaagaaagctgcaggaaatcctcacagaagtcacaaggcactctgctggccctggggcagggactggcaggggacatagaatctagctagctggctgccgcaaacactcatgtttctgcactccaggtgtgcctgctgctatctctgcctgggaaagaataacttcactcccgctctggcttctaacatttatcgaagtgcatctcattggatgactcttaaattgattctagaaccctctagctacaatattataatctatacttaagggactggaatacctttattttgtgagaaaaatacactgagctatcaaggtagaaaataaatttgctaaatacagagggatttgcaaaactgcagatcttaaggtaggatgtgaacttacacataacatggccaagcaaaatgtagtaataggagcaccattttggatggctccaagaagtgattccagaagtggaatcacaatccagaagtgaattagggaattgggtacaactgattggtgaacatctggttgctggtaaaaacagccttagtaaatggctgaaggaaaaggcccttatgctttgatgaggaaatgtggtttgaggcgtcccgctcctacaagagtgggcagagtttagaacagattaaggatatatgtggagtacctataagcaaaatcccctattaaagataatagtaaatttgttttcaatttttagaatggacctataggcaaaatatggaagacataaatagtagccttagtacaaagcataaatattaacatcgtttaaagtaaatgcaataacaaaatatttaaatatactataaacatataggagtgtaattaactaaaacacaaccaaaaatgataattctatttcttagagcagagtgaatagataacaccttgaatacttaagaaattatgctgtaggtatattcttttgagtagaagagataaccagtatgagaaataaaaacagaaacagaagtaggaagtggtgggagtgggtgggtagaggttgggctcaatatttttgcttttcattttaagatccttttatagtgcttgatttttttaaccatacacatgtattgttttaataaaaaaattaaaaaggctgttcttttttttaatcacaatcttcaagtaaggatattgctcatagcaaaaaaaaattcaaggaaatttacctctttagtgatattcatactctgaaggattatcaaaactacttcattctatttgaattaaagttactaagattttgtttttcattagtgttggaaatgattctcactagttgctgtatctaccttttgcatcatgctatggggcccctcacctgtggcaggtgagtcactgtcagtgatgtgctgttgctgagctctgcctctcctgctgtttgttttcaggaagacatgcatgaataggacttgtaactctatttcaagcaaaggggataggaccaagatcccaatgtgcccaatcatagcagatatcatctgaaggcatctggggaaggaagtttaatggggaatcactagttgaaatatgtgtgcctgaattgtcttaatagcaagcgtgtattaattcataaaaagagttaaataataatgcagagaaaagtagcaaaaggatgtatatgcccacatctatgctaatatgatgtacttaattttgttttccgtttaagtaagacagctttggttgatttttgccttctctattccaagcaagtaaagctactgggatccatgaaactaagctaaacggaaaagactctctttctcaaagcacacaacaaagaaaagttccaagtccgaataagtttaggaaatgctggttaaacatatctaaataagcttctttactgcaggtttactcaggaggggcactgtgaatatctaagactgataacatttaggtagagtagtgggtatttcagaaaataattgaaaaaggaaaattatgttttagtaaaaatgggtttagtcatattgtgcaggaaggattcaagatgcaaggaaaagtaaatgtaatgaacgcagtgataagaccattgtaccgatccctggtgatatagtttggatatgcatctcagtccaagtctcatgttgaattgtaatccccagtattggaggtgggacctggtgggaggaggttggattatgggagtgaatttctcatgaatggtttagcaccgtctccttggtgctgtcctcatgatagtttgtgacttctcatgagatctggctgtttaaaagtgtgtggcacctcgcttgctctctctcttgctcttgcttttgccatacgatgtacctgctcactcacctcctgcggagcagctggtttctaacaggctatggaccagtaccagtaacatggggttagggatcccagctttttggcacactttgatcaactttgatgattttttgtttttaattgctgtacaaaatcttaatctgttggttattacctatataaatgattgccaaacaactacttgatatgtagaaaacaaagcatgctactagataaagaccttatatatttacttcatttatctataagaattaaatactatataattaatattctaatattgggaagtagtctaatctcttgatctatctatttattttatttcttttttagtatactgacaatttaaggcagattctagattgactcaatgcgtgtgatccagttaactgaatgcaattttggtatcaattctccaagcaaaaatttcttgatttgtaaaaataaaaagtagctatttgtagcaacactagttattctaaagctgctttccttgatcactgatttcaggaacagaaatataagaactgtaacaatctagctagaatttaggcaaatgcatttgtaacactagtaagagataaaagttgttatcttttagacaagaaacagctgatgttatctagtctagacaggacttccttttagttaattggaagctttgtggcaggaactcaggcaagccataggaaagaaagaataggaacacacaaaggaaatatgaagataagaaactttttcataatataatagctttgttctcttctcagttttttaatctgacaaattccacatagagtgcagagctttctttaccatttgaagtacaactttaaagaaaaggcatagcctgataggctaatatttactggattatttcagtagatgaggctgcagtggtggtttggtattgtgtggacattagatgatggaaacttgcttgtaacagatgctctcttatcagagacatatacaggttattagtggagacttttagtcccagaatgtcctagtgcatgtttaagtgtttatcgaaatacacatgactgttcattgactttcccctgagattattatggggaaaaaaggcttggtatgcctgaatctcatttaaactcattgtttcaagttttactttaaaaaagacattttccaggagtgctaaaattattgatatgaagcattttccactttctttctttaatgatttaacttttttaattttttcatttcacaagaaatccatgatattttgttggctattgtataaaatacagaacaatcaaaacaagtaaaaagaaaaggtaaaatctgaaatttaactattattgttactctactatccaggtggaaaaagaaacattgtaatcttttggcttgtaatacccacattttatttctaagtaaacacacacaaacataaatggcaggatacttggccattattatcttttttattctctgccatatgaatcaggaaaaaaaagtaaaggactacctcttgtgcatcccatgatgtagccacgtgttgtactccaagattcttatttatgacttttgtgttgactggccagaagcaagagtttccaggtactcagaagataatctccacctatacttttctttttggaaaaacctagtgtgagaaagacacaagcatacagtcttttggaagaaaaatatttcttgtagttttttgtgattcttggtattttctttttttcttctccttctccttttccttctccttcttcttcttcttctgttgttgttgttgataagttatgggtcatagggcaggtcatgaagagcaattgtcccagagattgccaagagctgtggccttgggaaatcaatgaagaatctccaggtgatatagcagttaagaagaaattatttaggcagatagtgagggtaaggaagtccttggtaaggttttccttttaatgaaaagcaacccccaaatcattttcttttctaacaaagagcagcctgtaaaatcgagctgcagatatagacaagcaagctggaagcttgcactggtgaatgcaagcagctgtgccaataggaaatggcgatgtgggggctaggcctgtccaacatggtggctccatcttctcttttccttgtcaaccacgtgcacagtaaggagtaggcaacatggcatgagtcaggtagagacccatttgcggaagaagattacggtggggtgggcagcttctttgcgccctatgtaaacatcacacctgatccaaccaatctttgagccctatgcaaatcagacaccacctcctcaaacctgtctataaaaccctgtgcactccaccacaggctggaagtcccactcaggtgcccttctctgtctcttgcaggagagagagctgttcttctttctctttcttttgcctattaaacctctgctcttaacctcactctacctatgtctgtgtccttgatttccttggcttgaggcaatcaactttggggatttaacccagacaacgacactgagaggtgacagcgtgctggcagccctcgcttgctcttggtacctccttggccttggtgcccattctggccatgcttgaggagcctttcagcccgctgctgcaccgagggagcccctctctgggctggccatggctggagccggctccctctgcttgcggagaggtgtggagggagaggagctggcgggaaccagggcagagcacagtgcttgcaggccagtgcgagttccaggtgggtgcgggctcagtgggccctgcactcagagcagctggccggcgccaccggcccctggcagtgaggggcttagcacccaggctagcagctgtggagggtgcgctgggtcccccagcagtgctggcccacccgcgctgtgcttgaattctctccgggcctcagctgcttccctgcagggcagggctcgggacctgcagcccaccatgcccgagcctccccactgctgtgggctcctgtgggcccgggcctccccgacaagcactgccccctgctctgcagtgcccggtcccatcaactgcccaagggctgaggagtatgggtgcatggcacgggactggtgggcagctccgtctgcggccccagtgcgggatccactaggtgaagccagctgggctcctgagtctagtggagacttggagaaactttatgtctagctaagggattgtaaatacaccagtgagcactctgtgtctacctcaaggtttgtaaatgcaccagtcagcaccctgtgtctagctcaaggtttgtaaatgcaccaatcagcactctgtatctagctaaactggtagggacttggagaacttttatgtctagctcagggattgtaaatgcaccaatcagcaccctgtcaaaacagaccaatcagctctctgtaaaatggaccaatcagcaggatgtgggtggggccagataaggtaataaaagcaggctgcctgacccagcagtggcaacccgttggggtccccttgcacagtgtgggagctttgttcttttgctctttgcagtacatcttgctgctgcttactctttgggtccacactgcggtaatactcaccacgaaggtctgcggcttcactcctgaagccagtgagaccacaaacccaccagaaggaagaaactccaaacatctctgaacatcagaaggaacaaactccggacacaccatcttttagaactgtaacactcactgtgagggtccgtggcttcattcttgaagttagtgagaccaagaacccaccaattccagacacaacaccacttcacaggtgacagattggcaaggaagctgtggcactatgcaaattctagtgagtgtccatgaaaacaggcagtgagagtgtcagtggtgtcaaatgtggactggggtaggggcctctctccaaatgttctaagttgtgtgattcttccaaaacactccatggaagtttccctctttacatatgatagaatttcctgacaaccaagtagatgtggttttttggtagatgtgtctgatttagataaagatgaacaacatggccttaatgtcccctcaggtggactaaacttgagacaggtttcctcctgactgtgggcccctgaccttgtttttcttagagaatatacattagaaaacttgcaaattctaaatttctacctttctgagatgtaaatctacagttgggaatgtccttcttacagatctaggaaccattcctttgaaatgtaatgatcaagaaagataagacccctctttcccagtctatgggaaggtaaagtttaactttgttaagcacaattagcaaacacaggtgacctgatcacattgaccagcttcccctacccctaaacttactctagctcaccctaggacttaaaaactctctggagttgagctctgtaaaccaaaaagtgacataggcagatctgagtcaattagaggtttattttgccaaggttgagaatcagccggggaaaaacacaaatcacaggagcatctgtgatctgtgctttttccaaaaagggttttgagaacttcagtattaaaggggaaagagcaggcaggaggggaaggaagaatgaaaacagaagtcagagtaggcagtgaggcaagtggctacattcttgtgaggctttgatttgtttcagtaaatctacattttacagggggaaagagggagtagaggaaaaagtcagattatgcattctgtctcagacaggaaatctccattttacatgaaataaagtgaacatgtgaaaagagggagtagagaaaatgaggctatgacacagggagttgcacatggggttgtgaaattacagctatctgtttgggaacaaaaggaagacagtttggtgactcagttcccgagcttaactttccctgtggcatagtgagtttgaggtcctagattctatttttcttttacagttcaacctctcttccctattgaagtcttgacccttaatgcaatagccttgaataaagtcttccttaccattttcaataagcatctggtacaatttttctctttaacaacaaaaagtggcattacttgcagcagagtattattaaatatagtctctctttttgttttttcccccattgctccctctggataattagctgagatattcattctgatcttgttttcctgttgtaagagacgtgaaagattattcgattccttaaatctggaggaacagccaggcctctgttccagtcttcccttgcctgaggtgaaattaactattttcagtgtttctgaaaccttcccgataaggctccccaccaacgcttttgtttacagattctgggaaactacgagagaaaaggcagaaatatcctgggatgggagctgggaggagtctgttgctgagtgaaagggcctgattggccaggtacttgacaatgattttggctttaggtgtggaagccacagagagaagttccatgctcacgtttggcagaaaaggaatgaagctatggacctctgggtggagggcttgatgtataggcagggtggatagactctcagaggccctttttctatttttctttctcctattttattttctcatttccttacatagaaaaataagttatatagaaaaactcattcctccgagaatgtaggatacaatttttttaaagacattctatgttgtaactagtttactagttaagactaataatcaaagatatgaaagttaaactgtgagataacttactacatgtatcagaatggcaataactaatatttgtgagaatatatttaaatcataatatgcttgtgaatgtctagccaaaaaatggacaatgttggatcttaggcaagttgcttaggtaccctaagtccctgagtctccatttctttatccataaaaatgggaaaaaatgtgtgtactcccatagtggttttgttttattattattaaatgagctccagataagctactaaaacagtacctattacataaaaatatcaaccaatagtagtagctctaataatattactttattttaatctttaaagtgattagatttaagaagagtctccgtagaaatgtatgtgtttatctaagtgaacttggcaagtcccaacctctcttaagctcgattttcttatttataaaaacactaaatgtatttgcttgtctcacatggtagttgctgctcttgtgaaataatcaaatataatcatatatgcaagaagcagttttgcaagggagcatattattattgttattgccattctttactatttaactgcttattaaaacctccattaaaaaaaggtaaaggacaacaaaatagacaaagttccagaaaaattagttggaaagaaaaaagtaaattcataaatgctctttaatagatctagtcagatatacataagattagaaatggaaacttttcataatataaaaaagtgaaagaagtaaataccttggaaaggaaaaaattacatattgaattttaaataatctcatcaaaatataaaaaagcattgtaaaagataagtcatcttgtacaccctccaaatatgaataccttttatttatgcactgtgattttaaaatttgttatttggaatcatctggtaaatcacaactgtcataaatatatcatcaactaatatttgagcttgtccatcgtcatggagggtacatgtcaggcattgtaagaaatgagtaatgatgacaaaaaaacaaaagagtaatgcatctatctaaaggaggttatattttcaaaaactcttgtcagttttagagtgaatttgattggcctgacataggtttagaatagacataatagtagattggagtcattgatgatcagacattatttagttttataatgatagtaaattgttaggttaggtttttttttttagtgacagatgacattttgactttactttcttatctgtattataatatttgtgagaaatcactaccctactgatatggtttgtctgtgtccccacccaaatctcatcttgaattgtagctcccacaaatcccatgtgtcatatgaggaacccggtgggaggtgattttattatgggagtgggtctttcctgcactgtttttgtaatagtgaatgagtcttatgagatctgatggttttgaaaatgggagtttccctgcacaaactctctttttgcctgctgccattcatgtaagacatcacttgcttctccttgccttccaccatgattgtgaggccttccagccatgtgaaactgtgagtccaaataaacctttttcttttgtatattgcccagtcttagatatgtctaatcagcagcatgaaaattgactaatacagtaaattggtaccagtagagtggggcgttgccaaaaagatccttgaaaatgggaagcaactttagaaccaggtaacaggaagaggtttgaacagtttggaaggctcagaagaagacaggaaaatgtgggaaagtttggaacttcctagagacttgttgaatggctttgagaaaaatgctgatagtaatatgaacaataaggttcaggctgagatggtctcagacggagatgacgaacttgttgggaactggagcgaaggtgactcttgttatgttttagcaaagagactggtgagattttgcccctgccttagagatttgtggcactttagacttgaaagagatgatttaaggtatctggtggaagaaatttctaagcagcaaagcattcaagaggtgacttgggtgctgttaaaggcattcagttttataaggtaagcagagcataaaagtttggaaaatttgcagcctgacaatgtgattaaaaagaaaatcccattttctcaggataaattcaagccggctacaggaatttgcataagtaatgaggagtcgaatgttaatactcaagacaatagggaaaatgtctccagggcgtcagaggtcttcatggcagcccctccaatcacaggcccagaggcctaggaggaaaaaatggtttcatgggtcaggcccaggatgcccgtgctgtgtgcagtctagagactttgtgccctgtgtctcagatgtgccagctgtgactgaaaggggccaaggtacagctcagactgtggcttcagagggtgcaagccccaagccttggcagcttccatgtggtgttgagcctatgggtgcacagaagtcaagaattgaggtttgggaaattctgcctggatttcagaagatgtgtggaaaagcctggatgtccaggcagaagtttgctgcagtggtggggctttcatggagaactctgctagagcagtgtggaagggaaatgtggggtcagagcccccacacagagtccttactggggcactgcctagtggagctgtgagaagaggaccaatgtcctccagaccctagaatggtagatccatcaacagtttgcactgtgctcctggaaaagccacagaaagtcaacaccaatctgtgaaagcagctgggagggaggctgcaccctgtagagtcacaggagaagagttgcccaagaccatgggagcccacctcttgcatcaatcagcatgacctggatgtgagatatggagtcaaaggagataattttggagctttaagatttgactgcctcactggatttcagacttgcatggggcttgtagcccctttgttttggccaatttctcccatttggaatggctatatttacccaatgcctatacccccattgtatctaggaagtaactaacttgcttttaattttacaggctcaaaggcagaagagacttgtctcagatgagtcattggactgtggacttttgagttaatgctgaaatgagttaagactttgggggactgttgggaaggcatgattggtttgaaatgtgaggacatgagatttgggaggggccaagggtggaatgatgtggtttggctgtgtccccacccaaatctcatcttgaattgtaattcacacaattctgaggtgtcatgggaggaacctggtgggaggtgattgaattatgggggtgggtctttcctgtgccattcccattatagtgaatgagcctcacaagatctaatggttttaaaaatgggagttttcctgcacaaactctctttttgcctgctgccatccatgtaagacgtgacttgttcctccttgccttctgccatgattgtgaggcctctccagccacatggaactgtgagtccagttaagcctctttcttttgtaaattgcccagtctcaggtatgtctttatcagcagcatgaaaactgactaatacacctactctatttaaaaaatagttcaattacacaaatgcattgttttaaaatagtctataaagataaaaagtatatatatagctgcaaaaaagctagtcatcttttctaaatctgaggctttctttattggtatatctaacctggatctagctaataaatcaattttttttcagtcttcctgtttatatagttttagttccttagctaaattaggtaaagtgaaatccctagcattctaaacatattaacttgtatataaacaggaagattcaaaggaggttagctggaccaagagctagatctactcttgaattatagtcatatgttgtaaagggaaacatcattagttttggtgcatttgccagaaaaaatctctatggttttattttttttgcttttgtctcttgtgagaatgcaagaagtttaaaactggaaatctgtcattggaaaacatcctttttaaaaacaggtgtagaatagaattgaatgtgtacttccagaccatgtaagaagtcaaggagataaaattgcactttcactctgctaaagccaacagctatttacaaggtttcctgcaggagcaggaaaaagactatgaaaaattcgcaagattgtttagctgaggaagggtgaacatatgccagaagattttgaaacatgcaactttaaatctaaagcaataagaaagaccaaattgtatacccatagctattgttaattgcttatttgttcatatatataatatcaacagggatgttactgacttaaggtggtttggtcattgtgaatgattattacaaatttaatttcagtcatataaaagacaattttcctaggtattatttactttaataaaatgttctggtactcaatgttaacattattggataaaatcagagctactgactgtggctctataacaaatgttttctcaatatggagatcaatgggtaaacttgacattgtacctgtgaccttggaagccagtgcatgttattttaactccctcatgtagcaatgtatgtgtttcttatgaagttatggaaggtatttagaatactcttcttttatcttggggaacctttctgatgtgttccctaagcaggcttattgtactgtttgtttcattaaattgcatacatgtgtggggaaaggatgatggttccagttggattgtctagctcattgtaacctatattaaatttaggttgtggaagttctctttatctcctgatgtctccatctactcttgtctcatgaatacccacttctagctgagtaaacataacttcagaagattttcattagcaggagtaggaacagtttctgtaaaggcagcagaccaaagactaaataggttgccaatcatcctaattctctccatttcaaagtaccaatggcatgtaaaattaattctgcattaagcttaaaaccaattaatttctcatccttgtatatttcaacgggaatgtgaattttctgtttaaagtttttgggtacactaggaataggatttaattgtctagcctggccaacacttatggcaaaatccatgccatccacttcattctgtttttcagacaggtatatcttcctgatggcatgattttatagccacccacccgccccccccaaaaaaaaactccatccaacatttggaactcttctcaagtatggtactttttcagtaatccttatcaatgttgaaaatgttacccttgacatgtggaggatttaactatgtaaagactgcaaaataccaagtttttacttagttggtctgaggttgtctttgagacagtgatgcatagcaaaactttcattgcccttgaaacttggctcttgaactttaatatgaaacaaacagctgagctcacagtaagaagctgtgaaaaggcatcttcatgaattgggtaattaaaaatatatgccttcatttcatacatttatggcaatacactaagtctaagcagtaaatatactgagatggctataaacttttcagatgtggtcatgggtgattaaacattgagactgattcattcttgcacattgagaaaataatggtcatgtgtgtatgtgtctgtgtgaaaatgaaaagtacataaaactaaattgtagttaagattctgaatcaagtcagacatagtgatagccttaagacttttctttttaatttcctgtaaaaaggataaaagtgcacaaaggaaacaattgtaagacatgagagattccaacaggggataagtgtcttgctcaatgctctgtgtgttcccgagaaatcaaaactctcttcatctgttctttctttcatttctaaatcaggaagagaagcggagtattagagacctgggccagggacacaatggattctttaggggcattgtgggataacggcactgggcacaggcattttaaataaaaatggaagtggctaaaagtgtgtttatacatggcttgttaattagattctgtcttcttggagtgatggcgtctcactggtgattaactcttacttcagattcactttctgtttttcttctgtgtagctggacagaactcaggggcttctttcccccacacctttcttgctcccagagacagcccagacagcttatggaaagctcagcagaaagcacagctggatggaatagtttacactactgttcaaagcctgagggaaaaatgccttctttctcagcatactttttctgggttcttctctctttcagagtggtacagtctatgggccaaggttagggtctgagctgaggggaatggggccaagggaacagaggatgacaaggaacctcatcctctgtcagggacaggggtgatggacctaggcctgtctttagcctaaaggagaacttcgcttcttaaatataacaaacttgctatgaataggagctttgtatgtatttgggtccaagcctttactttaaattttgggtgtccttcttttcctctttgtttatgagtgtgtacatgcaaacacacacacacacacacacacacacacacgcacgcacttagaatacataggagattcattgcgatggatcaggctattaaagacagccagtaatggctttctctctccatcttgaacataatattaatatcatataactttctctcatagtacttatcatttcctctcttgttttacccttgcacatattcaaggtttaccttcttcattaggctgaaagctatttagaggctggatctatgatttatctttaattctcaatattgccttcacatgatagccactcaaacatttattgattaattaactgatacttcccatagcaacatttagacaagcactaaggaaatatttatgagaaatcaacaactggttctttgattggggaacttttgattggatatctatagagatagagattagagttgatgtcctagtaactacctgcatttttcaaaaaacattttacattgaaaattagacacacacaaaagtgagtaaaagagtatatagtgagcctgatctacttataacccagcttcaacaattatctacacataaacaatcttatttgatctgtactcaatctccataaatgcagattagtttgaagcaaattcaaaacatcatttcattttagctgtaaatatttcagttttctcaatgcatcttaaatgctctgctgcatatctctgttgggtcactatgcaatattcttctgaaatgattacatataatgtgtgcttcagtgttaattaggtgagtgttataaacttgccttagaaacttactgtgaaccccttggtgaggcaattaagattgtgatgacttagctgtacaagaagacatgaaagaaaagctaagaatccaaaaaagggatgttctgtttgttccttgtcacactgatttgagtgccaacatcccaaagtggaatcaatttttgcagaccaagctcaagtttagcaatatattgtgatggtaaacataccaggtgacacctattcttgggtctgccacaggcaccactttcaacatctggaatggttaaagaataacccccagaagccacagtgaaaagccaagtagagacaggatcacaaatccatgtgtccttatgtatagcagtgtgtcaaccagccaccatagcagggctctctggtactcagcttggttggatcatgatttttttttttcttgagatggagtctcactctgttgctcaggctggagtgcagtggtgtggtctcggctcactgcaggctctgcctcctggattcaagtgattctcctgcctcagccacccaaatagctgggattacaggcatgcaccaccatgcccatttaatttttgcatttttaattttttttagtagagatggggtttcaccatgttggccaggctgatgttgaactcctgaactcaaatgacccgcctacctcggcctccgagtgctgagattataggcatgagccaccgtgcccagccagatgaggatattttctaagcgattcctgattagtcagttaaaaatctctttaaaagcatgtttgcatctccacaacatttagcagaatgcctataggtgcacagtaggtacttagtatctatttgctgaattcagtagtgagtgtgagcaaaaatagaatagcacttagatatcagggcagcaatagctaccttaaggaatatcatgaaatactgcttaactgtttatttttagaaaatactaacagaagcagaaatctatttttgacacatagcaaacagcaaagaaaggatgactgtgctttaatattacatagtcaaaaatatatatgtactctgaatagttttacataagacagatgcatttgagatgtaggtacacagtggcaggagcatgcctggctcatacgcagtctgtggaaatcacattaatggattccttccttccagcagaggcactgatataaatagattcaattcacactggggaattgttttttggcggctaaagtatccatccaggggtcacattaccattcacaatattgtgctgacagggaacggggagtttgataaagatttgtgatatggaaaagttctctgtgatcctgttgtcccaaagtacctatctaaatgatcatcctatagattttcacagccttcaaacttaatggaattatttagacattgttaggaatgcaggcagagagtgttaagatacttgataaatatacataaatcctgtgtcatgaatcatttttctttcatgtgggctaaaagggatgttaaataaccatattattaatagctgaagaaacacctatttttgcaaagtagagcttcggtcacaggtcagcttggagtgtatgacttagactagatgtttaagtggaacttcctcccccatccaccctcttcccatccacttctacaacttgggactagtatatttcgctgtgcctatatacagagaaggatggacagtcctacatgggctgtatgaaatctgtgagagagaaagggtcaggtctctgagaggatgttccaacctcactcactaattctgctgtaaggaggggaagagtagttttagagtgggaggactcacaggtccgtgtcttgtaaggcacagggactttacgctagagtaaccatgaccaataaatacctctgtttccaaccaatatgattagcaactctttctattttgtgggggaaagctgccagggaagtggacagagacatgaagggtgaatataggaatgtagcttcctctttattatttactagtagttaatagttatgtcacattaaagcattggctgcaacaaatattagtatttatccatgttccctaacttattggtacaaataaaatcatagaacagccatacttaaattttgttggttaaatgcttatacctggtaatacaaaacctccattcccctgatcattgtctcaaagtatttttgtaagcagctaaatcatgtgtgcagtactccttcagcatctgcgcagtctatattgttgcttaacaaggggctacatcagcttttcctgcttccttgtcggacacaattcccttttaatgtctgcttgtgttctaaaggtgttaacatttcctggtagtttgcagtggagtgaggaagaaagctcttttctcttagactcacactgtactagcagcccaagtcaatgctgcttggccacacatggttcatcaaacgagtctctccataaaactctcttaaactaggacccaaacatgtgtccaggctcattgaggtattggttgaagtaacagccatcatttagtgtctaggtaaagaatcactttacttcttttgacactaaggttttctaactcgataaaggttgttacctgcctgctgcttttccttttggaaagaactttctaaagtgggttccatttgccttctgaaaacagatttctgttgggtcacatgctgaagctcagcatgtggccaaagcttcagcttgttccttccttgagtattctcaggcccactaaaaatggccttatcatggcctctcctgtctcatgtgcccagattctctatgcaaaactggacttagctgacatcactgtaggtgactactcctctatctcagacctgtcactcaaatatccaacacatctgactttgacccatagatttctcagggctccacttgtacatccaattcagcccatgtggtttgctatcttggtgccttgactgcttcagaatttaggatttggaggagatcttcctaattttttttttaaatttggtaatgttcctttgtctcattttctgtctgcctgtctcttgtgtttttctttttaacttttattttaggtttgggggtttgtcaacaaacccccgtgacacatgtttacctatgtaacaaaataattgtggttttttgcattgttgaagtttgctgtttgatattggaatacactcttaaacatagttatgttatattaatgcatcattttaatgcacatttcttgctttaattttttttctaatggcttactacttgctgtttatgtttattttggactatggaagtgatgttagacaaaaagcaaattcaagcaattttcttgtttgagttcaaaatgggtaataaagcaatagaaacaacttgcaaccaccagtggtggttcaagaagttttgcaaaggagacaagagccttgataataaggagcattgtggccaactactggaagctgacaatgaccaactgagagcaatcatcgaagctgatcctttcacgactgcaggagaagttgctggagaactcagtgtcaaccattctgtggtcatttggcatttgaagcaaattggaaaggtaaaaaagcttgataagtgggtgcctcatgagctgagcaaagaaaaaagttgtcattttgaagtgtcttcttctcttattctacacgacaacaacaaaccatttctgggattggactgtgatgtgcaacaaaaagtggattttatacaacaatcagtgacaaccagctcagtggttggacctagaagaagctccaaagcccttctcaaagccaaacttgcaccaaaaaaaaaaagtcatggtcattgtttggtggtctgctgccagtctgatccactacgtctgagaattatgctcagcaaatcaatgagatgcactgaaaactgcaatgcctgaatccggcattggtcaacagaaagggctcaattcttctccataacaatgccagactacgtgtcgcacagccaacgtttcaaaagttgaatgaattgcgttacgaagttttgcctcacctgccatattcacctgccctcttgccaaccagctaccacttcctgaagcatctcgacaactttttgcagggaaaatgcttccacaaccagcaagatgcagaaaatgctttccaagagttaatcgaatcctgaagcacagatttttacgctacaggaataaacaaacttatttctcattggtaaaaatgtgttgattttaagggttgctattttgattaataaagatgtgtttgagcctagttaaaatgatgtaaaattcacggtctgaaaccgcaattacttttgcacaaatctaatatttcatcatccagatattaagcccagtacccaatagttatcttttctactcctctccctacctcttccgtccccgcttaagtaggcctcggtgtgtgttgtttccttctttgtgtttgtaagttcttattatttagttcccacttataagtgagaacatatggtatttggcttactgttcctttgttagtttgctaaggatgatagcctctagctccattcatgctcccgcaaaagacatgatcttttttttttttttttttttaggatggagtctccctctgtcgcccaggctggagtacagtggcgtgatctcagctcactgcaacctccccctcccaggttcaagtgattgtcctgcctcagcctcctgagtaactgggattagaggtgcctgccaccacaaccagtgaatttttgtattttcagtagagacggggtttcaccatgttggtcaggctggtctccaactcctgaccttgtgatccacctgccttggcctcccaaagtgctgggattacaggcatgagccaccgtgtccggcctacatgatctcattcttttttatggctgcatagtattccatggtatatatgtaccacattttctttatccaatgtgtcattgatgggcatttaggttgatttcatgtctttgctattataaatagtactgcaataaacatacgtgtgcaggtgccttcatagtagaatgatttataatcctctggataaatactcagcaatgggattgctgggtcaaatagtagtactgcttttagctttttgaggaatcaccatactgctttccacaatgtttgaactaatttacactcccaccaacagtgtatgagtgttccttttctacgcaacttcaccggcatctgctatttttttttgactttttaaattgccattctgactggtgtgagatggtatctcattgtggttttgattttcatttctctaatgatcagtgatattgagcttctttatgcttgctggccacatgtatgtcttctttcgagaagtgtctgttcctgtcctttgcccactttttaatagagttgtttttttttcttgcaaagttgtttaagttccttatagacattggacactagacctctgtcagatggataaattacaaatattttctcccattctgtggttgtctgtttactctgttgatactttttcttttgctgtgcaaaagctcttaagttgaattagatcctacttgtcaatgtttgcttttgttgcaattgcttttgatgtctttgtcatgaaacctttgcccattcctatgtccagggtgatattgcctaggctgtattccagggttttgggttttacatttaagcctttaatccatcttcagtttattttcgtatatggtgtaaggaagggtccagcttcaatcttctgtatatggctagccagttatcctagctccatgtattgaaaagggaatcttttcccccttgcttgtttttgtcagctttgttgaaggtctgatggtcataaatgtgtggccttatttctgggctctctattctgttccattggtctatgtgtctgtttttgtaccactaccatgttgttttggttactgtagccttgtggtatgatttgaagttgggtaacctgatgtctccagctttgttctttttgcttaggattgccttggctatttgggctcttttttggttccatatgaattttaaaatatttttttctagttctgtgaagaatgtcattagtagtatgatgggaatagcattgaatctgtaaattgccttgggccgtatatccattttagtgacattgattcttcctatccatgagaatgggatgatttttccatttgtttgtgtcttctctgctttctttgagcagtgttttgtaattctcattgtagagatctttcacctccctggttagctgtattcctaggtattttattctttttgtggcatttgtggtttagctcttggtttggctattgttggtgtattggaatgctagtttttcttttggacattgattttgtatcctgcaactttgctgaagttgtttaccagctgaaggagcttttgggctgagactatggggttttcttttctgctctttttttttttttttttttcgtgatggagtcctgctctgtcacccaggctggagtgcagtggcatgatcttggctcactgcaacctccgcctcctgggttcaagcaattctcctgcctcagcctcctgagtagctgggattactggcgcccaccaccacacccagctaatttttgtatttttagtagagatggggtttccccatgttggccaggctggtctcgaactcctgaccttgtgattcaccagccttggcctcccaaagtgctgggattacaggtgtgagccaccactcccagccaaggggttttttagatgtagaatcattcatctgcaaacagagatagttttaattcctccctttttatttggatgccctttatttctttctcttgcctgattgctctggctaggacttccaatattatgttgagtggaagtagagtcagagggcatccttgccttgtgccagttttcagggggaatacttccagcttttgaccattcagcataatggcctttggtttattataaatggctcttgttattttgttcttaaaacttaaaatttatcttgaactaggtatgttccttcaacacctagtttattgagagtttttaatatgaagggatgttaaattttatctaaggccttttctgtgtctgttttgataatcatgtggcttttgtctttagttatgtgatgaatcacactaattgatttgcatatgtcaaaccagctttgcatcctggggatgaagcctacttgactatggtggattagctttttcatatgctgctggattcggtttgtgagtactttgttgaggatttttgcattgatgttcatcaaggatattggcctgaagttttcttgttttttgttttttctctgccaggttttggtatcaagatgatgctggcctcatagaatgagttggagaggagtgcctcctcctcaaatttttggaatagtttttataggaatggtaccagctcttctttgtacatctggtagaattcagctgtgaatcatctcttataaaatgatgagataattataacattagaatctctttttggaaatgtctgaaatattaacaagttttgaaactcatcaactaatgcactctgaaatgtatttagaagtaattataattttttaccatatgcttattgtatatataaaatgattatataaaatgaaaatttgctatttatttgtttgtcaacttaataatatatacttatttatatattaagcttacatttttgtattatatattatttgcttatttattacatatatttatttagtgtttgtttaggggttgtaaaatcggcatctgtttatagaagatgatggactcaattatctttagctccttttgtggcctaaggattctgtttattttcttagaaccttgtccctagcttcttattgttcttatttctaagctaaaatgatgggattaaattggccagaaacttttagctcatttggaaaattttgataactggatgcttttaagttgtaaaaatgtacacttccatataagagtaaaagtgttggaagtttttcaaattgaacattgattatgtaattgagaatgcttgccataacatttttataaaattgcatgctttttattttaatagtaagaatctagattttggccacgtcttctgtttgtcatggggatttagagcattctaaatctaaatttaaggaatatactcctaaagagagcaaaaagagttagcaaaataaattcttaaaaatccacaacagcaatgcagaaagagtattttgaagaagtgctgttatacgggagaaaaagtgttgtaggcagtgctttgaagaagtgaaatgtaagcagttgtttctgcctttttataaacatttgcctcacactggagatgtaactcaggaaggggtgtgcagagccacttaagaaacagatggctatcctaatagctatcctggggatgggctggatttaggaaacataaaagctgcagagaagggcctggtagagctctattttgggtctacaaagtaaatgctaaactatgtagtgaatcacaggcttttggatggccaataaaggcagttgaaatcatagacttggaattagtaagacctagtggatagaagagagaatagctagggtctattttttccccgctctggaacaataagtatttaatgggatagctgagttttattattcctttctggaacaaggaagttataatgtgcggattcctaagtttgtccgtctaaaacatttggattaaatgcttcctataatataaaggcattgtagaagtttagagtaatgtgaacatgagaaaatgccagaattatagagctggaagacattggagattctagtgcaaatgccttcatccaatggaggcctaaaatatcaaggccattctgcaagtggtagagttggggctaacgctcaagttattttctctgttacatcttactgtttcttttgcaaacagaggaaatgatgaccagaaaatatgaaacacctgtattattatatatcaatgtagacaaaagggtgttataactttgtggccagtttcctggagttaatgaaggaaataatttccttcaatgaacttatattataggtagtaaaaagggcattaaaaaagagtgttataactttatggccagtttcctgaagttaatgaaggaaattatttccttcaatgaacttacattataggcattaaacaaagtcaggagaatatgaaggctatatgtttgcctctgaacatcatataatcaatgatatctgggagcatatcagagtgaagagactaagggtataagctttggaactaaatggatctacttaggttcaaggcctggttctagcttggttcaagaactttctaatttggctggctttggcaatttaaccgtttttgctgaatgaaatgggtaataataaagacacttatctcatttgttaatcattagatgagtaaatatatgtagtgtctggcatagagtagctagcacattataagttcaaaaatgctagttattattatggtcttaatttttaaaaatcccataaagaagacaaaacaagacaaaataaagcaagcaaacaaagaaataaataagagcaattcaggtatagtatgatatatgctatggtagagaattacaggatcatagaggagaggcattttaacacaggcctggagcaagggattcaaaactcgaatcgtgatctacatgtattttaattgattcatcttctaatgtttacctcatcaaacccactccattggcctcaaatctttatctcttccggtatttcttatctcagtgtttgtttacgtcagaaacataaagctcatgctagacatattgcatttcttacttcctgacttaaaacctttcagcagggctaatagtgtttgggcagaggctaaactctttatcctagtaatcacagcctgtcaattaccatagtctcaggtttcattattctccatacatattgtcttaagtccattcattcaaatcttttgctgtttcgattcatggtattctttcagcaggctatgttttgtaggctggacttcctgaagtataatttttggtcttcctgattcttctctcactttctcctatctactctcttatgatttttcctcctcatcagagaaatattgcagagaaagaagtgaatgttttgggggatggtattagaaggaaaccagactacccttcaaaaaagtcatccctccctattggaagatttattgacaaaggggaaataaagactagtttgtgtcctgtaattacattgctgattgtgtcatgaattcatgcacaaaagtatattttagtttttggaaggaaggagatggtgcaaatgaattagagggttagaggcagagtgaaagagttggaaagtggcaaaagggcactaggagttgagtatttagcagaaatcttgtgtcaacagctctctaagacaaacaaccaaagaaaattcctgtataagatagatacaaaataatattggataaaataaaataaaaacattggtgttccaacttatttccccaccttcaatcattgaatatatttaagaaatacaatatctatttttttccacatatatataaaactgattatcaaatggcttattgattacagtacttatgagtagtttcatcagttttcaaaatgctaatattaaacaagcttgagctatcatctggagaatctaaaatacgtgatgatgatacattcctgtgaagaaatcatgttgtataaccataatatctatgctgtgacatcttctatacatccccaaatctgcataaaaggagacccagctctataacattttgaaagaactagtcaaatcaggctgagtgtggtggctcacgcctgtaaccccagcactttgggaggccaaggcaggcagatcatgaggtcaggagattaagaccatcctggccaacatggtgaaaccccatctctacaaaaaatacaaaaattagctgggcatggtggtgcttgcctgtagtcccagctacttgggaggctgaggcaggagaattacttgaacctgggaggtggaggttgcagcgagctgagatggcaccactccacactccagcctgggtgacagagcgagactccatctcaaaaaaaaaaaaaaaaaaaagtcaaatcaaagccaaaatgagaccacttgctttacatattgtagatgagaaaaccaaactagttgactgaaatctgctttaccaaatggtggaggtagcagcattgcaatcattacatcttggccctgggtcatggcactggctgcactgccctctggtcaccttccacacaggaggtggctcctgctagaggttcccaaggtttacaccttcactcaccatctgttgtgacttattcactgctgtcctcttgggtcctgagctcttcctcattttctttatacttgtcccttgaatgtggcaactgccgtgcctcttctaaaactgaacctcaatgtcttctctgaatcagaatctgtatttgctctgtgacagtctgtcattgcatccaggctaggcctgagccccataaccatgttggggtgccagggaatcctagaattccctattgttgttgttgttgtttttgagacagagtcttgttctgtcacccaggctggagtgcagtggagcaatctcggctcactgcaacctctgcctgccgggttcaagcgattctcctgcctcagcctcccaagtagctgagactacaggcacgtgccaccatggcctgctaatttttgtatttttagtagagaagaggtttcaccatgttgacccggatggtctcaatctcttgacctcgtgatccacccgccttggcctcccaaagtgctgggattacgggcgtgagccaccgcacccagcctctgattgtttcatactttgtgtaagccattcactggcctttctcatttgagcttctcctatactcttatagcataccttgtacactggcaccaaaaccctacacatacacacacacacacacacacacacacacacacacacacacactctgtctttttaaaaaatattctttttgtaaactttttcttcaagctgttccttctgtctggaaaacttctgcccaacaaataatttctactgattaattgatcaaaggccatctttctgtgaatccttcctggattccctcagttgaatgtgtatatgctatgttcctactgagaggtgaagcgagctggacttcctgggtcgactggggacttggagaacttttatgtctacctagaggattgtaaatgcaccattcagtgctctgtgtctagctaaaggattgtaaaagcaccaatcagcactctgtaaaaacgcaccaatcagcactctgcgtctagctaaaggattgtaaacgcaccaatcagtactctgtaaaatggaccaatcagcaatctgtaaagtggaccaatcagcgctctgtaaaatggaccaatcagctggatgtgggcggggccaaataagggaataaaagctgaccactggagccagcaacagcaacccgctggggtgcccttccacctcgtgggggctttgttgtttcattcatcacaataaatcttgctgttgctcactgtttgggtccacactacctttatgagctgtaacactcccagcgagtgggtctgtggcttcattcctgaagtcaaggagcccatgaaccctctgggaggagcaaacaactctggatgtgccaccttttagagctgtaaccctcactggaaggtccacagcttcattcttgaagtcagcgagaccatgaacccaccggaaggaagaaactccggatcacatctgaacatctgaaggaacaaactctggacacaccatctttaagagctgtaacactcactgtgaaggtctgcggcttcattcttgaagtcagccagaccaagaacccattggaaggaataaattccggacccaccaccacccgtccatgagtctcatctcccatggcacagcatatggatctctattatcgtgtttctgagaggctgctttgtaacattttcatgattgtgttatgattgtaggtgtctgactccctaaccaagatatgattctgaagggctgagagtatgccattcatttttgtgtccccatagaacctgacatagtgctttgaaggccactgtcatctggaaaatatccgtggaatttatacaagcagggaacaaaatatggctaattaatccagttggatgattgatgttaacagacattagttgctgaacagtgggtactcagagaggtgtgggcggctattttaaacctgtattttagaacattgatttccgatttttttttttttttttttttgagacagagtctcattctgtcgcctaggctgtagtgcagtggtgtgatctcggctcactgcaagctccacttcccgcgttcacaccattttcctgcctcagcctcccgagtggctggggctacaggtgcccaccaccacgcctggctaatttttttctactttttagtagagatggggtttcaccgtgttagccaggatggtttcgatctcctgaccttgtgatccgcccaccttggcctcccaaagtgctgggattacaggcgcgagccaccgcgcctagccggtttcagatgttttgaggcagactgctagaattattatggcttataattcaggcacatagtttaaaaatttattatcacgtcctctctttttgtcttaatattaaagatttcaaattctaacaaaatagccttctcatcattcaaacatacttgtgttttttattctttaaaattaacattcataagatattatttgagtataattttacatcttcaaacactttaaaactatgaagctggaaatcatttccccagggaaaagtgaaatggtattctttgtgactgcttcaaaatctagggcccaatgagttagtagattctaaacttggcaagccaatgtctactattcctagtgggaaatattttggttttaacttcctttggataatctcccaagctcaatgggaaataaacatactccaagaatcaaggctccttttagaaattcaatttaaattttttttcagggattctggctctggctcattttaacttttttcccctcgtaatcaacatttcatccttttcttgtctgctgccaaaaccagccttttcctgggctcctagaaatttgaaacattttggcaggctaaagaggaaaatgggtgggagaaactctcaaagagggtaaatgagtaatgatgtttccacttcccaatattctaggccagattgtttttctatgtgggggaagaaaacctctggaatcacttcaagtactccatagggattcatagagctggacttgtagggctggactcactaaatcaacaaatatttagcatgttctgggagctttagtgcatatcaaacttttaaaaactcagtccatactcttaaaaagcttagattgagttgctgagataaaatgcttgccctgtttaatggcaatataacaaaagaaattacctctgaaaagtacatggtcagttgtcagatgcatggtaaagacagtaaaagaagaacttggagaatgaggggatatttgtagacttcatggtaacatgagggtgatcttaatttccagagtccttggagaggaaattgaagtgttagacttatcacagaagatgggtattttgctgggttttggaggattagtaataaccattattttttctacccataaagtgttcaacactgagttacttgctttgcatgtattcactttagttctaacactgtgcaacgtgggtcttacgggattttattaatgtttctcttttgttgggctggaagttccatgatgacagagatgcatttgtctgcctttggtcgcccttgcatccttaagcgtagtacagtctttggcagatgggaagtacctaataattatctgtggagtacagatgagggtctgagactgagggtctgaggtgaactaacttgcccaaggtcacagtgccaatcaatggcaaagctagcatttgcatcttagtctatgtggttgcaaatcctaaggcctcttgtggtgtaatgctctgaagtgagggataagatttaaatatctggagaaaaatgagatggacaagtgaggttggaaaataagcacaaagaagattatggagataataaaggctgatttagctatgggagatttaggaaaactagaaaaacaagttggagtcagaatatgtaaaactgtatattaggctcaaaactttccatttttctttcagttaatggaaaataataaaaagtttttgttttaattagagaaacatatgacaaaaataacgttttaagcagatttatgcagcagctgtgcaaaggaggctttggaaggaggagcagctgaagtctgaggccagtgaggagactgttgcagtactcttggcagaaagtcatggtttcgtggtcaaggataactggggctctcttatagggaaatgggtccttcatcggattagtgaaaatggaaatagttggggtaggcaagagataatttgaagaaaagatcttcaggtgttcatgacaaggtatggacacttaaaacaatagaaaatttaaggacaactggttgtcgtgagcctgtgtaattgggcaaataatagcactgttgagacggtagaaagaaatcttctagcagatttcagttttaaacctgttacaatgggatcatgaatggcatgtctaataggaataaatttcattgctcaggactggtactaaaattagacgtcagaaatatgatagagttatagagccaaggcatagaggaaattactgaaaccgtagtagtggatgaggagaagcaaggagtgttgttaaagataagctctatttaacaaaaatttaattgcttcttttagtaaagtttgtatttaaatatagcatagtacgatgtacaaattttaagcaaaattttagaaagtgatgcagtcacataacccagaaaattatgatgtagactattaccaccatcttagaagtttttctcataattctcttcctgcaaagatagccactattctgatctctgtcactagagatgatttggaaccttacatacttgaagttgtctagcatctaccccttcacgtctgtcttctttgctcagttttatggctgtgagatgttatcttttctaatttgacacatgggctattcagaatgtgttgcttaattttaacaaatttagaaattttctaatttgctttctgttattgattttagcttaatcccacagaaaccagaaaacgttcttggtattatttcaatcctttgaaatttgctacgacttgctttatggcctagaaaattttctattttggtaaatgttccattgctttggaaaagaatatggactctggaatgttgaatacagtgttgtataaatgtcaattaagtcaagtttgttcatcatagtgttcagaccttctacaatgcttctttaatgccttttttgttctttcagttaatgagaggagtatgttacattttcccactatcatcatgaatttgtttagttcttctgttagttctgtctctttttttctttattgatttggaagcttgtcaggggcagatatatttagacttgttatatctttctgttaaaatgagatttttctagtacaaaatatatctactgatctttagtatcatttcttaaagtttgctttttctaatatcgttatggctctacaatttccttttcattggagttttgtgataaggtattttttctttccttttatcctattctatatccttatacataaagatatctattaaatcttaaattatagtcgtagttggggaagctaacatttaaggaggaggagcaggcaaagataggaaagaggcagaagatagaaagaaaaagagacagaggagtaggagaataggctagaaaggaattcatgaaactacgaaataataatttcaaggaggatggatgatgaagcctgcactgctgttttagcagaggcacatgtcaagtgctgtagagatagatactaggtcaaatagacacaaaggaaagcccattaggtagcagtcatgcattcattcattattttttgagtaatcttatagtagataacaggaagcaggtttaaaaagatagtgacaagaaaatagaaggagcaggttgagacatattatttatgaaatttggctgtagagagagtcatactgtgcttttattttctgtagaaagcactctaccactttagacctaatagggccgcattcttcgcctttctaataagttattcaagcattcacctgcctttttagtaggtacttcggttcttccttccaagtcaacaccctcctcttcaattatacaggactcccatgggctaacacaatccatgcagggtgtcggtctaccctgagcagtatgaacaatcaagtgccactgctgtctctgacccacagggtcgggggtggaagctgcatcctgcactgtgtgacttccagggagggctccctactgggatggtacttggctggttcatccctgattccacttgtttccctcttcccccaaagataaaacaattttctgttttgcttcagaacacaaagtatatggttaaataaattatgattcagccatccaaaggaattgtttgcatctgcaaagaaaaagaaatagaatgagcaagctgactattgacctagaaagacctccaagacatactggtactgaaaaaagggaaggtgcagaacaatgggtatagaatgccatgctttccctggataaggggattacttgccgacatttctaaaggaggttgccctgggtgatctcgcacatctgttcctccccttctgagggggattcccgtagtgattctaggatatgcacacattgctggttagaagaagtcagtagacttcagtcatctcaacttggtgttccgatacctcttttcatagagaagagagaaatagaaatagagagaaatagaaattgtgtcctgtagccatccttttgctaggtggctataatctgcaaatatattttaaagctatgtcagcttgtgcctacttgagtgcagatgagatttatgaaacacatataaaatgctgtaaggataattggataggttcttggaaaaagtgaggggagttagttttgaaggagaggacagacaactctttattcaaaacagaaagcaaagaagactcactcagaccaaatgcagcaggtccttgaataacatcgtttcattcgacttgtctccttataacctggatgagaaaaacaaaattaattcccatctggggccactatctgtgtggaattgacacattctccccatgtctgtgtgggtttcctgtcatattccaaagctgggcacattgggtgaattggcatgtctaagtggtcccagtctgagtgagtgtggttgttagtgggagtgtgccctgcaatgcaatggcatcatgtttaggcctggttccctgcttaactgcagggaagaggttaagcaggagagagctgggagaggctccagccaccctccaccctgaactggaataagtaggttgaaaaatgaatgaatgaatacaaattattgtaaaataccaatttgtaaagtggacaataatcgtacaaatacatgacaataaacaacaaggcaggaaatccctcagcgagtccacaagatttgtgattctttttgaactttgtggtgggtagtaggtgttcctgacaatttttgctttgcaaatttttgttccttaatttaacccacctgcactatgaccacagtcactcactgactcaccaaaaatggggtaaataattattttgcctgtttttattcatctttcttaaatgtagctttcatttatttccatgtttaatattagaagtgttttgggttttatttagaagcggcataatgtttttgtgaccagaactatgacctaggatttgctgtcttttatatcaattagcctatagtaaaattggttttgttgtacatcgtttcacttaaaagttgacatttccaaaactttacatgaggactcactgtatttaaagtacacaaggatgaatggaaaattcagagttgatgatcttaattttagtacttttttttctttttccttttcttttttttttcaagagagggtctttctctgtctgaaattttaaatttcagcctcaacctcttgggctcaagtgatcctcccaccttggcctcctgagtagctgggactacaggaatgcaccaccatgcccagctaatttttctttttctttgtagagattaggtctccctatattgcccaggctggtcttgaactcctgggctcaagcgatcctcctgcctcagtctctcaaagtgatgggattacgagtgcaagccactgctcccagccttgattttcttaatagaaggttactagctagcaaagcatttagttgtgatttctctcttgacactagcatagaaaaagaataaatgatgtgcctaagtctatacagtaactaaatactccaaacaaacattagaacttgtccacaaatttatttttgtttttattatgtaaaaattttagaaaaataaatgaatagagtgattaaccttcgctgattcatcactcagtttcaacaattataagcatgaaaatgagtgtggttcacctatacacatttttgcagattattttgcaactaatcccaggcatcatattattttatccttaagtaatttcaaatgggataaaggaaagaaactgtactaaggagtacattcaactctgtagccacaaattaaaaaatttgaatttaacagatgatttctatcaaaatacaaattatcaaaaattgatccaagaaaataatacaatactcaaagtaatttccttagaagatacaggaatatcattaaaaatttcatcaagaccagatggtcttaccactaaattttatgtgcaaagttaaaaaatgtttaaaccatatattgtgttgtgttacttaaaaatctcccaggacgtagaaaaagaagaaaatttctctaattaatttaattaagatatttatgacaaaaatgagaaataattgatataagcatcagaaagaaagaaattaaattttctttgtgctgatgatacaaattcaagatgttatgtttaaaaattttaaagttaatacaaaaatttaataagttgcatagcacaatataaatctacaaaaatcaatagactttctctactagctatacacacctagagttggaatataaaaaattgtattaaaatatagatgagccaggcgcagtggctcacacctgtaatcccaacactttgggaggccgaagcgggcggatcacctgaggtcaggagttcaagaccagcctgaccaacatgaagaaaccccatctctactaaaaatacaaaattagctagatgtggtggcccatgcctgtaaacccagctactcagaaggctgaggcaggagaattgcttgaatccgggaggcagaggttgtgatgagccaagattgtgccattgcactccagcctgggcaacaagagcaaaactccatctcaaataaaaaaaaaaaaaaaaaagaaaaaatatatagatgaataccatataatagatttaacaagagaagcacgggatatatatgaagaaactatcacatcttattgacttatgaaagatgtaaaaaaaaaagatccaaacaaatgaaaagacactgtattcttgaatggaaagacttaacataaacaacaacaaatttacaattagaaaatatacaattcaatagaaaagacgcaaacaatatgaaaaatttaatagatgagtaaactcaatcaatgtaggaaatgggtactcatgaatgactggtagatatatgaactgttacagcatttgggacaatatatttagtggaacctcttaaatttagacacacacatacctttcattttagcaatttcacacctgtgaattcagcccacagaaataaaaaatattcataaaagaccagtatatatgatataggaacaagatatttgtagtgagcctgcttgaaatggctaaaaaagaaagaaaagtgtattagtctgttctctcactgctaataaagacatacctgagactgggtaatttataaagtaaagaggtttaatggactcaaagttccacatggctggggaggcctcacaatcatggtggaaggtgaatgaggagcaaagtcacgtctttcatggcagcaggcaagagagcttgtgcagaggaactcccatttttaaaaccatcagatctcatgagatttattcactaccacaaaaatagtatgggggaaccgctcctgtgattcaattacctcccacggtgtccctcccatgacatgtgagaattatggaagctataattcaagatgagatttgagtgtggacagagccaaactgtatcaaaaagctaatgcccaggaatagaagaatgtgtcaatgtgtgagtataaagtgtatataatatcccattttggtaaaaccagtaatgtatatatatttaattgcatataataacattatcacaaagaaaaataagaaagaacaatagattattaaaatgggataactagttggaaaaaaataagattatattcttattagggggaaaggcaaaagaggaactataaaaaaattttaagagactgcactaaaatctacaccagtatgtgtaatggactacttatgcatttttctaaaaacaaattttatacacacacatatacatgtacatgcacatacacacacaatttttcaaaattaaaaacacaagacaagttttctgtttttaagtaccttggagtttactattcaggttataatataaagtagaaattgaacatactgaataaacctgcttagtttcaccttacaaatcaccttcttatttaatcatcaaaaattctcattaataataatttttgggaacatattttctgagtaggctattggtcacattttcttccttgcaggagttttcatatagagaatgcatacaagccacgaaccataagatgccatactgttacttagagctaggactaaaagccatccaatgatgagctttttggttaaagaaaatgtagcttagactagaggttaaagtgaggtattcttcctcctatactgaaaatctaaatctcagaatgaaaatgctgaggggtgcttgttggaggagtggattatgatcatgtaggtagagtagactgtgagatccagttgcccaaccagcttttatggagtaagtctacaggccagtctcacatctactctctgagagtggatgtggggtgaatggcatcctcctcccagcctttgggtaaagcatagtccacatttgctaactgcttgaaagaagcatttgaggaagaggtcacacctcacctaagggtaagaagagaaagaggaagtgcttgcactaattcttgcttttgagctgctgcaagcctccaacagtgaaacgtagtccatgaacatcaagttcaggataatcaaattagtcattcttttcttctggaggagcaaaaagggcatcagagagaggagccagagacattccatctcaaactcctcaaagagagaatcaagggaagatgcctctccctctgcaggctgcttgcaacttgaaaaattgtccctgacactgtcaatgatatttcataagaatgataagatctcatttcataagcatgataaccattaggtggtagtcttcaagcagtttttgaaatgtccacatataaaaagaaaaaacattttctaccttgtttttggtcatctatttaccttaaatgtttgatttcaattatgccaagaaatgtgcaagaaatgagaactcttcaggaatactgccaacagtgttaacttgaaagttacatttgattattttgtagacataagattctccttacattgatgcaggagttacagacaaaagaattattattattattgcttaaattgtgtaattagaaaagatggttgtattgtgctaatagtttgcattaacaacttggaaccagttttaaaatgactgggattgttgtttgcttggaaatagcattccaacagcttgagggattgagtcttgaaattctcaaaggttacaaaagcgtgcagtaacacacttttgtacacacttttgagggtacagattggtaaatatgtgcatttatatctgaacactttcaagtttgctttaatactatttttttctcttagtgttaatgcaaatttgcatctaaatatttacctagtacttactatgcttctagaacaattctcagctctggagattgacaaattcatgtctctacagttgatacttctaaggaataagtgcatggcttcatataattcacttgtcctgattgtggaagaaaaaagtaaggcttgtgtctcaacatgtgtccggtacttttatggcatccaagccacagatctgggagtttccatgtgtttctcctgacgctttaccctccctagcttgacctgcactgcagtaggccacatactggttttctctccccagctttgtcttccttgctatctccactgccccttcatttgacatgtcatttcccacactgtaattcctccatgagttaatatccagctacactccaagagacattcataactccagaatccgagttataaatactgtctctcaataaaaatcagggtcttatgttcccctagttcctaaatcctatccagtctaattggttgtgtcttcttacacctcttcctctttccccactcctactttagttggcttgtttcaggctctcaacattttctacttggattatgattaacaatctcttgcttcccgccttgctcattccttgccatttaaccaatagctggtagcgtggccttatgaaacacaaatttgatcaagttgctgccttaaaggaaaggcaacagcaaccatcagcacccgttggtggttttcagcagctttcaggatgaggtccacatttctttgcatggcacccttagcacttgatctgcccttagcacttgatctggcccttgcctaactctctggtctcatcttttgctgctctgcttctccatcagccacagtcaatttcactgaattacctgtgagtttcacaagaccttttccctgctttcttggactcctgcagttttgctctccggttagaattcccatcctctttttctcctcacaattattttgctggttaactcctagttgtttaaaaaacatgtctcgtttttccccagaaaccttttccagcattaattaccttttttatgagaagaccacagcttagttatcatgtgtacgtcttcaaagtgcagcaagtcgcccagcacaggcagacccgcctaaagctaataatcttcctgacctgagactctccaacggactcttcataggattctgctgaagagctggttttgttttcttcatgttattatttttttgaggctaaaaaaaaagtagttgaagactgaagagtgaaatcaaattgttccctaaatattggaagatgttatcaattaatttatttggaggtatagattatttaattccactatagtactttgattgcaaagtaaccagagatgttttcacgtaggtgatgctgaatttctaaaaaaacagcatctgtattatttttatggacttttatcataatcaccagtgccatcattatgataatttttttcatctataggtagagttagtctgagaataggcttatttctgttgtaaatgatagcttcacttttgctaaaaatactttttgattcacttatttttaagactttgctacatggtctgtcaggccctgggtttctggatgcattgtataattagtgtaaacttggagaaacttgttttgtttttaatgatccaaatttagttgcttttagtcacagaatttctgtaaatacaaacttatgtcagaagaggcttttatttactttgtgattcaactcagcatgtttatttaatatgcaatgattcagcttactggctcctttagaaacttggagtgtgtgttctcatgatggctgaataagttgatggctttgatctgaactgtaaaggctcagagggcattttttccttgcaaatttgcctttggaatttctctttcttttctgttaggaaagtactattgtttgaccgtagggccaatctcatgtagtttagattccccatacttgcagaattagagtttttttcttcattatgggatgctttttggtgctttcaaatggaaaaagcagagttgttccaggcactgacagaaatctgtgctgttgatttttgtttccttcctggacttcccaaaggaaatacaaaagaagatattgatattaatctgttagatcacaaaaaaccaatgtacaactaaatgaacctagattaattttttcaaagcccaaacaaaagaaagattaacagtacatagttcttttttagacaagactgacttgcacagcctgtcccctgagtcactaggcttcccacctcaattagtctgcatttgctcattttcccactctaacatttcttagtagtaaccagcttctatcttctctttgctttacatggtcactcttccttttgtgatcatcccccaaatatctcttatctcagttggcactcactgctgtcatttatcctctctaatcacctgaactcctaggtgttgggtgaacctgtcccttaggctaccgtagcttgcagagacttggctttcagccttaaggttcaacatgctgctggagttccttccattgcctccatcttccaggcagctggaagtggaaggaacaagacatctcaccaccaagccagctttctgtaagtaccctgcttaccctctcttaccagaacttcctcaatggccacagctttctaatgatcatttgtaaggacagctataagagaggctgtaaaatgcaaccttcgtccaggggcattgcaacctcagtgaaaatggatttctattacttagaagatgagaatagctattgggtagcaatgagccatctctgctaaaactcagagaaaacaagctaactaggagttcaagagttcttttttatgtccttcaaaaacacattcgtcttgagaaataagtctaggtttttaaccacctttttgtttcaagcatgagtaataagtccattttattgactataaaagtatattgacattctttctattttgaaagttaggcatcttagtgtgctttgttttttgtaatggtttctgtgtatctttactggagtctttagcttccccctctctttactcctcttttgagattcagacttactcaaccagaacagcatttttgctggttctccaaccatgttgagttacattcacttccagattcttaagtcatagaattatgaatctttttatttttgacaaatgtcttctgtgagtattcacgagggtgtatctgaccagtaagcaattttcttttcctgccagtttctcgccccattttccttcagtgtgatttgctggcagcttccatcccttcctcctagggctgagcacaggaccctggtctggttagtatgttctcctttcctgttcaatggttgcttcagggacaaacaaatgactcaaccaacgtcttttactgaaacccctgcaagggggactgtctctttttctgagattgttgaggggccatctctaactcctcaaagagaaagaaaaagagcttatgttagaatgagaccaacacagaggaaaagaaagctgatagatggattaagcaacttttctggggacatctttgtagaacttgaatctaacctgcctaatgctgtatcactccttgatttttgtgttacacatgccgataaagatacctttctccctttaagccagtttcagtaaatttatgcaacttgcacctaaatgagtctccatcaattcaatttggtaacttcttctgggctcctattcattctactagctaactcctttttcttattgaagtgtaccagctttatgagatacacatgaccctacatgtgctagataaattacataaagtggtatgaaataattctatcccaaaacctgctgatgtctgtttaatggtgctactgagaaataatcaggttctatattgacatgaaataaaggaattcagttcaacttgaatgcaattgcatcagtttgtctgctgtcactccttagcacacaaagaatgcagaggcaactgaccagacacgtaactgcgtaccagagagagggaaaagcagaatgaggcacaaacaaatgcatttcagagaatgcaggtatgttcccagttgttctttgaacattattaatgctatcaaaacacgttttcaaaatgttttgaagaaaattaaaatctcttccgaaatcagggaatcatgtctgtgttccatgaaacttgacctttgagcaattatggaaaacaacaaggagtttgtcaatattaataaggatcttgatatagttaatctacagttaattattcaatctaaaataacaacgaacatggagaaagggaagcaaaactaacatttgttgaggtcagttatgtactaggtatggtctagctttctttcatgcagaatttgatattaaagaaagcagaggcattttcaaagccataactgtctaaggaacatgaatatgtaaggaaaatggtaatatagtgcctgatacataggaaatatttgataaattatagcaaatatggttattgttgatgatgatgatgacatgcaaatacctggataagataaaccctcctggagcactgaggttggggttcttagtaacctgaacaaagaggccaggtacacagtggctcttgtattctaattgaggggaataaaatatctgcaccattgtcttctaaaggcaaatattaaaatgaatattctgaagtttatagtacagtgaatcagaatccttaaccatagagcaaaagtcattcgtatttttcacaagctccctaggaggttcttgatgtccattaaaatgtgaaaatcttggtctgggggaaggggattgacacgatgggaaggagaggatgtcactgtatttcattgacagttaacttccctcttttttttttttgaatataatttttgtttttatttcagattcaagggggtacatgtgcaggtttttacctgggtatattgtgtgatgctgaggttggggcttctaataatctcgttgcccaagtagtgaatatagtacccaataggtagcttttcaacccttgttcctgtcactacctccccacttttaaaatctccattgtctgtagttcccatctttgtgtccgtgagtacccaatatttagctcctacttataaatgtgaatatgcagtatttggtttctgtttctgcattagtttacttaggataatagtctccagctacatcaatgttgctgtgaaggacatgatttcattcctttttatggctttgtagtattccatggtatatatgcaccacattttctttatccaagtgaccactgctgagcacctgggttgattccatatctttgctattgtgataatgctgcaataaacatatgagtgtaggtgtctttttggtagaatgatttatattcctttgggtatatacccagtgatgggattgctgggttacatggcaattctgtttttagttcgctgagaaatctccaaaatgctttccacagttgctgagctgatttgcattctcaacagttgtgttgtgtttccttttctccccaaccttgccaatgtgttattttctgactttttaataatagccatttggactggtgtgagatggtaatctcattgtggttttgatttgcatcttctgatgattggtaatttttgagcaccttaactttgaaaatcttctaaattaatttgacatcaccagaaaataatttcagaacagtttcaatccaatattattgtttaatctttcaagtctgacaaacatttctttccaatgaaagcacaatctcaatttactaagcaaccataactatgaggcaaacacactatatttttaatgtgcgccgtatcctgggggttaaagattatatgtctcaatttaacatatttatttactttcttttcctttccttttttcttccctttctgcctctctcctttttccattccctcgcagtcactcttttttttttttttttttttttttaaccttcctttctgttttcctcatggtgcagtgtttcagtgtgaccagcagaggacactatgctgcagcaagtctgggcatcaactatctaaaagataaattgctgattgaattcaaagaagatagattaaaacaagcttgtaaatgttgttaaatacatgaatgcctactgcattttaattatggtgatttacatggacctaccatgatcacgtacttcataaaacaaactttgccttaatagctgcacttaacgatgtactctttcctttatgagaatttaattctctgaatatgatatgtttttaaaataagacaaactcaaaccagttgccaatagatcctcagctcctcctgaggtccttgttttatgggtctgttctactgtgtaattgtttagtttaacttggtaaacatgtcagttttcccaggataattaggtggataaacaaaatgttcaaaaagaaatggagccaattagactttttatcaaagacatacacacaaaaaaggctttacaaatgagtggacttttccttagaggtttgatcttaaattagagttcctggaatttacaagggaccaaggaggcagttttcctaaatataacgaaatcttaattatctggggaggagagcaaatgaaagacacaaactctcacatgctttgaaatcatacttgggtgggaaatgcagagaggcatgagttcagtaagagcataattttatccccacctgctcacagccacttttaaacaggttgggcaactggaagagaatgccctgtgactttgggtaattttcttagagctagctcaaagtagacaggtacccaacatatttttaatactattaaataggtggcagtacctgttgtggacagttgtgtgttgtatagatggagacttcaacaattgtttgttctaaaatcaacagtccattaatatattgggtgctctttctgtagagcttaacggtgttttaagaaccatatcactttattctatttcttatttttggtcattgaaaatagactcttatttggagtgtaacatatgatctgacttctctatccagattttgtctcatgttttctgctacttctctataaagatagtttggtcctcaggtgttggtttatgttgctgtgattcaagacttggttctattagtacagaatccagacatacgtttgtttctctttgaaaaatttcataatgtaacccagtgaataaaatatttaccaatattttttctttatcacttcttaccacaatttttcctaattattattcttttttaattctggaaagccactcaaataaaatatcttcagaattaacaaaataagtttctaaatttaaggattcccacaactacctcctgattatatagtaatattatatagatactgccacttcttcacactttaagcttgtgtacattctctaaatttctgtatttttatgagcttcatttggggtggtaataaaatatgatccagaaaaaaagcccttttattctgtaattatagtctctgtttttctacatagttctctcaggatttcttcaccttgcttccaggcttgtctgaatttctaactgctttttctattggttgtctcaaagtctcagtatagtactaaagtgctttctatttgttgctatatccattaccactgacaacctcagaaatctttgtctcttgggtgccatagcaataggcttgacacagctacccagtgtcttgtgagattaattcatcatgcatttaggacagtaaactgttgtttgacatgtaggaattaataagtgggtagtgtacaaagccttttgtttttatttgtggaggggactttaaaagggaaaagctaggatcatagtctaggccatgtatagaaaagattgcttgacagtagttacggggtaatgcctgagagtcctcatgtttgagactggtgtgtgctaagtgtaatgatgtaatctgaagagagggtggccgcttctctcaaaatggttttatgctagttttacctttctagagacccacatctacactcaatattgcagcccttgaaccagcaatctagggacacattttctaaagagtccttaaatagtttgatgtctttacaaggattttttaaaattttacttttttttttgcttgtctttaaaaaatgaaacagctgtattttgaatagaaatttgagaatagcaaggtatcaataaataaataaaaatcatcctaaataaaaaaccaaggaaaacccaaaaccctattcaagtttgaagatgtaaaaaaaaatatatatatatatttgggtagttgggtcggcagatgggcagagactttgctataaaaatgtgatcatactatagtgctattttaaaataatgagtttacatttaattttactacaatttaacagaagaaagaaatgaaaggaactgaagaaaatgctacacttcagataaaagtttctttactataaaaggtactatgctataaagaatctcagatttttaaaaatacatttaaaaaacctacctatgggctgggtggcatggctcacacctgtaatccagcactttgggaggctgaggcaggtggatcatgaggtcaagagatcgagaccaggctggccaacatggtgaaactccgtctctactaaaaatacaaaaattagctgggcgtggtggtgtgtgccacctgtagtaccagctacttgggaggctgaggcaggagaatcacttgaaccctggaggaggaggttgcagtgagcctagatcacgccactgtactccagcctggtaacagtgagactccgtctcaaaaaacaaaacaaaacaaaaaacaataaacaaaacaaaactacctgtgaaagaaactcaaatcaattggaaatttcttctaaactctgggcttgatgaatcgatctcaacttttccttttatctcatgttcttggaatgaattcttaactagatatgagttaatatgagcctctccttttgcaagaaaaagggctagttgcatcacctaggaaaaaggagacagacctttccagcattgtgaacaggtacccaggtgtgagtaacatttcagagcccatatcagataagggtaaacagactctaattcattcttccctccctgcattgactctcaaagtggtagacactcaataagggctgaaatggactgaagccagagagaggtgatctctggatttttcctcctatattccttgtatttggcctttatctggcttatggttgaattcaggaatgacacaagaagttgtggttttccccattggataatggtcagagtcatcccggtgacttctcctaagctaaggataactatgagttaaagataacaaagaagaatatgttttcatccaaaggcttgttgtcatctgtgtaaaacctcagtgaggggggctaagcaattaccagtagtgagagggcagggaagagaagcacctggctccaatattacccaggcagcccctgaaatcttacagccaaccacttctcaagaagtctctcaaaatagaatctactaacagagaagtcagaagttactctatggccatagcaactgggttcagaaatcaaagaatagcagccatgttgctacaggatcttgcacccttccatgcttgctggaggtggcaagtgtgaacaatttagcatttttgtcattagggtttttctgaggaatatataattttttatcagaacaggtgggaaatcctaagtgaattcacaactttttgtttgttttttgttttccaaataagactatgaaatcctccaattaaaaaaaaatttctgttcagcaaaaggtttatgagaccaacctcagaaaccaagcttccaaatctgatggcaacattactaagtttattaaattcatggtttcattaatagtgaattgagctgtaagcaaatgtcatgggtggaaagatcaacagcatggtctctgttatattatatatatatattattatatatatatatagtatatagtatatatatattttatatatatatatagtgtatatatatatatatagtgccttaattatattatgtggataattgcataagaaccatgtaataatactactgaacaatgggtacattgtcctttcaaaatgaggaagtacacagtttacaatgttgccatcacaagttgaacttatggggacattaggtcctatgactttatccagagagttggattcatctcctgctaaatggaaaaaaacttcaaactttattccacatctgtgctattctcaccatatcctcctttgcacgggtataacaggaatcagagctgaaatttggacaaagtcaaaatctctattcaatctttaaatacttaacgaatattgattgaagaaccagatgattctcaaagatagttctccccaaggatgagaaataaatgatctcaaccttgtaaattttaagttttgttaggtgggattagaacagcccttagcctagagctaatttgtctgcctcttgaggtgatatccttctgaatgctcaatttgatgtcctgtgacttatgaagtttctccacttgggctggtgggaacccagtctatacctgtccccgtgtgatcttcaaatattgatcccggaggggcttcttttgctagacttgcatagtttctcctcagttgtgtgctgatcagaattcagctgaaggctcaaaagggaccctctgcacacccttgtgtgtggctttcttttgggaatctgcctatgaactctagctgtcttggcctcccagctctgtttcctcagctctgggactctaccagtctcctcctgggtttctattccccgaactgtggcccagaaactctctccaggtagaaagcggggtcaatgacagggacttcacttcttttttttttgtttcctgtctcttgggtcactgtcctatgctgcctgatgtccaatgtctggaaatcacagtttcatatattacgtccatatttttagttgtttcatgggaggggataaatttagtccctcttgctctgtcttgtctggaaataaccatgtcaattttaaattagaaaacattctttattgctgtctctcttaaaaattgcctatgactccaaacaaatattatcttttacactggtgagttggtttaccatcttctgctttagggtaagacgttgtcaagagagagtgtcaagtgtcagagagagttgacaggactccttaatggtactacagatgtctctaaaaaattagttagttacaggttgatcactatgataaatagctccagtgttgagtttcacttctatttaaataaaataaaatttaactttgaagattaaacttatggacttcattttataaggtctcttctctctctcctctcttttagaatagctgcatctctagagcacataatgattgcatattctcagaggttacttttaggatatgtaatcattagcagatctgtgagtgtaaatgcaggtcactttattctaggcttgtgttttgccttatccagtttatttttatttttatgttttgccttatccagttttaataacaggtcctggatcatatactacatatttagaagaaattagagtagtatctatacagagagatgatgagacaatcaaattgaataggctttatgctttctttaactttccttttgattccattgaaagctcttttaagatgtgttaaacttaaaacttatttgtggcaagtgaatatggtatgtgtgtccgtgtatgtacaatgtgttgaaaatgaaaacatgactggcacagatgacatgagtgggaacactgcaaatttggtgaagtcctaagaattttagaagaaaaagacttctcacaaacaaggcatacaactatacaaagtaaggatgtgtgttagtttctagaaaagttataagaaaatgggagaaatgtcatattattgctacatctttcacataaagagactttcaatgacctttttttaaaattgattttttattgtataaacttaaggcatacaactttaagccttttaagcaaagcttaaacacactgtcattttgggaaacagaaaatacaaatatgaagaaacagtaggtaaaaaaatactttgggatgatgttaggagtcaggggaccagatacagtggctcaatatcttaaaaagtcacttaccttgtggtaatcctgctataatctcactagaaatttggcaaagtatctcttcataagcatttgtttttaatttaataggtctccaaactactcaggataatcagatcatattttggttaacctcgatgttaaccatgataaagccatttggtgctcattttttatctaaaagatggaatgattttttttgactgcctctcctctttacaagtcaatacattatttctttcttcttacagttaatctgaaatttattctgttttataaacctatgccaaataaccccactaatagtaatgtgttaatttttttctaattattacagtatttatagctaatgttatccaattatatatattggactggatactgccttgcttatgtatgatacttaagttttgtcaagtcatttacaaggttcttgaatacagagtccctatagttttcttctatatatttttcttctttctattagcccactactaagttgagagtagatgcttgataatttgttgtcttgaaatcaattctaagaatttaaaactagatataaaccccttccccctccactattaccagcttaatcccatcaacagttcagaaaaataagacaggaaataattgcttgtgaagggccacacaagaagttaggtataaaactacaattggacctcagactttcaaacccataattctgaactcaaaacaaaaggccacacagcctccatctatataattagatttagaaagcactcaggaaagcaaagctgctcttgtcctgaaggaaagtttgtgactgtgtattctttgcagaaagtaaggactatggatctcattaaaatgtccccaacctcaggatactatcagtataaacattcttgaaggggaacatatattctgggtctgggagacaaatcccatctggtctaccttggatggaaggctcccctactctgtagtggttggttgttttgttgtgtgtggacagctgagagtcatttcctcatctttattccaaacgaagctggacactcccttttcatttttgaaaagtaatctgtgtgagaaggcagccagcatgtttacccactgggcttggagccagacttctttccctggttcttcctctctctgtttctcaatctcccctgctctaagatggccagatatgaaaagctgccaatcgggatgccagaacatcaaagagatcgctcatgagagcacacaaagtcccatttgttcagcacttggacggagatgccagcagcttccaggcagagggagaatcgaaggtttgtcttcacttgacttctcgctcacaccatctggctgatggagaatcctttcatttcttcccgtggctggaccaaagggagaatgactgtgaatagaagtgccttttcaaccttcacttgtatccatttttaaaaggacaaataaggtcatctctgcttctgaaattaattgttaagatttctttaaaaaattctttttgctattaataaccttgatatattggattctagatttaagggataaacatggtattggtatctggtaatatggagtggtctgatttttatgtgtcataaaagtattttatcagtgtccctcccaaccataaattctctttcaggtatttcacatgaagcgtagaattctagttagaatccttgagattctactcttactgctccttctttggcaaaagcttactttcagtattgaacagtgctgggagtatagtgttaagtggttggcagttattttatactgggtgaatatgttttagatttgtttcaaattacagattttgaggacagatatggtggggttggaaaacgtaaggatatttgtaggtgagaaggaaatccatctaaagacataaaaagtactggattggaagactcctaagcagggccaggattaagtgaggctgtcagcctgtgtgtgtgtgtgtgtgtgtgtgtgtgtgtgtgtgtgtgtctgatagtagtggtaaaagcacttaacctgagatctaccctcttaatttttaagtgtatgatacaatattgttaatcataggcacaacgttggacggcatatctctagaagttttcatcttgcgtaactgaaactttgtatctgttgaacaacaactcttctttcccctaatcctcagcccctgacagccaccattctactctcagcctctatgagtttggctgtttcagatacctcatataaatggaatcatgcagtatttgtccttctgtggctgctttatttctcctggcataatgtcgtagggcatagtatttaaggaggcatttgttctcagcctcatgtaagtgcaggctgagcatctgagtttgagtgcctggatacattttgcaccttgagagacagttttgcctcatcctagtatcaggacctgcttctaagacaaatagccactttccacaactttcaccaaaactattttctggttccacagaagcaactatgggtggggcaatgtatgctggatgagggtgagaagaaatttcataagttatgtgattttaggtgactcggactacttccctgagcataattttcaccctggaaacagaactaatatttattatctattttatccaacgagaactgggatgggtctgagatttcgccctaataattggtgctaagctaagaaattagcctctcacagttctatggatgctgaaggaagacacgcaactcctgggtcagaaacacgaggctgtgttactcatagcagccacagttgctaagtagcagcatttatagtgttcccttgaactccagttcccacagggcgacatgaagagggccagatacaagcagtgaattgcattacatgagatgaacccaaaatctaggaaccaaagtgttttataatgggcaaatcagaaggcctggccttgctctgcagagggatattattttttgtagactgaacagtaagcatgcttattccttgctctggggggattcctagcatatttgcccccagaaatttctttctttcctttcttctctcctctcctctcctctcctttcctttctttccatttttgagacggagtttcactcttgttgcccaggatggagtgcagtggcgcaattttggctcactgcaacctccgcctcctgggttcaagcacttctcctgcctcaccctcccaggtagctgggattataggcgcccgccaccacgcctggctaatttttttgtatttttagtagagatggggtttcactatgttggccaggctggtcttggactcctgacctcaggtgatccacctgcctcggcctcccaaagtgctgggattacaggcatgagccactgcgctcggccgaaaattcttttatatgagagaaaaacaaaccctatcttgtttagactctgttacgttgggatgttttatttgtacacaaactgaatcctaacaaatacagaatttggcatctggaggtggggtgcaataacagaactcaacaacatgtgggctggcctagccgtgtggaggcatttaggtagtgggtactcagataacaaaggctggacaacaaataactcttaatatggcataggaaaatatctggtcacatgctcacgttttatcctttggaagtcaaaccgcatgtgaattagagtgaaagcaaaagggagggaaatggtaggaaaacatcagaatgttggtgggtgttgtgtaccttttgccatttttagcaaagtcctgaaggagtgagagaggagctcggactacagtacgccagacaggaaacacatcgttttttacagaggctgtctctgagagtatcctgtggcataaattgcttgtgtgtcctgtaatttgaggtgctgaaattttgaaaaagccttattttcccgtagctcaaatcagagcacttataggtgatggaaactaagtagccctccttagtaggaggtaatacagtgccagcaagagcttctagcaagagctatagcaagcaagcttatagcaagagctctctgcagacaatgggaactagattgaaagtattagcttagggttcttattttcccatccaagcctgttttatcaaatagtgtcttagtggctcccgctcatttgagagagagggcaatagataatgaagagaagacagcaaataaaaatgagagttgccaggctgaaaaacttagtacacacaagatcttggttatttgtatgtggaactgactggaaacaaatagaagcctactaagatttgaagaataacattggcaaagagaccccaaacttgatctacagtgccctgtgacaattaaaccttttgagtgggctttgggtcccagttggaaggcagctgtgaaagctgtgcttgtccccagtaggccattcactccagaacctagttcactatgtccatagctgatagtggacatagagaagtcccccaggagaaaaggccaaagggttacagaaaatggctaagaatgctttcccagaaggcagaaccagaggctacaagaagggtaaaccaaggaaccaacctcactgctagggctgggcatctttcaactctacccagatggattttataattgcttcagccagtgagtgtgctgtgttggtcatccttctcatttccatctgggaggctttattactgttttgctgttccttttctgccacagtgtagcaagtttgcctcaggcaggattttctcagtaatcagatcaccgggttatgacagccaacattttgacctgacggagagaactgtacatcacccagagatcctggactttgagctagatgcagtaactgggggtgactttggttcatctctgctggagaggaagcgtgttctttttgtaggagaggaatgcacatggaaggagttgaataacccaaagcgcaggctatcacaaagaccactgattatctcaagaaatccattgttcttctccttctccaacataaaactgcaaattcactttaagggcctattgactcagctaaatgattatatttcccagcgtcccttgcatccttgtgcagctatgtcacaaagtctgacaaataagcggtaagaggcagtattgtattatactttttaaaaggaaagattcagattcttcctttttttctcgtcaatcctgcttactggaacatgggtgtaatggctgacactctagttgctattttggatggtggagatgaggctcctcactgtagggatattggaatgaaaaattgcacaaggcaaaacactgatgaatttggccaggtgcggtggctcacgcctgcaatctcagcactttgggaggccgaggcgggcagatcacgaggtcaggagatcgagaccatcctggctaacacagtgaaaccccgtctctactaaaaatacaaaatattagccaggcatggtggcgggtgcctgcagtcccacctactcgggaggctgaggcaggagaatggtgtgaaccctggaggcggagcttgcagtgagtggggatcacaccattgcactccagcctgggcaacagcgctagactccgtctcaaaaaataaaaaaataaaaataaaacaaaaacactgatgaatttgtggatctgctaagtcagcattggactgctagccttcatattttctttataggacagaataatgccttttgtgtttaagcctttgttaagttggcttttctttcatatgctgctgaaactaattttgacaaagtaaaactatacaaatatgaggatattcttaacattgtgagtcaggaaatttgtcagaaagagtggatgcatcagtctttctaacagaaacaaagtaaaaattattcattaaaagtcaccttgacaatgggtttaaagagtagtttttttctggtatgaatgcctccatagcctggaccatttctaagattctaaaatcttaagtccataagggcatagtaccttgtcatactcactgggacctataagatattaataattgatacatcagggatcttgctgaagggacagtagtaggctcaattatttgtaccatatgacgctacctattgcaacacaactaattagaccaaaggtgggaaactaaccagtgcagtcaatgcatagactaacggttagtggcctatgattgacatgttccggtatgaaaagaagatctaggtcaatcagcatctctatatcaccagtttgaagtagaacatccagatggatatcagttagcagtggaagctaaagctaaagtcagcagaaatggtcagagtcagactatgatgaccatatataagacaaaagtagaggatggcagaaaccataaatgaacagaagcgtaggtgagtaaaagacatagggtagaaaatgaggatgctgctgaaagtagtatgagaagagaggaggaacacacaaaaagtagagatggagaggaaaactaagtcttgttattgacagagatatttgaattttgttgctgagtttcctgcagctgttgagcaaccatttttgtttctatatggcaaggtaagactgagttattgggttttccgcttcctttatcttttgcgcaactcttcctccgatatatacttataataacacattacccattgctggaaacatgtttttctatcactagcaacaaacctacctaattttaaattacttgaatcctatttaacttgtaaaaaggactgaattgaggcgatttatcatattaaacccagtgtcatgcaacacacttaaaataaggttaagtgggagagaaagatagttatagcaagaaactaaaacgagatacaattttttataatttcaacttttattttagattcaagatgtacatgtgcaggtttgttacataggcatattgcatgatgctaatgtttggggtgtgttggatcccatcacccaggtagtgagcatagtacccaatagtttttcaacctatgctcccctcctgccctcctctagtagtttccagtgtctgttattgccgtctttatgtctatgggtacccaatggttggttcccactctaagtgagaacatacagtatttggttttctgttcctgcattaattcacttaggataatggcctccagctgcattcatgttgctgtgaaggatgtgattttactctttgttatggctgcttagtattccatggcatatatgtaccactttttttaatccaatccaccattgatgggcacctggattgattccatatctttgctattgtgaatagctctgtgatgaacatgagtgtctttttcatagaacaacttattttcttttggatattgtatgagtccattctcatgctgctaataaagacatacccaagactgggtaatttaaaaaggaaagaggtttaattgactcacagttcagcgtggctgaggaggccttaggacacttacagtcatggcagaaagggaagcaaacgcgtccttcttcacatgatagcaggaaggagaaatatgagaacctagcgaagagggaagccccatatagaaccatcagattgcgtgagaacttactatcttgagaatagcataggggaaactgcccccatgattcagttacctcccacttggtccctcctgtgacacatggggattatggagactacaattcaagatgagatttgggtggggacacagccaaaccatatcagatatatacccagtaatgggaatgctaggtcaatggcagttctgttttaatttctttgagaaatcccaaaactgccttccatggtggttgaactaattttcattcccaccaacagtgtgtaagtgttccctttttccctctgcagccttgccagcatttgttatttgttatttgccagcatttgttacttgttattattctgttattttctgactttttgataatagccattctgattggtgtagatggtatctcactgtggttttgatttgcattttcctgataattagtgatgtggagcatttattcacgtgtttgttggctgcttgtatgccttcttttgagaagtgtctgttcatgtcttttgcccactttttaataggtttatttgttttttgtttgttcaattgtttaagttccttatagattctggatattagacttttgtgagagtttgtaaatattttctcccattgtgtaggttgtctgtttattttattgagtttcttttgctgcgcagaagctctttagtttttaattaggtctcacttttcagtttttgtttttgttgcaattgcttttgagaacttagtcataaatcctttcttaaggtcgatgtccagaatggtgtttcctaggttttcttctaggattcttagagtttgaagtcttacatttaaatctttaatccatcttgagtaaatttttgtacatggtgaaaggcagaggtccagttttattcttcagcatatggctagcagtctatcccagcaccatttatggaatagttctttccccattgcttatttttgttgactttgttgaatttcaggtgcctgttggtgtgcatccttgtttctgcgttctttgttctgttgctttggtctatgtgtcttgtttttgtaccagtaccatgctgttttggttactgtggcctgatagcatagtatgaagttggataatgtgatgcctccagctttgttctttttgcttaggatggcttaggctatttgggctcttttttggttctatatgaattttaaaatagtttttttctaattccttgaaaaataatgttgatagtttgatagagtagcattgaatctgtagattgctttgggtggtatggcataggggaaactgcccccatgattcaattacctcccacttggtccctcctgtgacacatggggattatggccattttactgatattgagtcttccaatccatgagcatagcatgtttttccatttatttatgtcatctgttatttctttcagtagtgcttttgcagttctcttcgtagagatcttttaccttctttgttaggtgtattcctaggtagtttcattttttttgtgtggcattgtaaatgggattgcattcttgttttggctctcagcttgaacgttattggtgtgtagaaattctactgatttttgtacatcttgaaatattactgaagtagtttatcagttccaggagctgtttgggttgatctttagggttctgtaggtatagaataatattacctgtgaagagaggtagtttgacttcttcttttcctatgtggatgccttttatttgtttctcttgcctgattgctctggctagaacttccagtattgtgttgaataggagtagtgagagtggtcatccctgtcttgtcccagttctcaagaggaatttttgaagcttttgtctgttcagtatgatattggctgtgggtttgtcatagatgggttttatcattatttggaggcatgttcctttgatgcttactttgttgaagggagataaaaaccttaatcatgaaaataatagtccttattgagcagtttcaggctggtggtaagcattttatgtgcattatttaattattattgtcattatgatgatcacatttagagcagccttatcatgtagctgtctttcttacccccacttcacagataaaaacattgaggttaaaagggttaagtacttgccgtttctatcaaatggcagatctggagatttgtgcttgtttgaccttgaatctacattcttaagcactatgtgttagtgactgtatttaccttgaagctttccagtcacactccccactgataagtagctccaagctgtggcaaagtataaatagttagcatctgcagggctgctgttgatgaagctggcagcccatgagccctgtcacttgggactccaggaaatgtcttgggtctgcacttaggaggccaattcttaggaaattttgcaagagacaagtggcctcttcaaagacatagtgagaaaattctcattccacactcccttgacacctaggaacttaaggtggaattgaaaccattgtgaacctgagagtctagttctagttaccaacatgaactctggggcccaggctatgccactaagtatgaccatgactttaggcaagttgcttaagctgtctgcccctgtttcctcatctataaaatccttcaaataggatttaattatattttataagacctgtaagttttaaataatttaatacaagtaaagcccttgaaagagttcatggcagatagaagagcctgataaatgagggttgttataattacagttcttttctttttcgttatgtccagttgacaggtctagtggacagaagacctcatcgagtgctgatagagctataatgtgggtgcctgggagcgtcaggcctcatttttactccttcagacctgaatgattgaatctattaataaagctagacctatcttaccctagctcaagttctttgccacaatcttaataacaacagctcaactaacatctcctaaatgtttaataggagatgttatgtaattttatggagatgttatataataggagaacttatataaatgccaagcactttagtaaacacttttgtataaatcataacctttacaacaacctgataaggtagatgctatgggtatgcccacttcacaggtaagaaaaaattataactgttttaaagtgatagcattgaaaataaaaggcatttactcaattaaattgtgtctgagtttctgtgaaatcacccaaggaagttctactctttttcttttctttcatttcccctttccctttctctcctctcctttctcttctcccccactcctctccctttccctcccctttcctttctttttcattccatttcattccataccactctattcatcagctgagaagagaactgacagtacagattggtgtcacaagcatatcacagaatgaagagctgaatgaaagtacgtgcattggcacacaagacctaattagcttggaagcattggtgtttactgaaagtatgataggttaacacatttccttcctccttatactgtttgcctcacttgggccttcatcataccactcaaccacaaaagtcaactcagcttgagaagtaggaagattcctagaagtgaatgtgagcaaaccatgcaatgcaccctgtatttcctcttattcacaccttactagagatgaataaacctggtccccatccttccagtacacctcttttttcattgaagatcattattgcttcattccatagatgttatataagcagaaatttataaaatgtaattttttgttacatgactaagcttttgtacactctcaaaatgaactgctttttgacttgtttgtgatatgtttttcttaaactttttactataaaattgttcaaacacaaatatttgaaaaaatactaaaatagttacctgcatctacctaggtttcatacatctacaaacgtatatattcacttttttttttgcttttccatgtgaagataagtagacattgtgaaatttacaccaaaatatgtcaacatagatctccccaaagtgatcgtaatttattacaaaaacatagtacccttacacacctatgaaaatctagtgtcaggttcaattcaaattttcacagttatcaccaaaaggctttttactattttgctaaaaagaaaaacaacaacaatgtccaatctaggtttatgcattgcaattaattatgtatttttaggttcttttaatttacaatttcctataaaatattttaaagttatctacagacagcttaacttttttgatgtatagttctgtgacttttaacatatgttgatccatataatcatcgctacagtcaggacacagttttatcacctcaaaacatttcttcaaaagtcccttttgaagtcaattcctccttttgtccataaactctggtacctattgattctgataacactatgacctgtaggtgactgtatcgtactgtttggtttttacagaacatcttataaatggaatcatacagtatgtaatcttttgaaattcacttctttcacttatataatgcatttgcgctttattcatgtttttgtatgtatcaatagttcattgcttttttatattccattatatagatagactgcaatttgaaattatttattttagttaacatatgataattgtacatatttatggggtacatagtgatgttttgatacatacaatgggtagtgatgagatcaaggtaattagcatattgttatctcaaacatttatcatttttctgtgttgggaacattcagtatcctttcttctagctatttgaaaatatatagtgttattaactatagtcatcctacagtgctataaaacactagaacttgttcctcctatttagctgaaattttgtgtcctttaacaaatctcttcctgtccccattctccctacactttccagcctctaataacttctactgagctttttacttctatgagataaactttttttagtttccacatacgagtgagaacatgtggtgtttaactttatgttcctggcttatttcagttaacatagagttctaaagttccatctgtgttgccatgaatgagaggattttactcttttttatggcccaatagcattccatccacaatttttaaaaattcatgtattcattgaaaaacatttgggttgtttccagtttctagtgattatgaataattctactataaacatttatacataagtctttgtgtgaacataacttttcatttcttcagggtaaatacctagatgtggcttgctaggtcatgtggtaaatgtatgtttaatttttcaagcaactttcaaacaatttgccaaacaattttgccttttcaccagcaatatatgagagttccagttactcagtacttggcttcaatttgcacttccttcataactaataatgttgaatatcttttcatgtttttacttgctgtgtgtatgtcttcttggtgaagtgtctgttcaggtcttttggctatattttaattgggttgtttcaaactgtcaagttttgagagttcttgttcttcatgtattctagataaaagttctttttcagatatgtgatttgtaaatgttttctgtctgttgtttgtctttttattctcctgccaggatatttcacagagctaaagttttaatgtttatgaagtccaatttatcaattatttattttttggattgtgttttaatggtgtttaaaaacacttgggctaacccaaaattaaaaagatttttctctgctgggcacagtggctcaagcctataatcccagcactttgggaggccaaggcaggaggattgcttgagaccaggagtttgagaccagactaggcagcacagtgaaaccccatctctactaaaaatacaaaaattagccaggcatagtggcccatgcctgtggtcccagctattcagaaggctgagatgggaggattgcttgagcttgggaggcggagattgcagtgagcctgggcggcagagcaagaccctgtctcaaaaaaaaaaagttttgcttttttcattcttatttaacctcttgatagttttaaatggcatcatttgactttctcttttaactatacaacaatttattatattcttcattagcctatattttatttttatttttaattttttaattttaaattaaattaaattaattaattaattaattaattttttttgagatggagtcttgctctgttgcctaggctggagtacagtggcacgatcttggctcactgcaagctccacctcccaggttcacgccattctcctgtctcagcctccctagtagctgggattacaggcatgcaccaccacacccagctaattttttgtatttttagtagagatggggtttcaccgtgttagccaggatggtctcgatctcctgagctcgtgatctgcccgcctcggcctcccaaagtgctaggattacaggcgtgagccactgcacccggcctatttatattttttctacatattttatagatgcattctttctactttgtcagaacttatgattttatatgctatttttttaacctatactctcaattttgttttattcatagatttctagttaaacatattaaatgttcactaccagtatgttttcttgttactactattaatattatttcttggttgcatgaagatcatcctctagaagacttcttgtcaaaggtttataggttcattatttcctaagtttctgtacttttaagactattttgttatagtcttgatatttcaatttcagcttagatataaaatctctgggttttgctttctttaagtatcgggggaaattcagtgcctgatatttcacatagtttcttttctattttccgtaagtgtcagcgggtctgagaaataatggtaaagagtacagaagagagaaattttaaagctgagtatccggggaagacatcgcatgttggcaggttccatgatgccccttgagccttaaaaccagcaagtttttattagtgattttcaaaaggggaaggagtgtatgaatagggtgtgggtcacagagatcacatgcttcacaaggtagtaaaatatcacaaggcaaatggaggcagggcgagatcacaggactacaggaccggggcaaaattaaaattgctaatgaagttttgggcacgcactgtcactgataacaccttatcaggagacagggtttgagagcagacaaccggtctgaccaaaatttattaggaaggaatttccttgtcctaataagcctgggaacactacaggagaccggggcttatttcatcccttatctacgactgtaaaagacagccgtccccaaagtggccatttcagaggcctcaccttagggacgcattctctttctcagggatgtttcttgctgagaaaaagaattcagcgatatttctcccatttgcttttgaaagaaggcaaatatggctctgttccacccagcccacaggcaggcatactttaaggttatctcccttgttccctgaacatttttgttatcctattcttaaggtgcccagatttgatattgttcaaacactcatgctctacaaacaatttgtgcagttaacacaatcatcacagatacctgaggtgacatacatcctcctcagctcacgaagatgacaggattaagagattaaagtaaagacaggcataggaaatcacaagagtattgattggggaagtgataaatgtccatgaaatcttcacaatttatgttcagagattgcagtaaagacaggcataagaaattataaaagtactaatttggggaactaataaatatccatgaaatcttcacaatttatgttcttccgccgtggcttcagctggtccctctgttcagggtccctgacttcccacaacatttaagtttcttgaaaatgtcactctattgttggctttctttgtaagttgctcttgagaattatggttggcttgtcttactcttatacctaatttgctcttttttgtctggagggcctgcatgtggatttttgttctttctgttttaaaaagtctgatattttgcaaggctatttctcaagttcaattatcctcagtaaaattttccaggtacgcaggaagccctttcaatgtatagatttagattttcttggattattggtttaaatattagctctgtttcattgtcttgtttttcttcttcagggattctaagtgtacatatattgaatatttgtctaccttagattccaacctccttctctctgacttttaaaagttctttatgttattttcattttcttggcttctttctcgcatttattccttagtaatgtgtcacttaaatctattttcctttggataccttataatttattcttcattttagggatattttatctgtgtaatttctttcctgagatctatcaactcattgcatttctttctttatttgtatacttctgtgcttactttttgcattttttattagaaattatatatgtatatctaaatgcttatttgaagatatttaattaagacttgaggttatattatagtttcttctgctttgtggttgtttgtggtggaaattttttatgatatgtaatatctttttttttacaatagcattgtatagggttaatttgttttgcttctattcttatgcattttcttgatgggctttttaggttgagcatattctcttcagtgagtgtaataaagttaaatatcactaatagatgattttgttggtgatgagtggtggtagataggaaataagaagggtctacatgtactgtgatagtttttatttctgcatgctccttaatttttcctgcttgcttcctgctttcacttcactgacagtctatgacgggcatttcctcttctctatttttttccctttcccccagaagcaatgcttcaatgttgccaatttccaactcgctcagttgtaaaccccttccctgtagctgtcgctgtgaactttccagttccagacctgtgttcagtattttggtatttagctttggacttttctctttctaagggtaattttgtctttgctttatttaaaagtcccctgatattttttttcttttacacgaagtgtttaaaggctttctaccctacctttcccaatcagtgaaaatctgctggaattgtttgtgtctttatatgaagggaaattgaagttcatagtattcttggtctcttagtaatgctgaaaatgtgggtcaagtttcatttgatttgagctcctttttcttttcttccctgttcctccccttctcctcctccttcttggaaattatgtggagagatttagattcaggtatccacttctatggccaattggattgcctactttcacatttaatttacactttgtctggattattagtagttggaaatcatttttcttttattgtctttaacatctagagctgatattgaaaagttaaaagccattctcattgttggtcttttgtatgtgacacacttctgttctctgaaacttttagtatttccccttttcccaaagtggttgcattttccaggtagatgttctgctgtgagttcctttttctccattgttcaggttactagctggagcatcttgatctgaaaacatgggtccttcaattctggaataatttttagaattatttcattgataattttgtctgcttatttgtataccctcctcactgaatccttattattcacctgttagacatcataaataagttctttaggtttatttttctcttctttggcctccttttcttctctctctctctctctgtacctctctgtctttctctctctctattctctcacttccttcctctctccttccactttctaatgttttctttaaagttttctatttttaccatcatattttaaattttaagagataatttggatttttgcttctattgttattttaaaataaaattttattcttgtttgtagatatatcttccttcatttttctgaataataacgaattttgtaaaatttttaccctctgcgttgtcataatgacctccattttgggttgctttcatgttagagttttgcctaaagtttagtaatctttggtttggctgtttatgttaacaagtgtatcattaaggagctgattgcaagctgtaggcaatttcatgagtcttgttgaatgtaggcttctcagtaggagggtataatttggttatttttgttgaggaaacacctgatattataatcattaaggttttttggggggatagttggattcctgagagaaaaattttccaatgcccccactgtacagacaaaaaatgaataatcgaaaccgaccttgtccaacctatggcctgtgggccacatgtggctcaggatggctttgaatgcagcccaacacaaattcgtaaattttcttaaaacatgagattttgttatgatgtttttagcttatcagctatcattagtgttaggtagttttctttgtttgtttgtttgtttgtttgtttttatatatggagtgtcactctgtcaccaggctggagtacagtggcacaatctcagatcattgcaaactccgcctcccgagttcaagtgattctcttgcctcagcctcccgagtagctgggactacaggcacacgccaccacacccagctaatttttgtattttttgtagagacggggtttcaccatgttggccaggatggtgaaatctcttgacctcgtgatctgcccgcctcagcctcccaaagtgctgggattacaggggtgagccatcgcacccggccagtgttagtgtattttacatgtggcccaagaaaattcatcttcttccaacgtggcccaaggaagccaaaagattggacacacctgatctacacaaatacactcacaacattgacaaatttcacaaatataatattgatttaaagacacaagatagaatggaactcatatgatgtggttccatttttatgaagttcaaaatggtgtaaatgtgtcagttgtgactgcattcataagtggtaaaattatttaaaagttttcatttagggtttcctgaaagcagaacaagagtcaaaggcttatggcaaattgtttatgtaagaagagatcttaggaagcagggagactgagaaaaaaaaaggcagaccaatataagtgtgtattttccaggccactgataaagacaacaggttgtattacaccaggatctctgagggctggacagatgccttccagaattaggtctgatgaataggaggttggggaatttatccatcagctcctatttaccattgtgagggggttgtactctggggtgataactccccttcctatatgtggtggtcttggaaatttcttggaacagaaaagctgagattgcaagccaagcacttcaggtgcagcattgtcagcattaactgagcttacaggtaactgtccaacagagctgtgattgcaattagaggcggactgaggaattgtgacgcacagcccaaaagtgtctgccacaaaaggcaagattatgactaatagcagactcagcattgctggttatccctagcaaggagggaaaaattgtaatggaaaaggtgtaaactatgggcatggaggtgttttggagtgctgtaatacctcttgattttgaattaagcaaatattgcattgtaactttttaattggatttataacaattgggttattatgatggaacccttaataataaaagagggaactagattaatggtaacagctctgaagtccaagtatttagcctcatttctatattcaaattatgtatgatgtggatggggcattcgtgattttattcaacgagacattaaaaaataatacaagaagataaactcacagttctgctgagtactgagaaaaagaaagataacatggaatacacttaagagactatatagttttggtgtttggtaataatggtctgaattagtgtggtggcagtgtgaatgcaaaggaaatattgatataaaagctcttcagatcagtttgacttgatgaagaaatcagcagatatattactgaaacttaaaactatcatttttctcaaccacagagaattgactatgcaattttctatgtgtgccacagtattccatatcttagacacactttgattatagctcttatctcactgagtttggaacacgtgtataccagtctacctctctatttcaaagccaacattgagaggagaaattatgagtttcttaaatatattagttgcataataatgttcattgaatgaatgaatgatttagtgcaatggcttaaatgagactgaaacccaagctgggtattaacttcatcaatgagaccctttgctagtgctaatattgagctgtagagggaataggggaatagacagaatggtgataacagatgagatttttttttttaattgcctcttctgcaaaatagcaaaggtgtgcttttcttttactcagtggatcaggcagctgtaaagataagaccaatcttcttagttggcattttgggttttacatggttggacaagaagaacagactccttaacttttattttctgccatgaaattgggcttgcatgtgaatttgtcgtctcttacttgctactttaatccaacccttcctatagggggagctaagggatttcagtacattagatgtaataagttcactgttggctgaatacagcatcactacttttatattaaaaatatcataacactatcagtaatgtttgttgaacagatgtaaatgactgggatttttttgtcacctaccatgagtgatttactatgtcgagaagtacccacagggtaggatgagtgagaatggatattaggaccccgtgtcagtcagataagctgctactcctgggagcacagtttctgagaagttacccaagctcaatgtctcgaaactaaaaaaagggaaaaaatacttctcaaaatctatgccaaggaaaattatttcataatctgtattttggtattgtcatagtgaatggggtaagcaaataacaatacagacagcatgtgctttgttctaacattgccaaaattagatcagagtctgggataagatcactagcaacagacattgatttttcacatggtacctctttggttgctaaaaatggtgcataaaactgttttactctaatcaacatggtctacatcctcttccttttccctgcctcactctcttaatgacaccttggccatttgaaaacagtaggatagtcagcagcaattgttaatagtgaacaagatcatagggactacctctctgtgataacaattccatcttaactttcaggagcttctgcttttttttagtatcatgaatgtctgattccaaagaagctcctgcttatggcccataaacctctgccataaagtcagaaatgctgtgctcacttcacaataggcaaaaactacagtttaacaagctagttgttcacctctccccatcatacttacatgatgcttttaccttctttgtttgtgtactccctaagaatgtcgtatctgggctttaaacaccttaaatgactcaaactgttgtgaaaacatttaaaactatttgaaaacagcaggttagttagaaaaaggaaatggaatgtaagaatagaaagggaggggatacaacttggaaaaatatacttgtcacaccagtcttgtttacactaaagactcagcagtgttttaatagatgaaacataaaggaacttaaattgtatctattaaatacactttattaaagtgaacaaactatcctacaaagagcaattgctaaatttttggataacttcattcttcatcatagaagtgatattaaaactttagtgatataattttacgaatttaattgcttgtgatttatctcattttatgttgaacttttttcatagaattttcttctgctttctttaaaatttcttcttggccaaaagaatcatcagtaaaattgagaatggagaaaaatgaattgcacctttcattgtggtttgcttttacaagcaataaaagccactgttttttcctcctttaaataaggaaaatgaatttggcttgatgggaaagatttgtgggtcggggagagtaagggagagggaagaaggaacaatttttattttgtttttggggatggaaacaaggcagatgcattagtatcatcagtgatacggtttcctgtgctttgcttactgacatagtgacttcctgtgattgccttaagggctgtggaatggagctgctggtgtactccctgaccctctgctctacccacatgcccaggaagggcaaggtgactgacatttctcctctatagaaacttgctgtctgtacccccaatttcttctcctctgccctttagtcccctgcttcaagggaatggcaaaagattgctttgaaggttaattaggatttcactttgtgtacaagaatggaaaggggaaggatatatagaacaggggagaacaagatgtttgcatacaaaagccactggtaaatcaggtttggtagaatggagtttgcacagagaataaagaatggattgcaattttcaactgagatcatagaaaatattttttaaagtgtaactatttttaggaggtgttagtgtcaatctctcaggaaccatttttatatataacatatgtgtaattacttcatatagtgtgaaagctttatacaaatctcattaatatgagatattatggtattagcaagattgtatgagatcatggagatggggtagaatatttaaatgtttctcttgatctgcatacttcacactgtttataaactaagaagtaagattaatttaacattttaaattccctgtttagatttctatgttgtcatacattttagtgtctataaaaataatagcaatcctggttattttccattagtcaaccatagtgcatgttaaaaatctggagttattttttgttgcctacccatcttttccagctgatcttcttcttaaatctaaaatattctatagctatttcttcttctctgtatatttttagcaatcatcctatttcatgcattgtcacatcacttcaactttttttttgttttttgagacagagtctcactctgtcacccaagctggactgcagtggcatgatctcgactccctgcaacctccacgtcccgggttcaagcaattctcctggctcagcctcctgagtagctgggactacaggtgcccgccaccacgcctggctaattttttttaatttttagtagagacggggtttcactgtgttggccaggctggtcttgaactcctgacctcatgatgtgcctccctcttcctcccaaagtgctagaattacaggtgtgagccacttcacctggcccacacctaaactactacaatagttcttcagtttctctatcttcagcattttgtactcaaatccatatttctcaaaacaacttaaaaatctcaacacccttttcatcattcaaactaagtatatgcagagacttgacttacagctgaagcaataaggcaggaaataggaggtacaacttttcaaaagaataaagtaacattatctttaaatgaagataatatgattgtgcactaaaaaatcaactgaagagttattagcattagtagaaatttgttaaagtggccagatactaactaaatttgtaaaaacccatgatttccttgcccttcaggctcagggacagatctacttgtgcttatgcactcgatgaaaatggtttcattgccttctgaatctcaccaactccgtcatgagacccaggccaagaggttgggcagacaccttgacgtatctgatcactgttcttcttctttttttagctaagcatattttcctcaaatataacctggtctgcagaggtgcagctctgacttcaacatcaccattaataacttcatcaccaagcaattttaccttcttggagctgaaatgtcaagcatcaccacttgtgtggagggactttgtagagctaaaaagcctactggagttgtttcagaacaacaaaaaaaccaccccccaacaattgttgaagagtatttcatttgtgtaataaaagagctgaaaaaaatattccaattgagcattctctggacacccacagtcccttggccctgaagaaacagttgaccttactctgggatggggcattaacaaaagacaaaaattaagtcctgagaatcagaactaagagtcagaaatacgcaagtggttgacatctttgtgtctcagctttctgacctatatcctaaacatgatgtgtgtgagactcttcatttgctgtctatgaatgtataaatgttataatgtaagaatgaaagagagttgtgaactcccttgattctgcctctcttgtttgttctttgaagcccaagtgcccacagatactcaaacttactttcttaggatgctttgaagatatgtgaggaatctcagcatcataccatgcaggatggggttttcttccttcttccctcttgctggctttctggagataagtgttttacccactcctttcctgagaccttgtctcctaataattaaaaaaaaaagggtctggtaaaatggagaagctatgaagtgactgtgcgtcataattcactggaattatgctagtgataaggtggtcagacttatcaagacatcaattgttggcattgttgctgtgtctttccgaggccagatcagcaaaggttgttcccttcgatgcttttctcctacttgaggagtaaaggacatcaagtgttaaggggaaagtgggtggatgattcactatgaacttgagccagtggctgaaagaggttagattatagaggagggtggcagaggatgggagagcagggaggaaggattttctgcagctcatctgaggtggggactgataggcattgctgagagcagaacaatatgtttatgctggtgttcttgttatgttagaacaagttcttccttttggtaacagattacacttttctagttttccactaataagggcctaattaagaggatttatttgcaatttgggctactggtcctgatttcttccctttgcctcactccactcatgtcctttacatcagcaaaatgggtgtcctttatttctgtatgcctggcagggaggaggagatagtttctctatcttgggtcagttgattcttctatactcagctatctcacaaggaggggtgtgcatcctggggaagcatcgtccatgtatgcaacacctttggcgtgaaaattcttgaaggagcacaatcaattctgaggctgcccacaagacctgactagagtggggacaaagtagtctagttgccttaaacccattcaggttcaatgactgaaagagatggaaagagtttaagggacaggcaattattcacagttatttcaactggtttcttacagctatctttttttttttttttttttttgagacagtgtctcactctgttgcctaggctggagtgcagtggcatgatcttagctcactgcaacctctgccccacgggctcaagtgatccttctgcctcagcgtcctgagtatctgggatcacagatgtgtgccaccatgccgggctaatttttgtattttttgcagacatggggtttctccatgttgcccaggctggtctcaaactcctggactcaagtgatctgccagccttggcctcccaaagtgttgggattcagttgtcttttaagaaaggaaaatttgctctcaaaaacacataggaaaatgtcaaacttttttgacacttgagcagataccctatagaaagaatactatcttgttttctcaccacagtttctaagaaagtgagtaggaaaaatccagtgttttttcaaacggcctccagaatgattctcaagtggtagttgaatagtgagagaatcataagagaattcaagtgtgaggaattacagcattagaattcacatatcacatgttgaatttgtagctattattctttgaaatgaatacaggttattcgttaccatgtttttcaacaccttcttttaaaaagttatcaacctttcacacatagatagctatatcaagtaaaccctatatagtatggtaaataaaagttgctaattcttcggacagctaattggcaaacaatactacatcatcgtttagagcgattggatatagatttggctaagattatagttcaagatgaatttgggaaactgagtaaatcgtcagatcaatcaatcaattttcttggggtaaaacgtctacaaatatgatttttgccaactctgcaaaatacgagaactgaattaagatattgtgaatagctctcactttattgggttccatttatgtatgaaggaaagatttttcacgtgaataagatttctaatctgggcaagatcttagtgtaagtgtttctaacataaagtttcatcttttataaactttccgcttgtcaaaaagtttgatagggttaaacaaagggcaaagaacatactgataataaaagaaatgaatacaattaaataaattttaacaagttaaaattaaacagaaaaattaatcgaatccgatgacaatatgatggcagcttttctcaaaataccaatacatttatgtcattcatagatacaaggttttcttttcagtgttgtagttaggatattgcagtaaatgtaaggatctagtggtggatgagggaaattgaggcagtagttatatatatagatacacacacacacacacacacacacacacagagctagaagtattctttgttgaaaaacccattgtactttattgcactattaagggaaatggtccaaatttagtgtggtcttggcctagatttttgagatagttaatattgagatatgttcatattttagttttgatgaatcaatttaaaacaacttagagattacattattgtcccagttcttctgagaattgtatcctctctgtttgtgaatctgttacttaaaaaaaagaaaacaatgcgtttaagaatcagtactaataagtggcagtggagtcatgctgtctggcaaaaataaaaaagagcagcgtttttggaaacggactttttgtggcttgggctgtcttttaagtctcaccggaagttaattaaaatgagctggggttttttttgttttctttttaagtttattttatcatttttgagtttactcacttagtggcagatgccagaaaattcctcagtccatgttactaattgaaaaacaactctcaatctgggaggagagctcagacattccagatatctctttctagttggattaaagggttttcattctaaatatcttatttggaagaaatgtgaggaatttcaatgttcccaatcttgaaaccatgaacaagagggtcagccatgccaggcttatttctccaaattcttttggagctcaaaaggtgtggtctggactaggatgcctgtgggtgatatccaggagtttcatatatatacatatatatatatgtatatataaacatgaatatatatgatttaaaaatatatatatgatttaaaaatatatatagatttaaaaatatatatgattaaaaaatatatatatagatttaaaaaatatatatgatttaaaaatatatatagatttaaaaatatatatgatgtaaaaatatatagatagatttaaaaatatatgtgatttaaaaatatatgatttaaaaaatatatatgattttaaaatatatgtatatatatacacacacacattcataatctgagtgtatccttattttaaaaacatgtatattacttcatatcctgattcctttagggaacttcagtttgctttgatcagtatttctaagggtctatgctatgttttctggcttgccaatcacttagacttctgcccttcaaagataacattcctggcagtgattactatctctgtgtgggggtatgttgccagcagttatttcacattgtgcaccttgagtgtttgttctgatgtagctgcagatgatatttccagttgtcatttttgtctcaaggttagctaggcttttctcaaaacagaacagcctctgtgttgtagcagtgtacccacagactacaaacagagagaatttcagatatctctaatgcttttttgaagaggtttctttctcctttccttttcttgtttagtagttcatgtcacatcatagggtgcatgtttggataataagattggtaatacactgggaatgcctctgaatactgcctaatttagcaaagcacttgttgttccccccgccccataaggcacagcgaggctgtgcagagtgagccattgattttctactccaacttcagtggcttaggctggcagataaaataaagtgagtgtatgtaggggtggggtccctggggaatgtcttaggagcgccaatagaagtcagataagaaggtagggaggttttcaaggaagatcatagtgaaaacatgctgttccaactttaagaactaagagatttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtaggtatgcggcgttatttctgagggctctgttctgttccattgatctatatctctgttttggtaccagtagcatgctgttttggttactgtagccttgtagtatagtttgaagtcaggtagtgtgatttctccagctttgttcttttggcctaggattgacttggcaatgcgggctcttttttggttccatatgaactttaaagtagttttttccaattgtgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctctctgtttgtctgttgttggtgtataagaatgcttgtgatttttgtacattgattttgtatcctgagactttgcagaagttgcttatcagcttaaggagattttgggctgagacaatggggttttctagatatacaatcatgtcgtctgcaaacagggacaagttgacttcctcttttcctaattgaataccctttatttccttctcctgcctaattgccctggccggaacttccaacactattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaacaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccactatgagataccatctcacaccagttagaatggcaatcattaaaaagtcaggaaacaacaggtgctggagaggatgtggagaaataggaacacttttacactgttggtggaactgtaaactagttcaaccattgtggaagtcagtatggtgattcctcagggatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacagtgatagactggattaagaaaatgtggcacatatacaccatggaatactatgcagccataaaaaatgatgagttcgtgtcctttgtagggacatggatgaaattggaaatcatcatcctcagtaaactatcgcaagatcaaaaaaccaaacaccgcatattctcactcataggtgggaattgaagaatgagatcacatggacacaggaagaggaatatcacactctggggactgtggtggggtggggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaaaaaaaaaaaaaaaaaaaagaattaagagaaagaatttcaaccgggggtggtcaagtcaaatatactacttaagaaagttataaaaatggttgtaatgtggaaacagattccagaataaaaatccttttgtgaacacttgatttggatttctgaatttaatcattttcagctgcaacaacaaatgcttgaaccacgtaagaagctttggcttcccatattttaacagattttttttctacacattagtttgttgtttttttttctctcatttcatgatgtttccattcagctgttggcataataatggattacagtgtggtgaaggaaagagttggggtttcagattaatacttgagttttcaatccctgcttttataattactaactgtgggaccttggacaaatcacattaactcgccaagtatcagtttgtctataaaataggataaaaatacgtaaaacacctactacatgttttctgcaacatataagatgggagaaattgttgctgttttattatcatgattactgttttgaaaattaggctaagataatataaaagtagtatttagtgagatttgctaatagatgaaagagaatgaaataaaatctaagggtcaatatgcagcaaagtgtgctgctcaaaataaaatcagtcttcttgttgaatttgacatacatatctcattatgtgccatatattttcactctcaagctcatctgtgttctgcattaaataatgaattcctttggaatgtgagtgaaattttccagaagttattaatttaaaagttaatatggagatcaagtgcatgctgtatcctttattattagcttggagttcatctgagttctgtactgccttttagtttgtgtgtgtgtgtgtgtgtgtgtgtgtgtgtgtgtgtgtgtgtgcctgcctacctggcgataatagggaggaaattggtcattttgcataaacttatactaagatgttaattaagcgtaatatatagctttaacacaggtctaaaaatgtctttttataaaagttcttcaccagctgaagaagtagagttttatttcttattctgggtatacatccaaaataattgaaattaggatcttgaagagctcactgcattcccttatttgttacagcattattcacaatagcaagatgtgggaacaactcaagtgttaatcaacagatgagtggataaagaaaatgtgctatacatgtacagtgtgatattattcagctttacaaaggaaggaaatcctgccatttatggacaatgtggatgaacctggaggacattatgctaagcaaaataagccagtaccaaaggtcaagtactgcatgattccacttgtatgagagatctttatagtcaacatcatagaagtagtgagtgcaatagggcttgccaggggctgcaatgttattcatcaggtatgctagatgaatatgttctagagatctgctgtacaacgttgtacctatagtaaacaatacagtatggtgtatttcaacatttgttaagagagtaggtctcaatttaagtgttcttacgacaaaaataaacaaaaaacacaaaaacgagacacaaagaaactatgggggctgggtgcagtggctcacacctgtaagcccagcactttgggaggatgaagcggatagattaccttaggtcaggagttcgggaccaacctggccaaatctgtctctattaaaaatacaaaaaaattagccgggcacggtggcatgcacctgtagtcccaggtactcaggaggctgaggcaggagaatagcttcaactaggagttggaggctgcagtgagctgagatcacgccactgcactccagcctgggtgacagtgagactctgtctcaaaacaaacaaacaaacaaacaaaaacaaaaaagaaactatggaaattgctggatctgtctactacgttaatagtggtaattgtaacaagaatgtttgcatatgtttaaacttatcaaattgtatactttaaatatgtgtacttcttcataatatcagttatgcttcaataaagctgttaagaagttttaatttatttaaatttgtgttaacctgtcactttgtgagggtcatctactttttatacaaagtcactgcaacctacatacttaattcttttgtactgttttgaaataagcatacacttgcagacacatgtttctacaacattctttgctttcccaataggcaagttcaaactcagaaggcgaaagtccagcggaaagtaccggaactgagggaaaactatttgcctaaccacccacaccactgaatgctttcttggaatctgctgtgtgtttaagatgatatcctacccacacacatgtaacctttacctttttgcaaaccaaatctgattctacaaggaaagcacaaaaataaaaatatttttctctcaaattatatcagatttgtttctgctcaaattatctcagactagttttaaaaattgtaaactctcccatatcaagcatctaactatccactgaatttggctatgcaacttcagtttttagagaaggtggtaaagtctctatttttaagggggaaaaattaagggttactaagaaatatagaaataaaactggattttttttttttgctttgttttacagtgtttctggaactttctttcttttcattcctcagtagctttccggactctatcctgaactgaatcttcttttgtgaaagttacctttgacctgtgacttgactaagcatgggctttttacagtacgtggtgcttgatcagtctatgaattcaacccaattaacattttctctgtagaaattgctgccattggctcccatgacatcatgcttgtgtccctcttttagtctttctgacaacttttacccagtcttattactccctctttttacttcacgtattgtttaattattgcttcttccatggggttccattccaaactctcttctttttcgtttctacatactttccctggaaaaattcactaagccatgaataaaagtatcaaatggacattcatgaatccaggctttcagtctccagccccatctacctgcctgccctgacaatacaaacacttgaatgattattacataaataaatatatttctaacttctgccactgttttccaaaaccacagaagccatctttattttggttggccattttatccttggcaataagcacagtccctggcacatggaaggctctcaaaaaatcatcttaggtgttgaaggagtgacctctttttggcatctcctgatgccctctaactttaatctgtcactatatctttttgcttctatcaactcacatatatttcaaatctgctttttcaccatcatccccaatgacattctttggaggagacagtatctcctgcctaccatcagccttgactccatccaccaaactatcagtgttcttactttttagacacaagtatggtagatgtactctcctgttcttgaatatttaatggattccaaattcttctagtaacaaatctaaatgccttagcccattcttcagggttctcaaaccctaacctgactctaacctctctttccaatcccatcttttcaatatattcatcctgtaattcagtaactgcagatgtctcaagtgccctgaacactccgtattctttttttcctatgttggtttcctctgctcttttgaacttctttgtcatctgtgtcttgaactctaacacctatgtgcatcttatacttttaacttataaaatcctattttttgacagattgttacccagtagtccttgggtgcaactgatgaatgatgaatagggtcataacatgaatgtaaactcactttctctgactttagactccgtcgtcttttgtgctaaggggaccgtggttccagttcccagcatatactcacactttgctcttagtcatttttcattgccatccctctctgctgactgcattcaggtcaccttttctgtatcactgtcttgactctgctcaaaccatgatcataaagagatttgtggtaaatatccttttatcacatgcattgatcttattagtgagtcagaaaccagggtgacctcattttcttgtttttctactgtacctttagttatagagtgcatttcttgattcatttttagtatatctctccactcttgaaaaaattgtcacaggtctttgagaggctgagttggaagacagcttacataggtagctatctttcacataaaaaatcaagtcttttcatttctcctagccaagctccttggtctgggtttgtcactctgagagtcctacttgaggattaaggctgtgggagccagctgtgagttccatctccaaacatcgttttcccatgggtctcactgaatcctcagcccaaaaagcatttctagtaggcttcttagataactaccttattaaaatgattcacaaacttaagccaagaagtataaagcctatatagaaaaggtatctcaaaattaatatactactaggaaggctgaagtgggaggaccacttgaggccaggagttcaaggctgcagtacgttatgatcatgcatgtgaatagccactgcactccaggctggacaacgtagcaagatcttgttgctaacataataataataataacaacttataagtgacccaagaatgattagctgctgtagttttaaaaatgaattatatgtattctctgacattgtttgataaaaaagtattaatggtcccacagcatcctacaatgatagatgattcgtgaggagtttatgtcagattaattaactagacaatttataaatgtggctactagcaaggcagattctggatatcttgaaggaccaggggaagaaaaagagattttcccatattcagtgaggtcatttctgcaattagtggtttggagtgggtccccttagcagagtttagctggatggaatttgaactcactctaatataatatgatggggtaaaatgttttgatcatctgccatttattgacatactaatctattatctatttaggctttcttcaattcatttctaagtagcaaaaaggaaaacatctgtaggttcatggtgattataatactgaaagaaaaccttttgctcagaagtagagctttcctttaggctgaaccccaagaaaaatgttttatttgcatctttattataaagaaaaaaaggcataatatattggataactatagtgtacatataaggtgcacagtctacaactttcctctaagaagtataaatgtagtaatagtcatatggctgtgtttatcgtgtttttaaggtaatcatgcaattcaattgagtaaaactctataaacagcagaaatacagtctatgtgtgtggttctgatgaattagcaagaagacttaagatttctcaaattcataaaagaggtaagattgtcaaagatgtttagggaatgtgtttacataaatgttacattgaaaacataggctctttgaggattaaatgcttctataagcgaatttagcaaaagaatacccttaattgcataaagattactggggacaataaaaatacatacacatgtcatgctattatgaaatcacaggtgatctgtggataatttacacttggttaaaccccaatagatttttttctctgtatcatgttgattcattatttatattagattggttatctatattaatgaagttaaacaaaggggccaaatttgtctttgcaagacatttttacattctaactaaccttcaagatccaactcaggtaccatcacttcctaaattttctttcccctctttgtttatatgtatagtctattttgcacagcatacctaactataattttatgctccaattgtttgaatcacgtgcacagttctagtgtagttgaaaattatcctaatataatacagttcaataatatgagacttttaacatatgccttacataaagatggagtttaaagccaagactcatgtactctatctggaaatctaggcagcacaaattcactcaagactgaatgagcgttacagaatcaggtcaaggtggtagagttttggagacattgaatgttgttgtttcagcactgctcaaaaaagcactgcatgaaaatatatctgtaactccgtacaaaatcatgtccattgaaacttttcactgttgcagggatataggttttatctaacattattctattattgctttttactacagtgcataaacagagtataactctgcttgaattttgaattttctactagtatatatttcatatgatttattagttattcaaaatattctgctatattttaattgtgaatcttgatacttctcaatttccatagtccagattcaatacacacaatattccaatgggtcatcactgcttccattaagattctccatctctgtcctggaatttaccctatcattgaaatcatggttatgtgtaatgaacaagctaactgctctagcgtggaaacacaaaaccttatttgtgataatgagatttgacttgtcttcttcctctcacttttaataatatcataatgttgatgcatctgaatgtaattggcataaacagtcttaagaaatgctttactgcaccagaaaacatagattagaatttaaattattattgtttttccagacattgacttttggggccaggccaaatggatttctggttcttggattgtgctaatcaatataactgtagctgtatgttttcaagattaattttatgaccatattttcttatctcaatagcaagaacatttttcattctcttgtctattggaatgagcaaattatttttgtagaacattagagggtaaaaactataagaaggcaagtgaaaaaattccctttcccctactttatcttttgcccttcctttattccttttcttgtagaagaagcaggggaaagaggaaaatcccattttccctgcttctcctatgtgtagatagtaggaaattaagtaaaaaataaatgttttacttgagctcttattgattatttatattagatgaaaagataagaaatggataatgggggagattaatctctaaaaaatattaattcacaataagtttggctaaaacatcttaacacataaccaacaactgacctgtatttgaccaaagctatatccttgtcataaatactcagacacccatggacagtatttttatgtggaagtatgctaataattacttaaggtagagcctcatttgggaggacaggtacctaaagccttcagtgtcttgggaaacctctgagatcagtgggcggcagcccgcggcttgtctctgtttggtctagtgcttaagtgaacttgctaactaaagccttccttcctcctgtgtaagtgaatgaaaaacctctctcagttgctatcctggctaagtgggtgaatctgatgtttttgggttgcatccactgggtctgaagttaaatgttgtggtttactacttattatctgaagatcagagatcttcaacttcaaactactatgcattttgagttatttgtaaatttctagagatttttgagggtgcccagctggagtgacatttattcctggattttatcatctcaaatacagcacagagccttatctataaattattcccatattctccctttgtggatatgtgtaatgtcatttatagaaataaatacttcattatacctttggtcttagtgtaggttctgttttataccttaagaactttgaagaactatgtatatgtatgaatccgtgtgtgtgtttgatatcaatatgagtatgcttatggtaatgaaggaaagaaagaaaagaataaaagttaggtgggcatacagagtagtaagcatcttgaaaataaatcaaagtaataaacacatggcttagaatgcataataattatactgattttcagtttgtcaaataatctgtgctatcatattcctaaagcaggcatgttaataatagcatcatgctgatttaaaagtgtatacaataatcctccaccagacacattccttaaattaaacatctattatactaaatttttggtatagcacagtgtgtaattatttgtaacttactcacatgtatagtatagtattggaattagtgtgctgtagatagactagatcttagaaaccatctaaacctgggattttaaataggtatcttttcttgtgttaatgccgtcgaagtggtagtggttgtgtggaatattgtttgagaattctgggactgcatgtagattaggaaaaaggaattctataattgattacttgtgtaggcatcgacccagcatagagaatgttggcaagtatattaggtgttttggcatctctaatctatttcaatatcctgaattcacagaaaaaaagagaggcatttatgtaacacttcagagattgtgcaactcattcacatatgctggcacagtttcttttcaacagttttgtaaagtatgcaatatttcgaagccctagaaaaaaaacagctgcttttgtccctggctggcagtgatcatttgtggatcttggatctgaattccagaagctccacaatattattctcacaacagcacatgccaaaagatgtccccactggtagccactcattcatattgcttctgtctacattcaaatgtcaggtaagattcatctgaccaatgaaacctggacatttgtcctcccacaactgcaaaggagtctaggaaatgtacatgtcttagaacatgttctccagaaagcagagcctgaggcaaggattaacatgttgacactttctttgagaagtacaaatccagcagtgagggtgaagaacatgagtagagaaaggtgctatgatgcatttctgtgttggttcctgtgttcaggatgtgtatccactggtctgtcgtacttctccagagcagttaaaaagaggagctgattcagggtaatctttagaagggagaaaggaggagaaatttatctatggagctttctcccatatacatttcctgttttactagactggcctcaccacgggctagttccctcagactttcaacttgggtaattcaggtcactgttgaatcccactcctggtactgtggcgtttcctctaggtctggaaatgtaggggaaaatcagggtggattgcttcaacagctgagggatgtggaccatgtgcccagaacttcatctcagcctcctcccaggctgcaagctcagcagagtgaggcaaagttcagatatgggtggcacctttagaaggaagaaggcagtcaagggaatctaaggatacataccacgtttttaccctatatagtcaggtttttggtttctaccttaagaaggctgttttcacaacatagaaagctcccacgacatagggagggtactcaaaagatgttgggcacccccaatggcagatgttcattaccacctcccgcacctgatcacccaactaaagcatgtctcccttgtcactccctccacagctcgctagggtttttcttccttagagcgtaccaaaatctaagcttcactaaggcagtattacttctgttttcatcatcattgtatactcaggagtgaatacagtgcctggtacaatataagtttggataaatatttgttggttagatgaatgaatgaatgaataccagacagcaaattatgagctaaacaatggtataggtggttattacagggatgaagataaagaaaataatcttcacccaacttggaaaagtttcacagaagaggtgggacctgggttaggccttggcatatagttttaaccagaaaagtaaagagagtagagatactcaaggcagaaaagccatgaaagtaaagatacatatgtgaaaatggtcttcattggttcataagatgatgaagaaaccaatgctctatcaaatttctggcaaacgtattaatacatatatttatctatggatttctgctgatctctaattattttcctaactgagaggtctacaaagcattgtattggaagcaggccttaatctatcatgtccaaacctctcctgagagacattttccttcagtgacctgggaagctgaactttcttaattggattagtggcattttgctgtttcaaactgaaacaggatctactgccctatactagctagcgctttataatctacatcatctattttgcggtcattgttgaagcatcagagctaacccagggagacaggaagtggcattagatttttttctgttttagccctgcttagagatgtagtccaagatgataaaaacaatgtgacctttctagatcagaatacgtttttgctgtagagctgaggttcacaaagaaaagcctaaaggaacttttcagtgattcagggtggatatctcctgggcacttaatattgcaaagggccttcgattcaacccacttgccctcggctattttcttaatgagaaagtggatcctacaaactttaatcccatttaccgaaatatcaaagcaatctgtactttatatcaaataattatatctgaggtaagcttaggaaatttagccatttgttgagggttgtttttcccataacaaagtctctaaatagaattatcaagactatcaaatgttaatttgtcaagagaaacagaatagctaataaggataattagatttatattgcaaatagagtattatcatgaaggtttccatgtctcctaaaggaagtatgactgaaatatgactgcagggaagtcttaatcaaccaaactctagagtcattttctcttcaatgtacgacagaatcttgctctgaggcagcgttagagagaatgccaccctggcattttagaactcaggtcttcaactgtgacttatctcctgaagaaaagcaccctcattcattaaatagacagggaaaggtggctgcctggcttccctggcttttctgattaagaagagagatgagcatacagcttctatccctgcacaagggcaaacaccagcctgctggcagaattttcaaagattccaagatttctcatggatgaggcttccaatgacttttccctccaagagtagacattgatcaccttgtagcagaagttctgaatacctaatgctttttctgcacttctaggaatctgagagcatttgctctacaccttgtattctatctaattctgccgtctcttgttctcctccactccgaatgtttcttcttataacattagcctggtgaattataattttttgagacgttggtcgaggtacaattttaaattgcttttgtgaaaaccaatacctgttatttgcattgcaggtaagttatttcaattttagggcagggattacaaatttttttcgtcaataaaatcccaaagaggacagaaagagaaggaggggtttgctaaaagaatgagattagaaagacagctgctgacagtaagttttttttctcaggaaaaatcagaaaacttcccttgttctccttccttggcccctaattaacgtgactacccatgggaagagcagctgtgtcagccacttccctttcctgtctttttcaatgaaaatgaccagaaactgaaagaagttcacagtgtggcaactgcacaatctcagttaaatagccttgaagaccacaggttaatcggttggatccttggttattgaaaaactggttgaagagggacagcttccccttgccatgtactggctaacaccactagttttctcactgttcttctccacatgactgttggactccattccatgcttcttgcttcctcctctatattctccatttagttactttgaaaaaaagctttatgtacatataaaactttatatatataatataatatatatatatatacacacactcagttttgaaactgtgaaacaaaacacccataatcctattgcccagagataagcatctttaacattttctttggcatttgctatgcacatatatgtagttagttttgtaaaattggaatcattctgtatattttataatagtttaactatttctcacatgaatatacacttctgtagtaagatcttatatgactatatgttcttctattgtacgaaaatcctattattcggtctaattctgagtatttatgttgttttgaaatcttttgtcataaataagactgaaatgaacattttagcatttaatattttatagatatctctgagaatttccttagggtaaatttctcaagagggaattttcaaatcagattatagatattcaaagagtctccagaaagctattatttatttatttcccatttaatgccaaataagtgttgatttttcaacatagcattacactatacaatattaaagatgaaaggtcttatgtttgattcaacttcttaaaaatggaaacttttataaggaaaaatttaatttctttaatttatatgaacattcttgacttcttcggttttaaaattaatttggacaatactgccatactttagtctctttatgaagtagtgacaaattaaaattaaatacctttccttttattttaggatctcagataatcctccgcagaagagcccatatgtaggatctatgtgtctggacacaaattcaaaagtcccatccctccttgaccaaccagcaaatgcattaagaaaacaatatgtgcccccccatagcagatagcaacagaacacaggctatgagcagtcatgctgtgctagaaatttagtttcttcaccactcaaaaagaaagaagggagagcattatactaaacctctgtggaatcttaagtgcccccaaaccaacagacatattgcattttacatgaatggattcactaccactatcatgaccaaagagcagttacaaggcatcctcttgtggtactagtacaaaacaaatagagaattatggcccctactctggagctgcttgctgaagtctcttctaagatctgccagtagcaagcagtgctcataacaaaaccatgacattgagcttgacgcaagtagagaaaaacaaaggaaaacatgctaccccagtaactaccatataaccacctaaaacagaataattacaaagtgaatagggaaacagaagaaaaaagaatatacatggtttcctgatgccacagtgtggcattgctacagaggactaagaaacaactaaggctgacaaaccagtctggcatggaactaagagggaaggtggttccttctcagttaagctttatgttagtgctgcattgaagaggtagcatcacatcagcaatagcttgtaacaaaaaataatcatgggatgtaatttaatgtatgcttaggatcaaaagaaccaacaatctttgcccattaacagtttaatcagatgtacacatggatcatatcacatgtacatacttagtttaagtcatttataccaagctaacagaaaaaggatagcaattccaaacattttgctagcacataactttgcaaaaaaattaaattggtgaagaaaagaaccatgcaattttacatttttggtgtgtgttttcaagctgcttccaaatttataaaatcacttccctttataacaaaggattttcagaatctaaatatcaaatgaaatactcctagcacttaaagagtttattagacacatacaattacgttcaatgaagttatgagggagcttcaaagtggaagattaagaattcacagtgataaaacttcaaacacatctcagaataaattcaagctttttagctaacatatgtgtctttatcaattttttaaacgcagaagggcccatgaaacacacagcagaattcaatgttctatgctaaatgcagagaattgtatagttcacagcatgacttacatatattatcacctttcctccacaatgcttaaagctattaacacaaagcagaacacatctccacattaacctatgttctgctgtatgtaacaaagactgccttcctgcaccaaggaaagaagtgactcttgaaataccgagtggaatttctttaaccaaaataagattgaagcactggcagacccacagcaggtgatcaggagccacatgcttaatggacaagaccaattctttgcattcagtctaataattatgtctcaaatttttagactgttgtgttcgttgccctcctagtccaacctcttcagcagcaactggtgctgcttcagctccagcactggtacctaggccactctctgacacaggctggtcaacaggtaccagctgatgaggaagtacagctccgactccaagacaggcactgggcatctggccaccagggcttggccgaggctgggcacagggcgagaggtgggaacaggtggtgggcaaagcattcaggccccatgaggctggaccaggccagggccaggcctccaccccaggtacatgccacagctaagctgtgcaactcagaagggtataatttaatgtatttttacctgcagtatgtgaacttacttataaacagtattgataatgttacttttttttttttttttttttttttgagacggagttttgctcttgttgcctaggctggagtgcaatggtgtgatctcggctgactgtaacctccacctcccgggttcaagcaattctcctgcctcagcctccggagtagctgggattacaggcatgcaccaccacccccagctaatttttgtatttttagtagagatggggtttctccatgttggtcaggcttgtctcaaactcccgacctcaggtgatccacctacctcggcctcccaaagtgcctgggattacaggcatgagccaccgtgcccggcctgcctctttttattttacccattttataaggaaaatgatgtggagttaatttttattttttgactaaacttgaattaactttattcattgacattttatatatatacataatatgcactagccattaacataaaatatcaagtttttttgtgtatgtgtgtttatgtaaattttatcttattccctttcaattttaacacataatgctaaatttaacatagtcaaatttgtcaataatttctcatatgattttggccatttaaaaaagtgtttggaaagaccttccccaccacaagatcagattaatactgagctgcattttcttctggttttctatgattttgttttttaacagtgtactatttaaccaactttgaaagttttttggcaaataagataatgtagagacagtatttaatcctcaaagagataagaattactcttatacgctatttgatttttccctgtcttgtggtgggatactctcttgatgtggtaattcattagctgaaatttaatttcttatttttgctgagaataatcagctgaagggccttaggattctggtggcaatgggaaagtttgaaagacagtggccaggtagttacctctggccccaccagaattgttgtagacttgtacaaggagctatgaactcacattctaacaggtaaaggacagatgatggaactaccaatatccagctcttttggggcccaagagaaagtagctttcataactgttgctattatttcaaccactactcatactctaatactactacatccaccactcaaaatttattgagatcttataatgtttaagattatactaaggactttatatacaacacatatgtgaagattacaaatatttatttttcacacacacaacgatcccctccattattccaactttataaagagcacatttgagttgggtcttagagaagttaagtaaattgtacaaagtttaaaatctgaatttgtaatccttattctatgttgcatgttaataataaaaagtaaatttgaaataatatgtttatgtggaagacatagcaaatagctaatgatcagcaaggtgactacaacttttaacaccctacacagctccgaagcactgtgtcccaatgttccttgtaggaatctgtctgcttttcaattctgcttttgtcaagttctaattggatctgttatctagtggacctacatactttttagggaataaattattattttgagtttttctttaagattttgtaccagatttgttatgttactattattaggctattgtgaatggcaaactgtaaacaatggtttttctgtggttttcctgttgtctaaaatgtgagtattagccataagtggagcctgcaactagtccatttgctttttcaacctatgttgggagttcctcctaccaaatattattagagaaataaggagggtaactgaaaggaagatgatgactgaaagtttaatccactgtgagaattggggcaagacacataagtagctgtgagaatcaaggcaagacatgtaaatggtggggttctcaatttctttgtaaaacagagaaaataatccctgcctcgttaaattgttttgaagaaaagataatattttaaaaatataaaatatggaaaaatccttttgaaattttgaaacagtatagaaaacatgaggaactaacttaagcttaccaagagaagagtgtggctttctgctcttagtgtagtaggttgattctggtttactcctagtggagaagacattaattcagacttctggatatggctctatgtttacacacttacacttttattataccctatgaaacagaaaacatgagaatatattgctaaacattagtttattttgtcttctagaggtagtttcagcttctgaaaaatagcagaaacaattatatttaaatctgagccccaatatataaaatgcagagttgcatgaagtgaattccaaatccttcttaacttggtaaagtttccccccggattagcagaaagtatacccatagcataaacattgttcttattctaaaatttatattaaaatatatcattcaaagatgtattagtataatcttagaaaaggaaaatttaataattcagttaatggccaaaattttagagaaaagagactgagaaaatacacaatggaggaaacgttgcctagtaactttaagtctttataacccaaatttattaaaataatgctttccaagaaataattgtttcgatatgtatttttgataataaaatagtcctagacaaatggaatattgtgactatgtaacattaacctcattccagtcccacgatgtggtggtaaacaatgtgccactgctactaacatttattttctacttttaatattagcaatagagttgtagttaaactatctctggaagattattgattttcataggtagttcaggtcttcatactccaggttcaagatctgatatcacccaaagtatggatccattactttgaaattaaccatgccactaactactattgcatgtcgttaaattgtgaaaattttgtctatgttgcatgttctttcaatgttttagtatgtcacactttttcaaaataagcttcttggcagtagtaggccacagagctgagtaataaaatatgaaatttaaatctgaatttattttacttactatcattctgcatcgattttgtgtgtctttttctctgtctatgatctcaaattggctattcttttctgtaagctattatctgcgtccacaatatattgctgactattgcatttgcatggattgtgtcacattcatcattcattggtaaaaatcagaactgaaactcaataactacagttttatttcttcattactttatgttattttggtataaagacaggatttctatcattatctagtgacaatcatgaattaccctttctacaaggaggggctcagaataaattcaagatggaaacatcaacacaatcagttgaaatattgaagccgtttaagaaccagataataaatatttattgatctgctaacatttctaggatataatacttgtagttcttaggaagcaatatagtacagtaaaagaaaatgtaggattttgcatacaacaaatttgaatttaaatgtaggcttgcggtgtaactagtttggggacaatgggtaggtcgcagcttttttgattataaaaggcagcttttttgattataacaatacttaccatacatacctgttgtgaggggtctagatataaacttctgaacatagtgactggtacataatgggctctgaatacacttaaactactcttcttgaaaccagacgggtctcactaaaaccatggttttgcctcttagtagcttcgtgacttgaatcaagttccttaatctctccaatcctttgcctgacatgagggaaaaaaaatgatagtcctcacttgaatccctttccctacaactacattgccaacccccaaatcaattctctacagtgtattattttttcttctaaaaactaaacatattagcatggttttctggaagaaccttcccaaattgaattattgccaagacccagctgggctaagcagtacagagatgagttgattgaattgttcatgcataaaggtaatcagccattcaaaccccggaatgtaattcccagaaaagagtgaggcacgctttccacctgacagtattcacttttctaacatgtgctatttcatgtttctcaccacatgtggcaaaagtggtagtggaaacatggaaagagagcaacacagtttctggtaagaagacgaagctcaacttgtcgttttcccctagattttctaattgcaatgcatggtagtcattttatttcagagcagttcatttgcaattttctttattctctcttctagtaatctcaagcctggttagtatatccttcaaatctttatctagatttatggtttgtgtcagtcacatgccttataactatttaaagagagatttaagattcatttatttggatacaagaaaggatgcactgatgaatgatatttagaaagggaaatagacactgctctccaaacagaatgtgacatgaagacacattttcagtgatttaccacagcatgaaaaagcattagattccattcctattctactgaacatttatcttctattccttgagcttatacttttctcaactgaaactttggaggaaagagaaaggcagttaatgttttctgagagcctataatatgcagcagtcggggacactttgtctaggctctctaatttagaaccaccacccactttgtaacatagatgacatttaccctgcttgtcagatgaggcaggacggttaagagaagttaccagtgtgcctgtggtcagtcactattaagccacagacctgagctttgtgccctccctactgttcttgtactatatgctgctttctaacgtgctatgcttagatatttagtttttggtaaagttcaagtcctggttttaggtgggccaaaataagtgaaactatttctttaacctattttctttgatgctagcctaacctatatatcagtgagattgaagttgtgaaaccataaaacctcaactcaaagggcaatcaactcaaagggcattgttaggtagatcagattaaagattcatgggaaatatgccagaatttgaagacttttgcacatggaagtaaaatgttagaaatttccctttcccagagaatgccaaaatgggaaataatttttctcactgatacatcttggggtattttggaaaaacagagttgtgaattgcaatgctatatgaattaagaattactatttttaaggtaaaacagacagcaggcattttgaaaaaatgtgagcaaaagaaagcaatctctttaggaatgctgctgagcaagatcttgtactttttttcagcagtaaccgatgggaacagatttttctggatttctctggagtcataattaagagccttgcatcaaggaagtgatcattctgatgtggtcccatgagggaacataaacatcatagaacgtaccagtttaggagaagacagaattagaaagcaagaaccaagaaacatcagaaacaaccagagtgagagaattctctcagtcaaaccagtttctctacttctctgtgaagagtttaaaagttaatatcatgactccactaatcttaattttttgtatacatatttgtatctacataaaaaatacaagaaaaattatccagctctcaatctatattgcaactcctgctttttgttgcctttatatatgactctaaattaaagaactcctttcaaatacactcagatatttgggtcaggaggacctctattcatcattataggcaaaatttggttgtccctagcaaccaggtaaaaaatggtactcataatggagtattgctagagggaggcttggtcagcttggctagacattcctagatatcacactatggctagctaacaccagaaaatacttggatcattagtatttatgagcctgagccgctcaacttttaagaataaataaagcttcctgcgtctctgttggagagcattctctgaccatggaaatgtggtaggtccaagaagtgcagaccaggaatctgggaaaatcagaatcttaggagtgaccctcaccagtgagggatgagatctggtggataaacactccagctttcttgccattgctggtacagtactgaagaatgttctgtacagcttcttagagaatctcagtgagactgagcctacattcccatagtggtaatttgctgattaacaatataaatattagctatattcacttccttccttctttgttttacttccttattctttcactgttcttcctgggatcactgcctagataaaccatttgcatttggattattgtctcagagtctgctaacccaaactaagaaaaccacctgattttttctacctaatatacagaaatatacttaacttatccaagttaaaatagattttttaaaaaaatttttgggcacatagtaggtatatatatttatggggtacctgagatgttttgataacaggcatgcaatgtgaaataaagtagattttaagagattgtgtaaagagttcttgtcatgttttgtctctagtgagactagtattttggggagtgtaatggaattggggaaaatatcttggaaagatgtggcagttataggacttgatggctattgaccaggagaatctaattttcaacaacattccaaggtgggcacacctatggcacttactgtatgctggtgctgtactgtgttcttgctgtgtgtatggtagtgtgtgagtgtgtgtgtgtgtgtttgtctgtgtgatatgatgatgtgctatgtttggactatgtttctggtccagaaaatttgagaaaagtttagcacaatgaagccaggaaagttttatcacgcaggtgacatcaaaatgtgcctcttaatgtttatattacacacagtaagcatttagatcacactttaaagttcacgttgaaattgaggccagaatatttgagattaaaattcataagaccttcctcttctaagatgtatattcttatgtgttcatcttcaaaggagaccctataattttacttcaaacaaatacagtgatttaacttaaaaagctgggataacgagtggttaataggttttaggaattgtttaaatattttttattgtgaatccgtgtgctttagaaacgtttgctccaagaactctttccttaaagagaagaggaaagcatttggaaagcatttaggtggtctgaaggacttctggtaatagttactgatacaggttgaagccgtatttccaagcaaactattataacgatttggcaattgaccagaagataagaaacctctggttcattctaattcttctatttcctggaatttcaagactcattccttctaattccactccaggaagtagaatgatatttttaaaactatcaataatccaaattaccatgaagaatcccatttttaaaagcaattcctttctctaaactaaggaatctgtttcttcattttttttttcactaaaataaattttggtcattccttctgatttcactgttaaagaactagctatgaaatttgcacaatttcatacaaaataaatttaacagcagtaacataaaaaagttatttttcctacctacataaacaattgtagttatattcttacatgatgttgatcataagagataagaactaaaaaaaaccaaaactaactggaacaaaagatttgattagaaatgacagttgtttgagggtttatttttgtaggacaaaagctagcatttaattgtttattttacagttagggagtttacattatggaggtattcatatctccatttctttcgttgtgctgtgacacacttcctgaatatttcaaaccactttgttttgcaagactactttgcattctgaagaggtttcctgcttaatttagttccgtcaactgattgccatggaaactcttgatatcctttcctcttcctggaatgagacactggctctgtttcaaatagatcttttggcacagaaatagagtatgtttcatagagcaaaatgtgctgtcaataaaagagggtccttcagagggatctactgaatggacaggagccacaaatacacacatcactactgaacagaaaggtagttgaacaattaaaaccaggtagcagcatagttcaaatcaaaacaaagtgatgcctaaccgactttttaattttattcacaagtaagttgaaatcaatgctttactgcatgccaactgagcaaaatcaaaacagaacaaccaatgatatattaccctaaaattttatgagactgaatcaatctgaatttctcaagggcatctcaaagcagattaaattggtgaatgtgaacagttgtgctggaaaaataatttctataattaactataacacaaagatctaccatttttcttgccatggattttattttaaaagtacatttctcaagcaatagtgactgtaataaatacattgggtcatcctattaagccctccactttgaaatgaggatcatattctgggtttattctacttatatttaacaatttttaaatatggaatttggaaagttagagccagttacaatcatgaaaaagagaagaatgattatgtttacagtgtatttactactttactttgtgtatggatcgctgagaaaaaaacttcaattgcatgactatatatgcatgtgtgtttacaactgttgtggatgaccgtgtgtgtgtttatgtattgcatacagacaggtagttgtcaaaagtacagattaatagaaaaagaagtaggtgtatattgggagaaagaggaaattcctttctgatgactctctgtaaattcaaatatatgatagcatctttaaagttagagtatcatgtgttaatctgttatttttcataatattcaggttttgcatatcctttggaaaaaatgagtggaagacagctatctccacccaaacttgtagagagctgttttcctaagacattaaaagtgagaagaggcaaaattttgcttccttgtaaaccttgaatttagcagcagacacataatggtttcttttgatggcttgaagtttgtctatataaaaatcattggttatgattttgttttttctgattgaggtggtaggcacacattatttacttttcccacagtcaatttacatcaagaaaatatgttgccctacaaagtttatttacaatgaaaattcacgtgcatggagagtacttcctaaaaggaatgcatatttagcaaatctggaaaaaataataaaataattgtataaattctaaatattataggtaagagattttaaaactcagtttattattttttgggtccactttgattatctaaattagaaaagtatatggtaccttcaaattagctacagccttagctgatttgtcaaaatgtattatagcaactctgttttaatatctcaccatgacaaagcagtaaagctctggttatcacagtatattgctcactttcagtgtgatttactcttagcagtctgtgcataaatgaagcatagtttcacaatgtctgctttttgttgttgttgttgttaaaacaaatgccttagtgtctgttacactcatatctcttcctggactagtttctccaaatacattttttttttaatcctgcacggacaattggagtgcatactgaagactgcatgatggaaatctctgacctaattctgcagtcatgagaggtttggagagcagtgattaagatctaaacatggacatacatgtttcagtgaagtatcttaactttatcagccccttaaccaaagtcgagttatttttatttgctttcttttttggatctttgcagatgctaacatctttctttctctttctctttctttctttctttctttttctttctttctttctttccttccttccttccttccttccttccttccttccttccttccttccttccttccttccttccttctttccttctttcttgatttctgaatgtgacagagagttctgaggaggtggggagctttcctatgacccattttcattctttgaacctaatttagcaacttgtgtatacattattgtctgtgtttgtaaaatgcacaaacaatactgcgacttaaacaccagattcatactaaggaattgatccttacactagtcagaaagcacttgcctaaaatgaatatactctgacatggaaactaaagctctgtttctggagagggcagaatagaaccagtgagtggaaattatatagacacagattttagctccatctgaggcacagcgcatcgataagtagccatagcattcttatttcatgatggagcagagcttgctgtctcttggatgggttttcgagttgttggtgatgagttaattatgtggtgagagaccttgttttctgccctcttttctgtttgtcatctgtccttttttcctcccctcttttttccttttcttcccttctctctttccctctttccattcagtcttcacacatgtattaacgtcctattgtgtgtcagatactttgcttctaaacctaaaagtctgttattgagaagtaatagttaattatgtgaagaaaaacattcagtactccttctactgagaagggcttgtctctatttcctttccacttaacactgacaattttagagcacattaaaactgaggaaactagcaatgctgtttcagaaattaatttttaaaagaaaaccaaaagtcttttttccattgattatatatcttaatttgctgctggaagtaaccaggcacccacagaaacagcaaaaggtggacaatgaaaattagaaagcatttaaacctgggcacctatccccagtgagcctctccagttttatccctgcaaagagttaatgaaggtagaacagaagggcagagcaagcagctgttttagtttttagtggggacaatcagtaggataagaatggacacatgtcaagttaccccccctgctgtccttagataaaaaggcctctgagacacagactgtgatgccaaaccatgtccattctgcctgtcgtatggaatgccaatccctgagatggtaagttttacagcggagaaagagtttattcatgaggcagtcaagcaaggaggtgggagaacaggtctcaaatctgcttccctaaagatgggattttaaggatatttatgagacagaggagtgaggtagtctgaagtatgaggaaaagtcattggcagtaaagaagagtgaggttatcagtgaactatgcaagcatagccaagcttcatggctcttcataggatgcatgttcacatggtggtggtgttagcatgatctgtaggtagaacatcaaaagtgtacctatcgaacactcaagcagggtcagtggtcgcaaatggcttgaactggactagagctgactctaagttcctgaaaaacaacttcagtaaccatcaccatggtgacctatatgtcagagatgttatctgtgaggaagctagtgcaagttcagttatatattgcttagccacatgacctttagctacatagattttaaaatcaactaaaggcaagtagctaaaaacaagcaaggcaggttaagcttggcagacctaatcaggttagcccttggtttcaactgtaagttgtctcccaataatccaccttccctttctccattttaacagaaattttagtctatcttatgaccactcagaatcccagtcccactacgtagccccgtctcccttgcagcaatatgatgccatgtgtcttaagttacgaccaatatgatagaagacaactatcccatgacagcttttgggaaacttccttaagacagctaatgtacaccgtggcccttcctctctttggcttcttctccatcctgctacctggaatgcagatgctaccatcttgcactgtggggtccagctatgacagaatggtagctggaaagaactaggtccctgaagagatcatggaatggagctgccataatcatcccaaattgcctcctttatacttgtcctctctaagtaacgttattttgttattttaaaaacaattcatagtcaaacacaatcccaactaatatgggcaccttataggaaggctaaaggcagcctgtctccatttctaagattgacacttagcattcctagtagtggaggaacatagtttttcagaaaggtctataaattatgcttttactagggattttacctatgtttttcttcacttcatcctcataggtggtaccaggctcaaactatgaatgataatataatatgttatcagagagataacataggaacttcgtttaagtctgggaattaaacacagatctacctgactcaaaacttacatttttttttctatcattctatattgccttcttgatattctgctttaagattcctcctcagtcacatatttctatggctgatagactggttggtatccacttagccagtagctttgagagaaggctccagagtaggtgaaagaagttttcctttgtattagcaagtgaagaccgatttccaatataaagagaaaatgtcaagtgtgacttctatttgagaaagatttgaaaataaatgctagatctgattttatattatctatagattattggttttaactggcagcccaggctgattttagagttacgtatacatttatattgtctcataatattaaaaaaaaaaaaagtaattagttgttaaactttaaaagggaaaatctgggttgctttcccacatgacaatcagctgatgctgtgtatggctgtctttatcagtgggcttgctatagttagtcagcccactccactcattttcattactgaccctttcctgttagtcatttgagaagtttacagcctttgtgtggacccttttccttgaagatgattaaacacacaacagattgttaacagttgccagtatgtttggcaaattaatttatcaatcttaacttcagacttacagtccttatttgtaagtatataaacaccggtgtattcttcttatttttaagaataatttggtgacctctagagaggtctatgcggtctcttcagagcacctataaacttctttagagaaattcatagataaaacaaattatctctgcattttggaatatagacttggattatttcaaagtcctagacattttctacacggttctgtttgcccagtaggctttgagcccagttggaatatagtccagcaaaaggagaactcttgcggtggcgggatttttgccaaagcactctctctctcataacacgatgaggacgtgtttttttttttccactaaatatagttttcctatgtctatgtcctatgtcctatgttctatgtctaaaagggttataatattggcagtagtagagggaatttagctataattgtgtgtaagatgcaaggaaaaaataaaatgaattttgtttcttttatgttctaggagagtacatcattataaccttgaaagtccagagggaaaacttcaataaatattgatgatgatgaccatgaattaagcattctctggaatagtcaattaactataatgcaattagaacaaagctcgaaggcctactaaaggcatgcagccagccttttaaaaatgactgttgtgggaagaggttattgggtatgtgaggtacaaggatttgttagatctctgtgctccatgactgcagaaaacatcagttcatttgcctttacctatgaacagggaatgatatgaacttcggtgtctaccactgataatcaaaatgacagtcctatgccattcgctcttcttttacagttgacaaagtcatggtaatgaagcactttacaatgacacattttgcatattttgagctcaatgatatcttagtcaattaaataaaatagcatttttataccagttggcagcttagacattttctgttattctattaagacaaccactttcagcttaaactcctgaccgattttcacaggtctccatgctctgatttcatgcacaaagccagtcttattttgtgatagaaaccttctgcctccctgacccacaaacccatcatggcctttaccccacacattttgttcttctatgaatggaaattcttcctctgccctctatgacagaaatccaaagcctccttaacctgcttctcatattgacacccatggataatcccaactatacaaggaagaagggcagatattatgtagttgtcaagggcctaaactttgaagtcatacttcctaggttcaagtctcatttcaatcagttgccagcttggtttggcacttaataatcaatcttaacttattttcctggacaaaccaagaataaatatatcagcttcatgggtttcttgggaccggtaaatgtaatactgcatgtaaagtaccaaacattatattaaaccttcaatacgtgtttagaatactaaggaattgatccttacactagtcagaaagcacttgcctaaaatgaatatactctgacatggaaactaaagctctgtttctggagagggcagaatagaaccagtgagtggaaattatatagacacagattttagctccatctgaggaacagcgcatcgataagtagccatagcattcttatttcatgatggagcagagcttgctgtctcttggatgggtttttgaggtgttggtgatgagtactgttgtacctgctcattgcacgctttcatcattcatgaattctcaacctctgtctccctctctttttggtgtttgttattgttgttgttgcatcagttgttcaatgttaaagttctgggtggaaatatgcaaccgctctctgtcacactctcaaaccatggctgtcagaggatagggaaatctcctggccttccacccaggctcacaaataaaagaggaatttcttcccaaataggacaaggttcagatgttgagtagttaaaaagtattctaacaaacaatgatgtctttaactgttctttaactgtttttcaagttggagcgctaagtctttgaaggcagagcttatgcatatttcacaggtctcatcatatgataggttctcaatgaatacatttcgacatagagcttaaagtttgacagatttgtttgggggatttattgctttctatgctccacttagagtttaacaaagtaatgaattgtgagaattttattgtaatataagattgccaaaatggtgattacagtatggtaagagagccctagaatatcttttcaagctaaatagactgtctctattcaaattaatatcctgcagattggagagtcaaaatgagagggtcatgccttgtggagaatacaatcctacattgtgtaaagtatcttcagggaaaattataacggaaaatgagagtagggagggataaaacctattaatattatttaataaaatttttattgtgaaagcaatatttgactgttatagtaaatttttaagatacagaaaaacacaaacacaaaagaaaatttttttaaatgttaatcaccacaattttgggggatgcattcatatattggtttgtgtgtatgtatggtgtgtgtgtgtgtgtgtgtgtgtgtatatatatatacactgtacacatgtatgtatagtatatagtatatatgtacattatacatacacacacaaacatggcccaataccatacacacacacacacacacatatatggtgtatacttgtgttatatgtgtgcttaaaaccacaaatgtatagcaaacacacccatatatgcatagttgttattataaaactgttcttatatacagtgtttattaatgtgctatgaaattgttttcttaaaaatgattcttgttataagagaaataaatgtttattgcaaaaaacccagaaaataaaataagaaagtatgtaatacatgcaaattctcagcaacccagaagtaaccattgtttatatcttctggtataatctttcaaaatcctagtatataacaattacacagttttttgcaaaatagattatctattttataggatatcttataacctacttttaaagaataacaataggttataatcatctttccatgtcaataggtctatttctgcaccatcatgatttatggctatatagaattccacttggaggatatacacagctgattttctaaaatacaataatggatgtttaagtattttttgtttttgtttttacaagcaatacttcagtgaacatccttgaaacatatttattcttcaaacatatctataactttatttccttaggacaaattctcagaagtatagttattgatgccaaaggtatgcatatatttatatctttgtatagcaaattgcactctacgatacacatcagtttgaaaataaaaacaggatatgagtgtgcattctcctaaaactaaatattggtgttttaaatgaggttttaaaatagataaatcattttggcatataaagtattataaagttttcttttgtgattaagcattttaatgtaatttaaaagccttgagtatattatcttataaagcaacacaatgaaaatggcatattactaaatctctgcatatatttatgagtattttctcaggaatattaccaaatagtgatatttctgggaagaatgtatattactatcctatagcatgctgactttggttaatttgtcaggaaaggatagtaacaccacaaatgaagcattcaaattaatatatagttatgtgtgttttgtggattgaaaagttatgtttgatctggttttggttttagtcttaccaaattataaatgggattccattacaaataaaataaaatatgcatttactactattaccaataagtttctacatgatgtggttcctgtatgcctctctgatcccaactatgaaatcttccagtcttcttttttttttttattatactttaagttttagggtacatgtgcacaacatgcaggttagttacatatgtatacatgtgccatgttggtgtgctgcacccattaactcgtcatttagcattaggtatatctcctaatgccatccctccccctccccccaccccacaacaggcccgggtgcgtgatgttccccttcctgtgtccatgtgttctcattgttcaattcccacctatgagtgagaacatgcggtgtttggttttttgtccttgtgattgtttgctgagaatgatggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcatgtgtctctatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtaagatggtatctcattgtggttttgatttgcatttctctgatagccagtgatgatgagcattttttcatgagtcttttggctgcataaatgtcttcttttgagaagtgtctgtttatatcctttgcccactttttgatagggttgtttttttttcttgtaaatttgtttgagttcattgtagattctggatattatccctttgtcagatgagtagattgcaaaaattttctcccattctgtaggttgcctgttcactctgatggtagtttcttttgctgtgcagaagttctttagtttaattagatcccatttgtcaattttggcttttgttgccattgcttttggtgttttagacatgaagtccttgcccatggctatgtcctgaatggtattgcctaggttttcttctagggtttttatggtttcaggtctaatatttaagtcttcaatccatcttgaattaatttttgtataaggtgtaaggaagggatcccgtttcagctttctacatatggctagccagttttcccagcaccatttattaaatagggaatcatttccccatttcttgtttttgtcaggtttgtcaaagatcagatggttgtagatatgcagcattatttctgtgggctctgttctgttccgttggtctatatctctgttttggtaccagtaccatgctgttttggttactgcagccttgtagtgtagtttgaagtcaggtagtgtgatgcctccagctttgttcttttggcttaggattgacttggtgatgtgggctcttttttgattccatatgaactttaaagtagttttttccaattccgtgaagaaagtcattggtaacttgatggggatggcattgaatctataaattaccttgggcagtatggcctttttcatgatattgattctttctacccatgagcatggaatgttcttccatttgtttgtatcctcttttatttcattgagcagtggttcgtagttttccttgaagaggtccttcacatcccttgtaagttggattcctaggtatttcatcctctttaaagcaatagtgaatgggagttcactcatgatttcactctctgtttgtctgttattggtgtataagaatgcttgtgatttttgcacattgattttgtatcctgagactttgctgaatttgcctatcagcttaaggcgattttgggctgagacgatggggttttctagatatacaatcatgtcatctgcaaacagggacaatttgacttcctcttttcctaattgaataccccttatttccttctcctgccagattgccctggccagaacttccaacactatgctgaacaggagtggtgagagagggcatcgtgtcttgtgccagttttcaaagggaatgcttccagtttttgcccattcagtacgatattggctgtgagtttgtcatagatagctcttattattttgagatatgtcccatcaatacctaatttattgagagtttttagcatgaagcgttgttgaattttgtcaaaggctttttctgcatctattgagataatcatgtggtttttgtctttggttctgtttatatgccggattacgtttattgatttgcatatggtgaaccagccttgcatcccagggatgaagcccacttgatcatcgcggataagctttttgatatgctgctggattcggtttaccaagatggccgaataggaacatctccagtctagagctcccagcatgagtgacacagaagacgggtgatttctgcatttccaactgaggtaccgggctcatctcactggggagtgtcagaaagtgggtgcaggacagtgggtgcagggcacagagcatgagccaaagcagggcgaggcatcgcgtcacccaggaagcacaaggggtcagggaattccttttcctagtcaaagaaaggagtgacagatggcacctggaaaatcgggtcactcccaccctaatactgtgcttttccagtggtcttagcaaacggcacaccaggagattatatccggcacctggctcggagggtcctatgctcatggagccttgcttattgctagcagagcagtgtgagatcaaacttcaaggcggcagcaaggctgggggaggggcgcctgccattgccgaggcttgagtaggtaaacaaagcggccaggaagctcgaactgggtggagcccactgcagctcaaggaggcctgccttcctctgtagactccacctatgggggcagggaatagcctaacaaaagccagcagaatcctctgcagacttaaatgtccctgtctgacagctttgaagagagtattggttctcccagcatgcagctggagatctgataacggacagactgcttcctcaagtgggtccctgacccctgagtagcctaactgggaggcactccccagtaggggcagactgatacctcacatggccgggtactcctctgagacaaaaattccagaggaacgatcaggcagcaacatttgctgctcaccaatatccgctgttttgcagcctccactgctgatacccaggcaaacagggtctggagtggacctccagcaaactccaacagacctgcagctgagggtcctgattgttagaaggaaaactaacaaacagaaaggacatccacaccaaaaccccatctgtacgtcaccatcatcaaagaccaaaggtagataaaaccacaaagatggggaaaaaacagagcagaaaaactggaaagtctaaaaatcagagcgcctctcctcctccaaaggaatggaacaaagctggatggagaatgactttgacaagttgagagaagaaagtttcagacgatcaaactactctgagctaaaggaggaagttcgaacccatggcaaagaagttaaaaaccttgaaaaaaaattagacgaatggctaactagaacaaccaatgcagttttcttaactgtgctggttaactgcgttccagagtttccgtccttgtttctttctaacacaccaagcttattcactcctggaattttgtgcttcctctctgctgatctatttatgactggctctttatcattcgggacttcatttatcattacttcagagaagcattccaagacaaggctaattaaagtggacagtgattattactattgctcttcatcaacatttgtggttctccttctgccaagcatgcaggaggattacattttcctacctctttgaagttagtcatggccatgtgacttgctttggtctgtcatgttcatatctgacactgttcagtggaagccattaaaagctggtatataatttaccacatgtccttacctatgtcactgcaattgatgacattcaacagtgaagcctccctcatcctgcatacctgagagaggacgtggaactaagcaccacactgaactaagcaccacactgtgatggacaaatactgtatgggaaaaaataacttggtttttaaataccattcagactttggggttgcttattagtacagaatacctaacacatcctaatacacaggttccttcttcttttaatcaatctcaatactttcctattttattttatacagagctttcattattacataaaatcatcttatttattcagttatgagtccactcacctccaccagtagcatgtagaatcctgaagagcaggagctttgtctgtcttgttcattgttgtatcatcattgtatgcaatactgccttaaatatttgttgagtaaatgaaagaaatgagaggaaggtctcaacacacgcctctggaatctagactagacaatttctttccttttaaaacaattgttcccagattccaaaatagcctttggcagacaaaactgagaacatgctcagtcaggtttctgatggccaagagaggttaaatattttctcatcaagatgtaagagctcttagccacgttaatcatttggtcttttcttcccccaacactatgaacattttccctctgtgtggatggaaaacaaccatgatttcaattattttatattttataatattctgttatctccaaagctttttttttcaaatgaataataatttagcaaggccttaagtatatttagtgaatagacaagtatattttccctgaccttccaaaggcaagatatgacattatatttataatgtctaggctcttatgagacacccttccatgttggcacttgatcattctttcattataactattatgtcccagctaccctgtggtctgcagatgtgtatcaattacaaagatactttgagttaatgatttctaaaaagccttaaaacaagtggaatagatgtgtttattattgggtagttggtgaatagtgtttctgagctagaggtaatagacttgtaccccattgcctcatctgaaagaggctcagcacttgcgccagatgacaactattctttggtcttaacacatgttgagttagagtaactattagcagctgtatatgttggtatcttctcaatcagcatatgccttctcttgaccagaatagaatagcaaagatgacattgctacacatttgtatattccatttggctctaaagctacttattgcattttcacatgccaggcaaagggaaagaatggcaaaaactcttacgttgaactgcaatgtggccatttgtttgcttggcaactagtaacatatcagcatggatctatgtgattttagatcatccatacccttgggtttaccatcacacggctcaacttcatgagctcagttgttacagaaaaaaattacttctgattcttttgtgtttcgatgttgtataacattctggaactccttgcccttaaatgaactcttcgtggtcctctcaaacatgcttcatatttgtttcttttcccctattgcacttttaatttattttgacattttgtttttatatgttttactgtatatcaggagttttccatgtttccttgattactaaatggaaacagggtagtaattgaatttagagcatggaattattttctcccatcattaaattactctggcatccaaaatagttcaagtaatttcaagagcattacatatcagataaatctgaaaaaattcacagtgatgtttttccagttttgatatgtggagcaaagaagactttgtggtatataggactttggagtcagacaggctcatgtttgaaaactagcacatttactgactgtgggcttaagagagttatttaatactttggggcttaatttcctcatctgttaaattgggaaaaaatatttccaatctcatagggtcgaggtgaggattaaatcagataatgcattttaaatccagggcctggctcatagtgagtactaaacaaatggcaactattatcttgcagagagtaatggcacatacctaaaagattagtgttccagagattgtgatttcatcaatgctgtaactaaaactgtgtatatgacgtgtgctatcctagcaagattccaatgcatcggtaaatcaaattcattctaaagaaataaggaataatgccaatagatatttattattaaaatcataatagtagagaactttatttgatacctatagttaaggaaacatttgtacatacgtgtttttatgcaatccatgaaagtcatctctttattgggcagaaaaatcattccagacagagggaacagctaatgccaacgtttgaagggaaaccatgcctggcatgttcaaacaacagccaggaggcccatggggtcagagcaaagaagggaagagaagtagaagataatgctgagagaagaaacccagggctagattacgtaggtcatggttcggaccttgactttgtttttagtgaaatggtgggtctttgcagggagtgaggcatgacatgattccatttatgttttatggagtggcaaaagtcactctggctgctggttttagaacagattgtaagggagatgtaagggtagaagcaggaacaccagctaagaggcaaacataacccagtcttgaagtggtcaaactgtggctctgttttgaaggtagtagtgacaggatttcctggcagactggatgtgcagctatgagagaaagcaagagtcaggtcagccctaaggcttttggcctaaacaaatgcaggatggaatcgccattcttcaggtaaattggaacaagtgtcaagggatgcattaggagtttaactcaaagcacatcaaagaaagaataaattaatcaattatatattcatagaatgaaccagagcactgaaaataaatgaagaagcaatggatctcatggacgaatactaaaaacacagcatcgtgccaaagaagtcagatacagaagaatatatactaccagtttccaattttgtaaaatttaaaaataggaaaaaaattaccttgtttagagatgcatattcaaatagccaaagaataaagtaatgcaaagctatgattcccatcatatttaatagagcagttatctgtaaggtgagaatgaaggaatgaacatactgttgaatgctgaggcaggtaggatgatggttatgtgaatatttgtctgatgatttttcactttatgcattttaatatccctgtgttatatttagcaacaacaacaaaagctttagaaatgctatgcagctttcaagacctactcctccatgaaatttgttctgatcaccccgttctgtgagctttatttctattctaaagatagaatcattattaactgtataggtcaattgattaaacattaccttataacattgcttcagtggttatcttgaaatattaggaaactatttggtagtggttcaaataatgttttattatagatcatccttccatccagctcttgaaccccatggcaaaaaacccaattttttgttcacaatagtaacttgatgtctggtaactaacacataattatagattgcagatctagggaatacattattcaagtatttatttttgaaaagttctaatagtatcacaccatgaagggcaatattgtgccctggaaagaatattagaattaaagtaaagaagtctgagtactccttcttctcttggtagatgtttgcttaaccaagctatttaacttttccaagtattgagttctttgtgtgttaagtgtggtatttgggctaaattctccttttcggttgtaatattctatgaatctttgaaatactgtattataaaaggatgcaagaatcaaggttcagaatctgttaaacaaatcatgtcaaaaagtacagagattataagggccaattttggaaaacaacagacctggtattttttgaacaggtaaaaataatttttttaattgaaggaaagctcaatatatttcaagtaaaaagacacatagaaaatagaggaaaaaaaatggtgatataagccacacaacgataaaccactttttatttttttttccaagaagaaatgaggagatgagtcaccaactgactctgtgaccaaaaagtcatagaggaaattcagaaacagaagctggattaggggaactgaaacaatcatcaaagaaataaagtatgcatatttatttttcatgggatagaacattgtgtacttagttgccccaattttgctgttttgttttatgggtttatttggggaaaaatagcctattcaaatttaggtggaaattattagagattattgataaataatttgaatagtcattaaattgtaatctcttaagagatagagaatttaaagcttgtttattcctgatacccagttattaaatgtatttgaatctgtttctatacctgctcagtgatcagtcactaagcctattactgaacacctccaataacagaggtcttagtatcttctgttgctgcagtttaaaagacttactgtattttcacacagagggctactttatatggagagattattttacagctgtccttaaatggtatctttttttttttttttggttggtttaacttcacaatatgtatgcctgattttcctccattttatttactgttgtcaatgatacttttaaggattactacttactgagagtgagattacatgcttatatttcatgatttgggggaccaatactctaaatcccatatggtgggctcacagaaagaataactatctatctgattgccaccggagcattatattttatattagttgactgaatacagtttgaccagatcatggcaaacttgcttgtctgttggttccctacacatatggacccttttatattcaaggacaaaatgaagtcaccaaaagacaaaattaaagtattttagaatatggctgggcatggtggctcacacctgtaatcccagcactttgggaggccgaggcagctgatcacctgaggtcaggagttcgagaccagcctggccaacatggtgaaaccctatctctactaaaaatacgaaatttagatgcgttggcatgctcctgtaatcccagctacttgggaggctgaggcaggagaaccgcttaaactcaggaggtggaggttgcattgagctgagatcgtgccactgcactctagcctgggcaacagagcaagactccatctcaaaaaaaaaaaaaattcagaagacatagttaatttcagttacttcctctttctgttttttaccttcttcattatagagcgtttctccctaaatctgaaaatgaatactctgaaaaattacaactttagatgttttgctataggaacaagatcaatatttactcagataaaatttactactattctgtttgtaaataagaacttgaagaaatggatccaagttacgtggttacttatatagaatgatcaaaaacaaaagggaactggataattctattacatttatggaaacgtaggaccagaaggttaagtgtgaatgcactatgtgctctaggttatgttgaatctgacaccttaatcctggcaccagcagtgaagtccttgccttagggccttaagggtgtcccagcattcaatgcactcaatgcattttacttaagccatgcaataatgaggcatcctcatattttctttgagctttcaatcaaatgataagtagagttttagtgaagattctcataatgtgttcatttcttgctatgataacttttccttataagaaatacgatcttacattctctcccaactgaaacttttgactgtgtcatcttcaataaagcaattcattctatatcatatgtagaatgctcatgttttttctatcatttattatgttaagcatgaacttgaatgaaatgagcaatttttgtaggcacaaaagaggcgtgctgtttttggagagtttgacagcttcccacccagaggtaccttttaacgtgacggtgagctggagtgccctcctctagggagtaatattagcagcatgtccttaaaagcacgcctatcacctttttattgcctgaagaggtcttcaaaccttggccttctgcagatctgaccattcaccttcatctttttaatttcctcattatgtaggtcagtgaatagaagtactctgtttcaagcaggaaatctcaggacacgtagtgtagaaccaagaaatttgttactatctgatttattaagtctatcacataaatcacaatactgataacctaaaacataaatgttgttgtctgtgtgttgcaaaaattttggtcaacttaatatttaagaggcattttttctgctgcttgattattttgtttactaaatatgcgtcacctttatagcttttttattttgttttgttttatttatttatttttttagacggagtcttgctctcttgcctaggctggagtgcagtggcgcgatctcggctcactgcaacctccacctcccgggttcaagcaattctcctcccaagtagctgggactacaggcatgtgccaacatgctcagctaatttttgtatttttagtagagacggggtttcaccatgttggccaggctggtctcaaactcctgacctcaaacaatccacctgcctcagcctcccaaagtgctgggattacaggtgtgagccaccgtgcccagcctatagctaacataggtaaagcacccatctaatttccactttaacttataaaaaaatagaataaactagtaaactgtatagtatgtaaaaaggtgataggtgcaatgggaaaaggtaaacagacaagagagtcagagcactctagaaggtggggaggaatgttaaagtacttgtaaatagccatcaggaaaggcccaattgtagcttgacgattaaatgcatcaaatgtaactaatactgagttattcctagtagaatatcagggtgtgtgtttgttcctatgtaaaagctgttactcatagactctggtcaggtgcataaaaaggctgcacttgtctaggagagcactcaatatttccttaacaggtagatgtaaaatgacttggttattcatcaatttcatactagccagtacggaagttgaatcagaagtattacattttagtaaactgaactaacttcacttttatcactgtggcagctaactttcttcttttgcagatgacgatagtgagataaaatacctaaaatcgaagagcagatggaggttaagaaagtacatcatcattgcttaaaaagtgaaaatttcataattaagctgtattattgaaaattaatatttttaaaaaacataaagttcagccacttaaaaaccctaattcagtgttttacttgcatatttgagcaaataatcatgctgttttattttatagaagacatttcataaacctcatttttttcatttctgctatgcaacttcaaaaaagaagccagaagattacctagctgaatctaaaccaataaaatgtttcaacacatcacatctcacatccataaaaatacccatttttaattttttgtctcagtcacttgaaaagccaacagaaatggggctgtttatgttcaagataaagcaaactaatctttataacatgaacgtatcaaatacattttgaaatttaagtggacattcctggaacagattagttcacagatggatttatttaggtcaatgtccctcacactctttctgaaagcagagccaacatccagagagtaggacacaaatattaatgaaaactcactttacttgcccttagttgaatgatgttccctaaatcagctcacatttgaagtagtccagttaactcctcctgaatgtagctctgctttggtttatagtgaagggcggtattatttgaaattgttttaaaagcttttagcctttagccttactgcaactcacttcagtagtacacagaagtgaagatctgaggaggtagcagacacagttatttgctcactctctacccactcatccaggctttcttctttgctcatggagccccaaattcgttcaagtatttacctcttcaagagctgggccctttccttcattttaagaggaaattctgattagtctaatatttaaagaaattcatttctccttaacactaattcgtttaagtggtcaaattctggtcaagttattaggagcttctgcgagtgttgtctttcttttgaaagggactttctggctctctctttctggtcattgtcttctcaggatatgctgcctagaactgctgcagctatcacatgaccataaagttttactttaggatgaagccagcaccaagaatggcaaagcagagatgaaaaggacctactctgataatattctttagctactgccttaattaagcctacttctggacttactgttcattcattcatcaaatattcactgagggcttgctatgaaccaagaactgttctaagtgctgggggtatagctttaaaaaatagaaaaaaaatctctgtgcaatgaagctaatattcaagtagggggagctagacattaaatagaataaataagatatatatgtatatatatagttgttaaagtgattaatgcaataaaaaaataagatgtggaagtgtaagaggcattggagttgtacatagagtcatcagggaaggtcttaatttgaaggtaccattttatcaaagagagaaagatgtgagagaattaaattctctagtgagtatccgtcccctgttatttgctcagtgtacacttactgacattgatgtcatgggtaagttactcagttttcatagaaactaataactccctgcctctccatacatgtgtatttgtgtatttgcatttcttgacatttgctatcatgcctaattcaaatgacttgggcaagtggattatctgtgcctgtgtgctgggacaaactttttgctttcctccatttctgaatcaacttcttgctacttctggccattcagttctaataaggagaagagagaaggcatttgcaggaggacattggaatgagttttattttatctataccactttcctcatagtaacaatagctaacatttattaagcacttaccattctctggataatattccaagccctttgagtttattttctgtaattcacttagcagtcttatggaggtttatattagtattattaccattttttcatattggaaaaccaagggcaaaaaggttaactttgcaaaggtcacagagcaaaaggtgagcgttgactcacagcaaggggttggatttcagagccccagaaattagacataagataaatatttgtacttttcagatgttaataacttttatagagcttatgaaaaaaatgatcatattcactgaggtatggaaaaaccaatgcaactcatgaaaacccaatagtcctttagcacagtgaatacctaggccatttttaaagctagttgtgttaaaactggatacaaatatgcagtcataagtttagtaaacacatattataataaaattgcttactaatctttattcttccaaatttatatcccatgaaagttaaggagaactaacaatgttgattcagttggcagctaaattacataccctatgtattttcctgtaatctattaagagggatcattgcaaccacaaaactgtaaacatgtttacatttaatccccaatctatttctaaacttctgaaaaaaataagcatctgtagtaaaagtttccaagaaaaattcagtgattaggtcatatctgatcatgactctggagaagggaaggaaagaatggtttctggagaagaaactccagataggagagaggacaaggagaattgaacttctattctggttggagggacggctaggagtagaagcaaaaaaatgtgtgaatgagctctaggatatgataaaatattttccaaagtgtatgcaagatattaatccccagggtattaacaggcttttggttaataaccaaataaaaatttagttaaaaaataattttgtgcagacccaaagtatcagatctttaatgcactaatttgtattatgaaatttcacttgaggggacattttacactatgttttctaaagttatttatccaaggagaaattgcccctcccctgcttccttctatagggaatcttacaggactaggattccatagtagacacgttaagaaacactgaagagtgacagaaatatctgagcatagctgaacattttattgtgtgccttagagagttctccagaaactaagaaaagatggctgctgtggaaaaaggagaaataagctgaatcatccccatgcatgatcctagcactgggactagaatcttctttagaaggtcagcttcattagagaggctccttgctggcaaggtggtgttgccaagtagccaggctgttaggaatcacctaaagttcccaggcaatggttgagtccttataactagcaaccagatcattaaaacttctgtgtagaaagtaagtagagaatatttcaaatatataagtgagggcttaatattttcctattaaatacttcattttatgttgtcatgacctgtttgtccatgagttttctcacgccccatgtgctctaagcaatgctttgccagttaacattttagctataaaatgagcctccatggcataccagtagagttctgcacagatttcagatcttgtgttaatgctagccaccagccaggcaatgtagaattgagtacatgtggctgtacatttgtaccaatattcttttagtccagattttctcctttttatgtatcgcaatcctctttataaataacacttccatatttgaaaaaattggtcaatattttgcatccttttctcagtgatactgagagataggactagctggattttctaggctaagaattcctaagcctagctggggaaggtgactgcacccacctttaaacacggggcttgtaactcagctcacacccgaccaatcaggtagtaaagagggctcactaaaataccagttaggctaaatgcaggaggtaaagaaataatcaaatcatctgtcatctgaaagcacagggggagggacaatgattgggatataaaccccaggcatttgagccaggagtgggcaaccccctttgggtcccctcccactgtatgggagctctgttttcattctattagatcttgcaactgcacactcttctggtccgtgtttgttctgcctcaagctgagctttcgctcaccgtccaccactgctgttcgctgccatccacccctccagatcgggcagggtgtccgttgcgtttctgatccagccaggcagccgctgtggctcccgttaggactagaggctcaccattgttcctgcgcagctaagtccttgggttcgtcccaattgagctgaacactagttgctgggttccacggttctcttctgtgatccatggcttctaatagagctataacactcaccgcatggcccaaggttccattccttggaatccgtgaggccaagaaccccagatcagggaacaaaaggcttgctgccatcttggaagtggccgccactatcttgggagtggtccgccaccatcttgggagtgctaagaacgaaaactcacccgtaacaacatgctattatggaagtaagttttattagcacagtaagtcagtggatcaggggttttgcggataaaatgttcagtcattaagtagtaaacttggtctctgaagacggggatctgggggaagaaaagaagcaaacttggtattttaaaaatatacattccaattatttggaaagaaaatctgagatttggaattatggaaaattgattaaaaatctcacagttgaatgtaaagcatatactctaatacagatggatgtcgatacacttagtaatgtatgtatatatggattttatttctgtatttttatcaggcatgctaagtgcattcattgatgccaccttataaacataagaatagttggcttccatatttaagactattagtccagatgatggctgggtaagacccctcaggggaaaagacttcctgaggtacttgttcaggtattcttaaacagtggtcagactaaaggaattgtattcaaaattttgtatgtgtttctgcattttcggatgagaatatctagggctttggtgagaatctcagtgctggtctgatacccaagaggggtaaagaatcactgcttcagggctccacaagatatgctgagctgtggaatcctcagggtattgttactgagctgcaccttctggactgatcattgtaaaacagtttaaaggactattttattttattttattttatttatttatttgagatggagcctcgcgctgtcacccaggctggagtgcagtggggtgatcttggctcactgcaagctcgcctcccgggttcacgccattctcctgcctcagcctcccgagtagctgggactacaggtgcctgccaccacgcccagctaattttttgtatttttagtagagacaaggtttcaccatgttagccaggatggtctcgatctcccgacctcgtgatctgcccgccttggcctcccaaagtgctgggattacaggtgtgagccaccatgcctggccaaaaggacttatttttagtgttacttcaaccatcatttgatctcttaaattaaagcaatgcgattatttattataattgactcagtcaagtccacacatcacccattattcctgtgttatttcccagctgacttgactcgtgtgtgtgtgtgcacacgtgtgtgtgtttgcaacaataaacctctcaatagaccttttggtgatatctgacaaaccagagttataagtcccaaggctctcagtttggggaagaaatgcttctattcatgtatcccttagcatttacaaactagagtttgtattttcctaacagattaaatgaaagcttaagttcttagttctaagattctttgcggggaagggaatacggtaaaggttttagagtatttttaagactatcacaatcactatttctcaatttaaggatgattttgcttgcaaccctgaaaagtaccaaaaaaagtttagatctggaattttaacctacatgtacatatgcatgcacacacataatgacaaataagattgtttcctgcatttgcacttaagcatctacgattagacacatttattacagaaatagagtgtgattcatgattgaattatactaggtctctttgattgctaagatgaggaactgtaaaatctcttgtttggtcagcttcaagaagaaaatgattgtcttgagaagtcttcactaggcatattgtagtatagaagggatcaaagcaatgaaagcaatgaattcaattttctaaaaataaacactctcaaatattttcccaagcaattgtcatctcgtgtttgacttgggggatggcgtgttaattactaaactccaagtccctccacaatgttgggcatggcatcctcctggctgctgatctggctattttcattcagcatgtggctgacactttcagtgattctcatcataaatattttgctgccacatcgcaaaggaagagtagaaaacaaagcagcacgcagaggctgaaaggggtgggtttccttcatttgccttagtcaaaacatcacatgaccttcctatcccaccctcatgattcattctattagtcttcttaaagggtggcatgttgaggattagtgaggaccattttaatatagttaagtttgcttgcaattaactacaggttgaatatcccttatccaaagtgcttcagatttaagattattaaaaataaattttgggatatttacattgtacttaccagttgagcatttctcatccaaaaatctggaatctgaaatgttccagtggacatttcctttgaacatcatgttgaccctcaaaaagtttcagattttggagcatttcagatttcggatttttggattagggatactcaacttgtacaaagggaccgcacttaaaagcatattagaaaaataatacaactcaggacatatagattctcacagagtttcataaagcaaagttcggagccacataataatagtatgttgaatttataatttgcttttaaagcagcttaattacactgagcctgaattgcctagtgcataacctacattatatatagtaagcaccatctgctagcatgctagcagtcatcaaagagaatcatcaagacacacaccacattccagtagcacttaatctacttaggtacttgttcaggtattcttaaacggtggtccagaccaaaggaattttataacattccttgtataactccggaatttgcaatattactgttgagagactagaaaatattgaaagtttgtgtgtaaaagagagctcattataataaagatacgtattcacaaggtaaggcggaaagtgattctttccatggatcttttattacgtgacacaatgtaccacagcaactaaactgctcttcagcagctccaccctcagccagcctggacagaaggcagcatggagacacactggcacagagatcagtgctcaagcattgaacccagatctgtgcctgtgcaagacagggcaggcatatctactatggaggaatgtgatagtgggtcacagaaaatacagtttgagtcatgagaagtcacggggaggcttccttatttccatttaggttcagcctctaaacctctgccctgcacacacccacacaggtcccacagtctacaaagggatagtttgtattagacaaagagaagcaagcatgtcacagcgttcattcgttgattagaaatatttattttgtacctacttgttccaggtactcttctatgtcttaaagataggaatgacaaaaaagttcccatagaactttcacacttctcagaacttcacatgacttaacccatttaccgctcataaaaatctgcgtggaaagtgcagtcatccccattttatagatgagaaaacagaagccttgagaatgtagcataacttgtcagaaacagcttacagacccatttcttaaccattttgctgtttcttaaccattttgctgctttgtttgtggatccttggaatggaaaggtatgcttgggaagaatggggacagggaattgagaaggtggaaaaacagcattttctgcttaatgtaacaggcactgagctaggtgccacatgaggattatctaattttgttctgtaacattttacaaatgaggtcagttttctaaggattacaaccagttaagccgaaggatcaggaattgttagatttgaagggcttgtgatttttcctttatactatactgccacaaaagagaaaaacaaaaccagaaaataaacatttgaaagcctgtttttcaaatttgtttcagtacttcttcaacaatccatgtgtatgttgtgtgtgtgtgtgtttattgaattgttttctttattaaaaccataattaattagtatccttcagaactgctatcagatttagtagcttagtgaatgtgtgaatgaaatgaataggtatttctggctttaaaaagaattctcattttatgtccaacatgtgtgttggccagacttctcacatccttttttatttttgagaaaagaaaaaaaatgatgtggcaacatcatttgaaaattttcacatcctatttcacagaaattttcagtctttgagagtacaaaacatgaatttttaaaaaacaattaaaaatggactaatggtatgacataacaatatgtttttgtattttcagtttttccccatgcatcactggcacatagtgacagatgcagtcacataaatggtaataatttccttggccacatccctgcttgctgatagaagagctcagctctctggatagaatccctctggttttcctgggaactccctcccccagactgcccaacacacactgatgatcaagttggctttccagtcctggttcggcatctgctgggtgcctcaatgtctaccagacccctccaacctcatggcatctggggtactggaggccttcatgtgttaaaactccttaggtttctgcttcaaatgggaaaggcttctttcagggtgatcaaagaagtgctgctcctcttctaaagtcttgactaagatgttagtaaaggttctcttctgatttttttcttcattttccacgtgtcctatatgagagtccagcagggctgaagtaacaggtaaatccaaggaagagatgccatgtttactcagatctcctctcacctccagtaaccaaagctttccgttaagctcattattccagactatcttttccatcagaaaaagaattttctgggggccacccagtcccattgcaaatagacttctggagggtccacctttccaacttcataaacatgcccccaaaagtccagtgtactctcagactcaaattgagatacctcatagcatgacctaatacctaccggaaactaaacgttacaaacattattctatttcatctttacaacaactccatgaagaaaaaatatctctgtgagtcagttgggctaagagagactaagagacttgtctaaggaaatggagagcaagggacagaaatgaaacattcatggcttctgaatccacattcaagactttccccactgtatcacagtgtcttaagaaaatctgacaaacaaattttagcttttaaaaaaacattatccaaaaattctcattcttataagtcacacagtgatatttatggtaaactgcatattcaactaacccagaaattcgaaattcagacacagtagtattcagttgtgctactaaaaccaattgttttcattttcccttttggattgtcattagttgcatgtggtagataagacatcagatttagaaaaaaaagcattgatttgattgattccaactgtaaatcttaaacgcatttttcaatttatgggatcatagttgttctcctaggcccctgggttatagtacataggcctctggattacagtacaatttcctatgcaaaccaggttatttcctgacagattttaagactcaagattggaaaagatagaaatttaaaatatttccactttcttcccagtgaccaattaaaatataaatgtatatagtgggattattgaattatataagcatttatgtctcaatgaaataacaatctatagcacactaccactgaaaaaaaaagactgtacctgtctccagttacacattgtatatgatattaactgtgtctctgtgagtgctcacatacataagcactccacatggtttagcagtcagacaaatgttttgtgtgggtgatctgagactccataacataaaccacttactcaaaaaacctattggtatctctctaaatctgtgccagctggacaagctaatagttatattgagagtttctcttccctggtgcttatcgcctacacaataagctatttgactaccagaaactatttgagtagggagagattttagtagaaatgtttgctaaaatgctagaggtcaaagacataagcttgatttcaaaatgagaactagcatgttgtggattaaaagtctacaaaatattttaaaataaaaaatacacacagacatatataaatatattacctagatttgatagcaaaactataaatccatctcctcttgccattttctttccttaccatatgtgctttttagccacagatgcaggagtgttggagcttctggacctgtggatagtgtttccatactttcctgttcctcctagtttataggaatttcacacttgtcaacatatatccgctccataaaggatgtctgaagtacaatcatcttaagagaggtcttttctcagaaagatgttaaagctaggagatttttgcatattttttgtaataagttataatgataaaaataataaaatttataaagaactatacagttaaaaaattcacatacatttttatattaatatatgacatttaatatgtcacattaattcttgcaaactccatgttataggttttgttgtccctatttaatgaaagagaactatttcattcttttttcaaggtcacaaatggaaaaagtgactctaggtctcatcctcttcactagatggttgtgcaaagcatgcaaagtaaacaagtatatactagacacaaaatgctttgaaatgaacaaatatccagaattttgttattacatagtttatctttctttgctttataaaattcattcatcacagttcagggatggtttgataaatgttgaactccaaaaccccattttatggaaagaaaattgactctgagagagaaagtgattttctcattttctgcactcacaattaacaatgaaattcaaattggattcacataccaagtgaagtgtatttacctggacttcagactagatatacaacagaaagtgagaaaaaacgatgaattgtgcatgataggacaaaggcaggcagattgcatgtattttcatagttacatagagatgccagctagccatccaaattcaggactgtctgccatagtgtaacatttagttgggaatagctgctgagttgggaattgcagttccctttccatttagttgaggcatgagagtagatctctccaatggtgccataagcagcagcatggtcaatggtgtgttttctctaagttttcttctccttctctcaacatagtgtaaaatgaggccccaagtgaggggagagccctaaagtggaagtcatgtaggtctttgaatcaccctgtgaagaaaagcagcctactaggaacacccaggtcggactgtggtataaccgagaaataaacttttgttgcaggctgttgaaactttggagttagtatagcaactagtgttatttaactaatataaaattgaacatgtatttaagtaaagaattaatatcattaaatgatagataaaactataccctaaataagttttaaattatgaaagaaaataaattatttttaaaattgtaaatattgcataagctaatgcatatttcccttttttagagatgatggataaaagattactttttactagttgatataatttgtagatggaattctagttgtataggcattatctcattatttaaggaagtgatatataacaaggattcttttctggtagctaatctagtttatagatggaactctaattatatagatactattttattttgctctgaaatgcacaaacacaaccttctgccagtactatgttattaaccagagaagtgatctttaagcaaattggaatttggagaaatcttgtcacatttgaaataattaactaattgacaaataagaaaatgtatatatttatggtatacaatgtgatgtttcagtatatgtatacatagtagaataattaaatcaagctaatgaacaagttaacatatccatcacatcacatacatattttatttgtgctgagaacatttaaactctactctaaacaatttctaagtaactatgtattattattatagtcaccatgctgtacagtagatctccagagcttattctttctgtgtaattgaatacaaattgtaccctttaaccaacatctttcaattatccatcccacgttccaactcccaacccctaataaccatcattctactctctgcttctctgagttcaatatttttagattccacatatacgtgagatcatgtaatatttgtctttctgtgcctgacttatttcactaagcatgatgccctccaagttcatccacattgtcacaaagaacaagatttccttctttttttaaggctaaatagtattccatcatgcatgtatgtcacagtttatttagccattcatctgttgatggacactcaggttgtttccatatattggccattgtgaataatgttgcagtgaacatggaagtgaagatatctctttgacatattgattttacttactttggatatatatgcagaggtgggattgctagatcatacagtagctttattgttaattttctgaggaactgccatattgcctttcataatggctgtactgatttatattcctaccaacaatgcaaggattcccttttcatcacatacttaccaacatttatctttttatttgtaataaaagccaccctcacagctgtaaggtaatatcttattgtggttttaatttgcatttccctgatggttaatgatgttgaggaccctttcatatacccgttggtcttttggatgtcttcttttgagaaatgtttattcaagtttttgcccatttttgaattgtgctatttgttttcttgccatttcattgtttgagttccttttataatttggatattaacccatatcagatatacattttgcagatgttttcctcccctttttgtaggtctcttcactctgttgattgtttccttagctgtgcagaagctttttaatgtgatgcaattccatttgcctatttttgcttttgtttcttgtgcttttggagtttcttatcacaatttaaaaggtatctcatcatctctagttgtgtgtagattcatgttggatgcatttatgcgcacattcccaatgatggtgaccaagagccaagaacaagagatagagatctagttaagcattttctatctgtgagacttgaacaattaactttacctccctgagtctcagtttcctcatttgtaatatgagaacagtaatacctagactataagatttttgtgacagtaaaatgagatgatacaaataaaactatctttttatccgtaagtcaaaatttaaatgttattcgttattgttatttattggcatttggtattcatgacaaaaaatagaaactcataggaaaatttggcttaaattcagcagaaattcactttctgcagcaatgcctgaatatatatatattttaaaatatttctatgtttcgctgagcttttttctgtcttgcagtgggttaaaggaaaaggcaagttagtcatctgagatgagccatacaatgtactcttgtaggtcaagatggagacatgttaatggagaaaagatatcatttatttacaaacatttcagttaactgaagagactctacgcatagtcaactgaactcagagcttccagaggtcactgcgcgtaggaaaaaaactaagtaatcatcagaattaatcatactgacgcctgtttgtctgatattttttagaatattgtgggaagctaacagcaatgaaatttggcaagcaatttggaatttgtgtgtgtgtgtgtgtgtgtgtgtgttttataaaatgtgatctttagatggtacttcagctttggcccaaatcccatcctctagagtctgggcaaaccaagttttcaaatacaagagatgccaaacagcaatttgtgaaagggaagagggtggtgataaatttagtattcgtgcatgatgtgaaattttataaatttgttatcagttagagaataactatactagagagctcataaaaggtgatatttgataccagaatttaggtagaagagacgtattctctaaatttataacttgatttattaattgaacacttacttaagttttactcagaacgcttcaggcaagacacaatatctgggtgtccctaagaaatcagaagatagggctcaagattataagccatagacagcaccacagaatgtctattaaaaataaataaaatgtacagcttattaggaattgaaacaaatatgggtagccatggaaataaaaaatggtggtggtgatacaatgagttttcatttggacagatattgaagctataataatgattgaagtttgttgtatgtcaagtaagaaaatgaagaagtctcaaacgttccacacattatgacaattacttggcatttgtctctataggggctctagagttcaggattaaaatccagtgctccatggaaacaaccgtttagaagaaaaatttaggaaattaagtgacaggagtctcacagtgacatttgtacagtatattccacagcacttagatgaccctctgctttgaaaatgcagaaaacacaaagggtttgctgctcttattcctagccacagtggagtaatggaagacttggatagaaggcaatagataacagctgctcagctgtcttgagtaatttgaagtttaagtccttgcttgtttccctttgtctaaatgtttctcttattattagatcccatttttcaatcttttaatcatccttgtggctcttctctaaacttgcttcaaattctcgaactttctggtaaattgtgcagctcagaactgaacacattttttaagccttctataattaaaggttttttgttttgttttgttaacagttatataggtgctcaaatattttaagtataattttttaaagtttctcttgaaagcaggaagttatagcattttaacagtaacccaatgcaaatacatggaagtttagtcttatttacccttgggcacgataatgacatactattatttccccaattatattaagccagtggtagcttgatttggatagtgacatattcagacatactcaaagactgtttactagccttttgtagtataataaactggcctttctaaaaaggtttttatacagttaggttgattgaacaatgtttttagaagtaaaaacagacattagaatttactcgtggaaacaaatagcatagttgtcatctctaattcagtttgaatgactgacttctattgaaggtgttctcatgagcaatgatgcatcctactagtgtatataaatagacgattcagttctttggggcatatttttcagagctcaaaagtattcaatttctaaattacactatatgttcaccataaatgcacaaatttattccttgactttaaagcctgacattttaagctttgtatgaaatactgttgccttgagggaaaggaaggacagaaatgggtagaggtcaggataaattttatatgtagttttagaattatttgtcaatgctagcctctataccttctcactgtaaaagattatttatttcccagaataaaagatacttctaaaaggagatccctttgcatcttgtaataatgtacacttagaatatattctttttaattttttttaaagactagcacagttgtatattttaattaaaggtactccaattcagatctacctatgcttatggcacatgaatatatctagaggacagaaaatgaacttttaaaactatttgatagattaggcagtaattataatcactggactaatcttgatgtgttgttgaaacttcagataactatttttgtgggatttgctgagtaaaataaaagatctgagcatgttgaattatactttaaatttcaaagctttttaagataagagaaattctgaggttggcatgtcccaaataatgaggtttggtgatacctgtcaaggctatggagctcctgaagaccagttacaatatagattttcactactgcttctctataatgaatagttctgctcccttccaaatttatatttcatatcacatttgtttaacaactgtttaagtgaatctggtttgagtatgtctgttagatccagttcttattagaacaatgcctgacatcttagactagcatgagaaaaaaaggaaaaaagaacaatgcctgacagttgtttagaaactaaattcaaagtattgaaaagaaaagaattgttcacacagttattcactgacatgatattgcttattgatgacgtcatgggcgatatcgtttcatgatcaagcattccgtcaatgccaaaagaagaaaaataatatttttttcagacttatagaaaacttgagttgatatcactgattcagtgtgtttttatgaagataaatttcttgatctgtcatgcggcaaattcaggattagaaattcagcgatttactattaggttatattaaatgctttttaggaagaatttcaaataaagatgagattttaaaaacatgacagttgttgttcttttgctgttgtttttagagcaaatattttttctattttgttgatttggattatgttaatagatacagaaaaacagcaagaaaaacgagaacttctgttatttgagaggaaaagcaaattcctacatccttctgtcttcaagtgctgtcaatcttcctttgaaatatgggcatagtaggttctcccatttctgcttccagatttagactcttttaatccctcatgcagtgtgtcataatgacttcctaattgtcctccctcctttaatggctggccagtaatcttgtgaacaacctatgcaagttttgctttttcaaaaaaaaattaaaatcactgctcttcattgcattcatctattcatttctataattttgttatttcagtaatgttatataagtggaatcatatactgtgtatatttttaggatttttttcactcataattctctgaaggtttattcaaggtgttgcatgtattaacagtttattcttggctattacagagtagtatttcacagagtttgtttaaccattccaattgaagggcatctgagttgttttccatttgaaactattacaaataatgctattatgaacatttatgtacaagtttctatgtgaacataattttcatttctctgggataagtgctcagaggtgcataggatgtgccataggatagttacatatatatatatatatttttttttttttagaaactgcaaatgtattttctagaatgactgagctatttcatattctcaccagaaatatatgaatgattcagtttctccacatcctcaccagcatttagtgtttttataattttaaaattgtattcattctgataggtgtgttgtaatatctcagtgtgtttttaatttgcactttcctgatggctagcgatatttatcatttttatgtacttatttgttatctgtgtatccactttaataaaataactgttcatgtcctttgccaattttacaattaaattctttaggttcatcttttttaaaaaaattttccagtcacgttttgagagttctttacttatcctagatactaatccttttgcctaatatatgcttcgcaaatattttctctcagtctgtagcttgttttttttcattctcttaataggatatgatgcaaagaatacatttttaatattgataaagtctaatttattatttttttcttctataagtcatggttatagcttcaggtttaaaaactctagccctatatcccaaagacatttttttcctaaaagttttataattttatattttacatttaactttgttattcctttcgagttcatttctatataaagtgtaaggtttaggtcaaagttcattattggtccaattgcttgtccaatttacgtccaattgcttcagcaccattttgtggaaggctatttttcctctattgaattatttttgtatctttgtcatggaaagctgggtatattggccagccgcggtggctcacgcctgtaatcctagcactttgggaggctgaggccggcagatcacgaagtcagggggcggagaccatcctggccaatatggtgaaaccctgtctctactaaaaatacaaaaattagctgggcgtggtggcacgtgcctgtaatcccaggtacttgggaggctgaggcaggagaatcgcttgaaccagggagtcggaggttgcagtgagccaagatcataccactgcactctagcctggtgacagagcaaagtcgtttttgactttttattaacattttatatttttcagcatggaaattctgtgttttgatagaattatactgaattatttaattttcttaagtgattataaataaaattgtgtttttgtttccagtgtttattgttagtgtatagaaatgcaattgatttttaaaaatgtatatcttgtattttgtgaccttgcggagctcactttttaattttaggagattttttctttgcatgatccataggattttctatttcaataataatgccaactgcacacagcacagtttatccctttttttctcaatttacatgccattatttctttttcttgttttattgcactggctagaactttgagcactatgttgaataagagtggtaacagcagatagatgttgttgccttgttcctgattttacagagcaagcattcaatctttcattctttataattttagctgtgatatttttgtagatgctgtttatcaagtagagaaagttattctcaatttttatttttctgagagtttttaaaattataaatgcatgttgaatttttcaaaaatctttttcttcatagagtatatgatcatatgctctttcttctttagggtgctcatttgatgggttatattaatttattttcaaatattaaagtagtcttaaaccacttggtcatgatgtataataaattctatttactaatattttgttaaagatttttgcatctatattcttgagggatattggtctgaagctttcttttgttttgtttggtactgtctttggttttgatatcaaggtaatattaacttcatacaatgaattaagaagtgttctgttttcttcccttcaagagattgtgtagaattggtgttaaattttctttaaaagtttggtagaattctccagagaaattatttggcttggagattaatttgggatagagatgagtttttagcttatgaattcaatttacttaatatttaaatatctgttcaaattttctatgtcatattggataaattgtggtagttttctgtttttttttttcctgaggaatagtaaaatttcttctaagttattaaatttagttatgcagagatgtttgtagtattcacttactatctttttgatgtcttcaggatctgttttattcctgatgttggcaattagaataatctttttccttttttgtcagtcttgccagaagtttgtcaatcttattgatcattcaaagaaacagcttttcgtttctattttttttttgttttcatttccattgcttttctgctcttatctttattattgctttccttgtgcttactttatttagatttacactggtcttctttttatagattcttgaggagcaagcttgaattactgatttgaagcattgtctctaccctaatctaagtgctatctatacatctggtgctataaatttccctcttagtcctgcctacatttgtcctcaaaatttcggtatggtgtgtttttattttcattcagttgaatatatttctcggatttttcttaaatcttcttttttggccaatgagttatttggaattgtgttgttcagttttcaagtctttgaggatttttctttctttctattattgatttatagtttgatttccttgttatcagaaaacatactcttcatggtttcaattcatatggcccagtatatggtctttcatggcatacattttatgggtgcttaaaaagaatgtatattcttctgttgttgtgtcctataaaagtctattagattcatttagttaagagtgttttaatcttctataatcttgttgattttctgtctagttgttctatcagttgttggataggggtgttgaaatttccaactttagtcgtggagttgtatagttttccttttagtgatattgcttttcatttcacatcttttgcatcttggttgtttgatacgtatacttttataattgctatgtcttcttggtagattgacccttttgtcattatatggtgtcttactctaattcttttgttttctctgttctatttaatctgatactataatagaagctattgccactgtctttttattaatatttccataatatatcttctttatctttttactttaatcagcttgcattgttttattaatatttgaagtaagattcttgtagaaactatatttgggtggtattttaaaatctgctttgccaatctttgtcttcccagtggcatgatcatagctttttgtaaccttgaactcctgggctcaagctaccctcccaacctaagcctcctgagtggctgtgctgcgccactactcctggctaactttttaaaattttttgagagatggggtcgttcaaggttgaacaggctcaccttaaactcctggcttcaagtgatcttcccaccttagcctcctcagtatctgggattataggcataagccactgtactgggctcttaaacttttttttttttttttttttttttgagacagagtctccctctgtcgcccaggctggagtgcagtggcctgatctcggctcactgcaagctccgcctcccgggttcacgccattctcctgcctcagcctcccgagtagctgggactacaggcgccggccaccacgcccagctaatgttttgcatgtttagtagagacggggtttcactgcgttggccaggctggtctcgaactcctgacctcgtgatctgcccgcctcggcctcccaaagtgctgggattacaggtgtgagccaccatgcctggccaaactttttaaaaatgttacattctgacttatctgtattgtttctagagtttatttcattgtataattttttggtggttgctctaggtgttacattatacacacaaaacttaccacagtctaatggtagtatgattttaccagtttgagtgaagttcagaagacttaattcactttatattcatttaccttcccccatttataattgtcttaaatattttctctacatacatattgaaccatgtcaaacattgctatatattttttaattgcttcaatcatcaaacatagtttaatgttttacctatgttttatgtgtattgtttctcactgtgttctgtcttccttcctggtgttctgagattctagtttattctattttattttattcctgtttagagaaatttatttagccattcttgtagagtggattttcagcaacaaattctcttcgtttttcttcatttcagaatatggtgattttcctttcattcctgatatgtatttttactaattaaatataggatcctaggttgatagttttttttttttcctttcagcacttgaaaatggtaccgatacttcctcctggctttatggtttctgctgagaaatttgctcttattcaaatattttcccgtataggtaacgtgttatttctctcttgtttccataaaagtgtttctttctctttagttttctaaagtttgactatgctgtgtcttattttacatttctgtagatttattgtgttttttattcactcagcttcaatctgtatgtttatgtctttcaccaaattggaaagtttttcactttgattatttgattttatattactttgatcaattcttcagttcctctttttttttctcatttatttcaaggactccaatggcagaaatgtttgttttttttgtttgtttgttatagtcctccaggtccttgaggctctgttcattttttttttcagtctatttcctgtcctcctgtccgttgctgaaattgcataatttctattgttccatctttcaattcacatattctttcctgtagctcctccattttgctgttgagcactttcactgagtttttaaaataataattaataatttcagttactgtattttctgagttctaaaattttcatttggttctcctttgcatcttttattttgtggctgagattttctatttcagagactttctgtttttctgtttctctcaaatgtgtttgtaattgcttattgaagcattttatgatggcctccttatcatctttgtcagctaattttaatatctgtcatttagatgttgccatttattgattgtcttttttccttcagtttgagatcttccttgttctttgtgggatgattaatgattttctattgagacctgaatatttggaatatcatgttataagagtctggaactcacttaaaccttctgttttagcttatttactgtaaccccacctcagtaagacaaagatgggggtacctcatcactgtccagttgggggagaagtgcaggtgtccccctcagcctccattgatacctgaggagtgaaggatccatgttactcctgggtcagagtggaattgctggctccccactaggcttttactcatacctctctggaagtgggtagaggagtagtgcatttccttgttatcagaaagcacgctctctacagtttcaattcttatgacctggctaaatttttatgggtgcttaaaaagaatgtatattcttctgttgttaagttgtgctctataaatgtctattagattcattttgttgtcagtgttgtaatctatactcttgctgattttctgtctagttgttctataaatatcaatgttgagataggagtgttggaatttccaactgttagtgttggatttggagaaatggcctctttattgctggcggttgctaaagttctgactctccacttaacattctctgacaccatctctgtggagggaggttgaggcacctcagcatagcctaccatgggtagaagcccaggcactttggtccctccctcagtatttgctggtgtgggaatgagcataagtggagctgtaggttttttcttccctccccgcctctggtgtttagctggaatagtcattgtctaaatatttgtttttgtctttatttcgatttggtcttagactgcctctttcctggtccttttcctacagagaaaaggctttatttcttatatattaattttttgtccatgcctatcagtgatttcagcttcttagcttcttttcttttcttttcttttcttttcttttctttctctctctctttctttccttccttccttccttccttctttttttttttttgacagagtttcactcttctcacccaggctggagtgcaatggagtgatttcggctcactgcaacctccacctcctgggttcaagtgggttctcctgcctcagactcctgagtagctgggattacagctaatttttatatttttagtagagatggagtttcaccatgttggccaggctgatctcgaactcctgacctcaggtgatccacctgccttggcctcccaaagtactgggattacaagtgtgagccactgcgctcagcctgctagcttctttaactgaaagtcttggatatatgagaccaaatgaacatctagggaactcagcatcatatcatttcttaggtcccagggttcatagccaatctgccttcttttcttgttttagaatcatctgctgcttgttttacatgtaaggtccagggttttagtttaatttgtgggagaaacaggaacaagtgcatcaacttcatcttctcagaggtggagccaggagttgtgcatatttaaccagtggtatatttttctaacacatcagagagttaattactgcctaatctgaaatgcagttcaaatcttatgaatctctacaaatgaatgatttatttcaggtctaaattattctctctactcagcaaatacactaaagtagaatgcagtactgatacccatgacattgtgagttatgaaaagtaggaaggttgttttcctcttatataaatatatcaagatgtttaaggattctgatatagaaatgaatggtatagtacttcaatacttagaaaaaataaaatgttttaatttgttcaaaaaacttctagggtcttactattgatatcatgataaaacatttcagtcaaatgagttagagggtaaagcactaaatctcgtgtcctgagagttttccagcctgcttaggcagataccaggaacgtttgttttgttcctgaacacgttaaacaccaaaaaatatcacagagttaagcattaactagacagcgatttcaagcacatagaaaaacattaggaaagaacaatcaagaaatccaaagaaattttgcctaaaattaaaccctatagcgtaggtcaaattttattcaaatttttaaagattataagattgctgggataaaacaaagtcactgcaaaataaattaattactgaaatcttgtggtctttctttaaaagttatgtcaagtaaaataaagcaaaaccttgattatctatcatattcctagctttgtgctaccattttggtttttgcaaaataaacactagtaaagctgactttgatttatgaaattcagcggaactttgcccattttgaagatctcttttgactaataattttcaggaaaaaatataattatatttcctgtaaggttgtgctgccaggccatgcatggtaggctacctatacacaacaaggtaattacagaaatgaaatgtatgcatttagaaacttttgtggaaagttgacattgcaacaacatccaaatatgtggtcagtgtattcatctcactgaacagattctggaccagtccaggtactactgaatttatgtgtgagcccatgggatacatactgctcactaggcacgtgcatgtggaacacatattagttctggcagataagaaatttaaaaaacagaaaatggtgccaggcatggtggcttacacctgtaatcccagaactttgggaggctcaggtgaaaggatcacttgagcccaggagttcaagaccagcctgggcaacatagtgagttgtctctacaaaaaaaaaaaaaaaaattgaaataaattagcctggtatggtggcacacacctgtagttagtcccacctactcgggaggctgaggcaggaggattgcttgtacccaggaggctgcagtgagccatgttcatgccattgtactccagcctggatagcagagtgagaccatgtatcaaacaaacaaacaaacaaacaaacaaatggaaaaatgggtcctttacagatatcttagcattgctgccaagcacatattatgtgggtcttacgcaaacatatttattttaaaactatacataaattatagctaatttagcaaatttctaagtcagctcaagtaaaattttttttattttgtgattaaaatattgactagaataagaaaacacagctaatcattttaatcttataaaaaccctaccacaagaccagtgttgtcagaaattgtaaaatgctaagttatattagatttcattattcctcaaagtttcaaagaacaaaataagtattcaagggaaatttttaaatcattttactcaggagactttcctgtgcattgaaaataagaatatacaaataatctgtccacttctctcacctccattccaccatcattactcttgaccagtggtcttcaaagtgcagttgtcagaccagcaattttaatatcacttggaaacttgttagaaatacaaatgtttgttcttcattccagacctactgagtttaaatctctgaggctgggacccagcaatctgtgatttaataagtcatccaggtgattctgatgcacaccgaagtttgagaaccacttctctttaccaagatatttccattactcttggttaccacaatagcttcccaactctaattccctttcattcctttctcaactctatagtctgatcaatatttaacaacaacaacaacaaaagtcaggtttctctacctattaaaaaaatcaatgattttctaatactctcaggctaaagaccaaaatgtttaacgtgatctgtaaggcactttaggtctggtgcccagtccacctctcaggtcacttctaacagcactccctccgcctctcagcccttgcccctctggcttctctcacgcctctctactggcttatcccaattctttcctgattgattatctctaacacaccctttaggagaaatctatttttcaggaaagtcttctgtagctttccaggttaagagtctcctgcataattctgtaaatgtataattctgttgtttaatagaccttgtatctcctagcatctatcccaattgcaatattatattcacatgtgattatttgactgtttgcccatcccaatatcacaaattagtgtgtaagctcctagatagaagagaccatgtctgttttttgcttttccttgtttccccagaggctggcacagtgtttactctgaggttgacattcaagaaatattacataacttaataaatggctgactgccaaataaatggacccctaacctaggagtggctcatactgcaatgggacaatgatggatgactctctggctgtgctccctgttactacagtttttttttttgagacggagtctcgctctgccacccaggctggagtccagtggcgccatctcggctcactgcaagctctgcctcccgggttcacgccattctcctgcctcagcctcccgagtagctgggactacaggcgcccgccaccatgcccagctaattttttgtattgttagtagagacggggtttcaccatgttagccaagatggtctcgatcttctgaccttgtgatctgcccaccttggcctcccaaagtgctgggattacaggcctgagccaccgcgcccagccgttgctatagtttttaccttccatccacctcaggaacagatactgtactgacaccatcccaggagcaaccatctttgaaaaatagggtaattcttgctctttttttctgctgctacaatacagcagagtatcagcagagtccaccatactggaagaatttccatcaagtattacagctcagtgtaaattttcccataccaagaattgaacaaaccagtcatcagtggcattctttttatgattcactgggctaaactggggattcaccataatttacaactttttgtggaaaaaatgaaatcccatttttaaacaatatccttacaaacatacctacttgtttttagggattcactatgtaagcagtaatttgtttatttttttctctcaacactcccacttctgccaaattcaaatgtttttcaccagcccaaaaccttccgcatccccctctaaaatttaggacagaaattattaaatattatacttgatgactttttaaaatctattcccatttattcttcctctggtaatccttaaaggataagagctcttgaatatgccccttaattagtgatgttgggagaaattctgtatggcaaacctaaactaaaaataaatgtttctaaattctaaaacagagcttctatcccttcttaaggagctcagtgacctctttgcctctcactctggggcaaatcagcatgcctcagccactgaatgtttttcccactgggttggaggattccaataataaattaacttacaggagtgaacaatggagtaactccccttaaggccaaatcagatgcaatctgctcaaagtcccaaatcaaggaatattttaaaaatgtggttaacataatggatattattcatgctttgatcttttcaacatcatcctcacaaaacaatcatcatctgcatcatcatcataaaatatgaaggtgtaatttttatgtgtgcctggtaaataatgtatatatttataattcgcattttataagttgcaaggaatgtgtacatatttgtgaataaatagaatgtttatgtgtatatatgtatgtatatctttctacctatgtagaaagtcatcaagtacgttatgtgtatatatgtatgtatatctttctacctgtgtataggtagaacctcccatatatgcatgtgtgtatatacctgtctttctaactatacatagaaagatatctatgtataggcagaaagataggtatatacacacatgcatatatatatatatatgtatacacatatgtatatataaagatatatgtatgtggtttcatatgtgtgcatgtttgtgtgtatatatacacacatgcatatatatacacccatatgtatatatgaagatatttataaagaaaatataaatatattatctttatatacacatatctatgtatatatacacaaacatgcgcatatataggggcacatacctattttattaaaagactaaaggcagcaaagtggagctgtaaacatgaaggataaatcatttcatacctggaagagtgctgtctaaacactgcccatcacctaaccaagagtcatcatccctaactttttttcataattgactatttcagttaatagccctaggcttcaagaaaggctgcgcatcttggaagtattagggcatgagtcatgagtcttgattcttccaaataaaatatggtaactctttctagtgatttgtttaggaatgtatgtgtaagatgatgatgggaagtctactggaatctctgagagaagatttttcttgcaaaaaataaaaagacctaatgaaagaacactctgtttggaccgttagtctcttttggtgaacagtaagtggtaatgagagaggcttagctgagtttttggcagttctttcaaagcatgggagcaaatcttatgtcttgaaatccataaggtaaatattactcaaatgtctaggttgtaaaaatatatattgtaggcaagaagaagtcagttttttagttatgtattattatatgattccctgagaggccatatgagataataccaaaaccacacaaagaagaatgaggacactgatgtaggacagaatctggaacagcccagaaacattaaatgtgtcattataacaagaagtgtaggtatcaggtatagggactgcagcaggtagaaaccagatcttagaacagtcaggaaagttcccagagcatattcggagtttgtctagactcaggaagtatgcctaagtctagaaacatcctagagagctatgtccaagaaatcatccgatatttatactttcagtactgataagattaggcagaccctacaaaattattcctctttttcattactaggttatttctaaaatgagatgaaatccaaaataatgatattctatattccctatagataaggatatgtacattttaaaaaattatctttgatataaaacattggtgttggtgtaatattgaccatcatctctgcttaccatttattttatgtccagaaaaataacgatcttgtttcaaaatgtacacagtcaagagacttagaaagttagtggccaacatgctcaaaaatctcttgagttacaaaaataaattttcttttctatgaggtcacccacctaaagtgtaggaacataagtgagtcctcaaaacccagctttacacaggttagaaacttgtcctcttaatttagtattttaaatttagtgatccatgcagtagtggacatgttaatgtacataaggaaattttcattttatgtaatatctgtggtttatctataggaaatttctttttatatgaaaaaatctttcttcaacaaaatggattttgtagtattaatacaccttgagtcattaggtgtctccagttgataaatattatgtaatctgatggtcctaaatgtattggatcaattgtatgacaatctgtttgattaattggcaataaatatagaaatggctccaaagctggtgatattgtatcactcttttgttgtggtatgaagtattggcagtatacagctagaatgctcaccttgtcttaatgtacattcttgaatctaccatctgagttatttggcccatattgtcaattacattggccgacagtcttttattttttaagagacagaatctcactctatcaccagactgtgcagtggtgcgatcatagctcactgcagccacaacctcgacctcctgatcttaagtgattctcctgcctcagcctccctagtagtatgccaccgcgcctggctaatttttttagaacattttttgtagggacagttctctctatgttgcccaggctggtagtgaactcctggcctccaggatccacctgccttaacctcccgaaccgctaggattacaggtatgaatcatggtgtccagctgcaacattaactctgctccaactggacctgaagtggaaaaaaattgttaacttgcctgtagtatttattttatacatatcttctacagaagagatttcagaatttatagaaatattttaaaaaaatcatttagtgacaatagaaattttagtgtcatcttccttatacatgcttaagctcttaaaatttcattctcaaagaggaaatctggatgtagataatgaatatcattaaaatgcgtatgtaggaattcttgaaactgacactcgtttcggcaactggcaaacctcctctactggaaacagccctgggctaagagtcagatgatttgcactctgatttaccagctagaaaccttggataagagacctaacctccttagtcttatattctcatttgttaaatggatatgaccatatcttctttaattgatttatggggtatgttgtaagcattaaaatgatgaaggaggtaaaagctttgtagaacatgtatgctatttagatacagccattttaacatggcaatttagactcagttgatcattttgatattatttagcataatttttaaaataatgtattgattaggaaagatttggataaatagtttagaaaaaccccactaaataatgatggcagaaacaatgtatttttctctctgaaaaaattctcagaggtaccaatccagggctggaatggtggccccatgatgccgtcagtggaccagggggctgtctctcctctcccttgtctttgtatagcttccatccttaacactgcctcagtgagttctagccacttcatttgtagtctctgcaggaggaagaaggagacggaaagggtaaaaggacttctttctcagctgtcattccactgcaaagcaaagcatcttcctggaagacacacacaatgacttctgcttggctactccaagagagtcaagaaaatgagtctttagctgagttcatcaagagtttactgtggtctataaaacaaatgatcaaacttctgctttttcgttacaaaaaaaaatagtgaaaagcaaatctgtatctctttcttgagacccactcttccctatccctgaacctcccacgtccctaccccttctccccaagctgagaaatgggacagtaatgctcagatggaatgagagatgggctaacgctcaaagatacctcagaaatgtgtacttggaaataaagaacatgtgtttaatttttgacgtggtcactttatttgaaaatattaaattctcatttgttaattttttggaaaatatttattgaacacctactctgtggtaaatatgacagaaaatgtttatacagatggttatttcaaaatgtaagtgcattagagatattaaaatatggcaaattcagagcataaatgaggtgggtacaggggcagtatttagatgagatggtaggaggtagaatttagactgaaatcaaaaaccagttctttaaaaaattgtggtattcctactattaacactgatggcaagccttataactcactggacacaaatgcatgtgaggtcttgtcactttgtttcttttccatgtaagtcactctagaattgccagtggtgggttatacaggggaaaagaaattatgagaaccaggcccacataaatatttcttctcttattgtattaatcacttacctactgaactaattatcactgcatgtgttactctaatgtgattaaaccatattcaaacagcattgctaatatcccacgagaaactcagtaaaactcccaacagacctaggcagtaaaagggagcatcaatataatctttttccctgtttttacttatgatgaaacaataccattttgattttaaaatcatcttgttttagattatgtatgaatgtagttatagtatttttcaccagcaaccgcttgccttctctaaagctgacaattcttttttttagtatgaggatttagattctatttaagtattgtaactattaacaataaagtgacagttccatccaacagcagtcgttgggcacttgcaatataccatgtactgtaccagcacaagataagacaaaaataaagtatcaggaaaaaggctagatttcttaaacccacttgcccacgtcatcatgttatatttatgggaccatggccacatactgcctaaacccattgaaccaagagtaaaatttccatttctacctagtcaacttcaatctattaatggctcctttttcaatggggagagtctaggtgcattcactttagatcattatctatgtttgtggaatcaatttgtatccattttagactatggcctatgccaagaagaggggagtttattacttgccttcagggctcttgattcatctccttgcgtgagcagcctgtgagcctgcccagtgtttgagaggaagctccttgtattggagcacatgtggtttggcagagcctggtgtgaacatgtaagtgccagtaaccagtgctgtgttccaacgctgcatgctcattataatctcagcctgatcattatcatgcctctggcagggcctgcttcaaaggagccttgcttgtgatttgagggaaaaaagccaatagaagacacatctagaaaaactggttggcattgctttgtgtgattcagccctggattattcctataaaggaagagaaggcagaggaggatggtctcagacaatgcaccgtcattacagttggacgatattgggatgtttctgcttcacataagcttttaaataaatgcatatgcatttatcccatgattgccatgtgcaaaccaccgtggaggatcatgaagatgtaagacaaacatcctgatctttgatgagctacagtttcattgggtagacatgatcaatatacaggaaagaggacaaaaaatgagaatttatgataatgaaataactaatgaggttcatactgtaattgctaggaaggctcaggcaagaactttattttttaaggtttacagtgtacttgcttcatgttttggatcaagcagaagcaccacaaaatgttttcataggtaaatcaagggcaataacatattcattcaacaaatacttcttgatgaaagactgacttaatattcactcagaggtagattccatagagttagaacctaagaggaaatctattgtgacatatattacttgtgatatgccaaggctttgttttgcaaattaaaattcttacagtgctagacagggtgaagggtgatgacagtagccactgaggcagccactaatcagctctagttcattgtcatcaaagatgaacgcaagcttagtgttgctgagtcttcatatcatttcaagtgaagccagaaataagaattctgaaattccctaatatataaagcattcatttgtgggttgggaggaagtggtggctgtgggcatgtgcctgctatttccaagagccatcaatgtgcggtgctcttggcagcagtagatctccatccagctttcctcaccagctctgggcatcaaggacaggattgtaatgtgttttaagaaaacactgcactggaaacatgctaatcaatatgtaaagtacccaaccactccatactagatgtaaaataagagatgtatttgaaggggttttggaagcaaacatctaaatgggaaatagaagcaattatctttctaaatatcatccttaatagttttttcaatttggaaaaaaagaaaaaaaagctgtagctgccttttcttgttagaagtcttacatgagctaatctttctgatttgcacagattactatgtggcaaagccttgcaacttgctttaagcttctgtgtgtcaggaaggtaagcagggatttcaattctctcatgggctcttgagtggatagaagtgttgagtaacaaaacacaccttttctttgcacctgctttaactgaagaattcaggaggctaaagaaatcggcttcccttcctttccccattctgtaatttttcatccaccaaataggattggataatcaaaataaatgatatgagaccctcatttcacattttatgataatatcctccaaaggatgcttgttcactcttaacagtatctcttggttaccatgacaaggaagaatgggaaaaccactctcacattgaaaggaatcccttgtttgtttcgttgttttgttttgttttgttattgagttgtactactgttaacaaaagacatcacaatgaagcacatctcatctaataacccttgtgtagctctagtcatgttagtggttctgtagccctggtgccatccaagctccccaacagaatctcccattgccactgaagtccagagacccagaatgtgaagtaaaactggtccacaaaagaagctgtttttcgtggccacactgcaatctctgacattcagcaattatctaggatcaggcaaatgggcagagagggactccttcccctcctggtatcctaagtgacagctgctccatgtcaccaaagctctttttttttttttttcagatcaaatccccacttcatgaaaactaaaatttaaattaaaatgtctgttttgggggatggattataattatatttctattcaatgattcatatataatctttggtcttacagaaatatcttaaaacttccacatttttcatcaatatttttctagcagcatagggtttgtgttcagccatttgtgaagacttttacacataattatttttcatttgaaatgccttctgagaagaataatagtaaaagtatgattaattaaacaattacagagtgagtcaatttcttgatttcaggtttctgatgaagatagaattctccccagccaaatttccagtgaactctccaaattattagaatcaggggaaatacatttttatttctggaaccaatattaaaggtaactcatattagctagatttttctctgagaatgaactaagtttgcaggaactccatatatatgtgtgcatagatagatagatagatagatagatagatagatagatagatagacagaaagacggacaggcagacagataatctccaagaagccccgaagaaacctgcctgctgcatttctgcattgctttcaaccaaaagccctgtgggaataaggcaataccaacactgtgatgcatgattggtctcaaccagtatttaaacaaatgaaggtctgggaggagacaggatgtgggagagacccccaccacaagcccaccaccttcacctgttgacattaaaatatcctcagctcccaggtctgtgttttcaattcatgtatattaaatgattcagagtctggcaggaggaaacactcgtaggagtgttttgtttagttgtgtttcgtagctgcgatgttttgaaaatcaggtttttttgagagcacatagctagataacaaaactggcacagagttccagggttgaagacagagaaactgagaaacaagccatgggacctggattatgtgggtcatacggacaagaatgcatgcgtggtatcttctcacagtgttcagggacttgttattgctgtcactgtttttaaatgtgatttctgtacagattcactcagtgtgactacatctggattgttcaacattgttcagtatttcctcttatgaccttaagaagaagaataattttgtcaaggaaagtgctaaattaatagggtatttttaatgtacttagactttgagaaatttttgatgatttctgaaaagtttaataatgccatcttaggcagagaatagtttctcatacatccatgaagaaaaaaaaatgaattaaaactcaaatcttaagcaaacataaaggatgaatttatttaatatcacaaagagtaaattaccatttgttcaatggtaataattgctttagagggggaaaaaacaggatagaaggactagcaagtgcctgaagggtaaggattgtggggtgtggtttataattttaaagtggctgtttggcctgcagggtggctcacgcctgtaatcccaacactttggaaggctgagaggagagggtcactggagcacagaagttcaagactgcagtgagctatgattgtaccactgcactccagcctgggtaacagagtgagagcctatttctaaaaaaataaaaataagttaaataaatacataaagcaggtgttcaaggaagtgaactgcaaagtgacatttaagcaaagacctgaagaaggtaacaaaatatatagaaaaatatttcatttttactttcctttcagaagcagataaagtaattgataagtatttgcaaagagcaatattagaataattcatttctttaggcattacctgagaaagatgtagacagactactggagacctgtaatcacctcgaaggctggacctggatgaatcttctgtaagatcctagcaacttcagctttgttcagggtagttttaggattctatgtaactttgttccccctttttgcgaattaggaatgtagtccttctatgtttgtatacttaaggacttttatttaataaacagaaacatcccattctctgggcagtataatagcaacaagaacagtgtacagagtcccagagtggaattgaaagccaagttttgggctgagtggccccttagtagccttaggactcagagcaacacatttaatttatctgtgtctccgttttctcatctgctaagcggtaagtagatatcatcgtcctcaaagtttttttgtaagttgcaaatgtttatgatttccaaaattctgttattttaccacttgtttctgagcctttgcctgaaacagagggcagcaggatagcaactgccttgtggaaagttctgtgggtgactcaacaggccaaacaaggaatcgggaacattcctttatacctgtgcccatgtaaatcctctccctgagttttcagctatagtcatttattgcacaacctgttagtgaccttgccaaagtcctccttatccattactcaacccgcgtgccaagctgcttcagctcctgctattgtttcccaggagtttatagctgcccttcattgctcgaagctgcactttgaagtgtcctcacacttgtggttgtcctgttttatctcaccatgcccagattccgggaatcctaaggtaatccctcatctagaaggtcagtgaaaatttggtgtggtaggtcttactgaagaattaaatgggccgggcacggtggctcacacttgtaattccagcactttgaaaggccaaggcgggtggatcacctgagatcaggagttcaagaccagcctggccaacatggtgaaacccaagctctactaaaaatacaaaaattagctgggcgtggttgtgcatgcctgtaatcccagctactctggaggctgaggcaggagaattgcttgaacctgggaggcagaggttatagtgagctgagattgcaccactgcagtccagcctgggcgacagagccagactccatctcaaaaaaaaaaaaaaaaaaaaaaagaattaaatgaagactggctgtattctggcagtgtaatggtgttatttatttactttctttgattttggtgcaaaaggatgtttgctgtttagcagtgctcaaaagtccaaagttcaatttaatattccatttactctttcctgcttttacaaagactactgatgaatatatcaacccatattggtcatctttcttttctgaaacaaggaagcagtattgtggtatagcagaaagagcacaggtataatgtggagatgaacaaattggatttgaattacaactctgcattttacttggctgggtatgtggaaaggtactattgctgctacaactgagtattgatggtaataattttatgcgtgtgtatattcctcactactacctgataaggtttcattttctttaaaatacagattgtaatatccatttcacagaattttatgaaaattagtaagagagaatatgtgtataaaacattcaatcactaaatgcccaacgtttcaaacatactagatttctccttttgaacgtttttattcaatatcgttaggcttaaaacaattattttataattatttcatgcctataaatcttgtctcagtaatctcctaataaaatttgtaaaaaaagaaccaatgccacacatttctttagtgtctccagtgcagtgtctgaactacttgaggactttttaatctgttcataattttcaatttaacgttagcatgttaaattcttagcatttaacacagtgccaggcacataaaacttgctcaataaatattttatgagtaagtgggcttcctcatttatttgcccatgaatctcttcaaattcatgggtccaattaactgcccttaaattagttttctttcaatcaaaattccactggaattttgcttggctggccatagtcatctggacctatcataacttgcttcggagtacctcagatcatccaaggcttctaggcccacattctggaatacattaggttctgttctagtgctttaagggagttagactgcccagaaagtgacaatcacatacaaggatgtgttttaaatttaggtagtggtatatatattctcatataagagatatatccaggcttaaccccatgccaagttccattaaaagtcatcattgattattttgtcacccattgccttataatgtcgcaatctttctactccttagctcagctaggtctgagttcttgtctcacaaccaggaagaattaggcacacggacaccagagaatgagtggagtagaatgtattaagtgagaggaaagctcacagcaaagcagcgatgcggaagatagttcccttacccaaaggcagaaaagtcccttccctgtggctgggtctgggtcctcttatgcactcagaatgggtagcgcatgctgattggtttgtgagtaggcaaaacacgttaaagcaaaggcatcactcaaaggtgggcacaacagtgtagaaaaccaattaggaaatgatagttatatgtaaaataggtgaagggtggggaccaataagaggaaagtgcaccaaatgaaaagacaggttctcaatccattctgaggatttaactggtagcttggctttcaggctttaatactgcctttggcttggaggtggggttttcttggggacccacccctatctgcctagccatgtggctgcctcctgccgctctcaataggtagttaaataatctgtataccaaactcctgtaacacacaatttacctatataactaacctgcacatgtacctctgaaccaaaaatacaagttaaaaaaaagtcaacattgttccaaatataactggcaaatgtccaagaagacaatctatgttccttaggttgcccaacttggtttttttcaataatatttttaatatttttgaggaaaacttctgctacatttttgctcatatatctaagaatcacaatgaaagtaatgattgctgagtggtttgctattttgggatctttttatttgtattccttgcactaaaaagaagagaggaaggtcaagttgtcagtcatctaaataaatataatgaggtaaatttaaatgtattgagcaactataaaaaaaatgtgtttggccctgtggtctcaaattttactttggataagaatcagttgagcgatttattaaaattacagttagtctgggtggagatcaggaatctgcattttatcaaggggcccaggtgattctgacactagtagtctgttgatctcagtaaaagaaacctgtcttagactgtacagtatagtcactacttaggaagagcatgtattatctatagccaaacagaactcatttcaaattccagaactgccgtttgctatatttgtgagtatgggaaattatgtaacctctttgaacctcaatttccaactgtaagactggatagttcttaccacgtgggtaagataaaatgaggtatatgcctagaccattttgtgtatcaaaaagtaatcactgaatgggaattatgtatttctacatatgtaatatgtagaattgtttctttactgtttgtgtccttctaaatgtaatagctcactagtaattttaatggggaaatatattgtgaaggctaatgttctaacctaggttcagctctataactcctctatgattactcagggatggaaatcttgagaaccacctgctagtgggattatgggatctaaaggtgatgtttacttttgaatcagatcaaaggatttttttttctatgttacagcagacaaaagttgttaaagaaaaggtataattttatacactccattgccctcaattgtaatataagaaaaatacttcattgatttctggctctgtaactccatttaactcctgatgcaatttcccacaagagtaaatttacctgcaaattaatctgctttgaggccccctggaatttctgatgcaaatgtgggtagaggctggagggtttaataaataggttgttccagtgccagcccagagcccatcattgcaagaaggatactgagggaaacccaagccccagaaaagactgagatgttgctgacctagggttacactgagaacaccctgtgagaagttttcttgataccccagaggtcaggtcgctgctcctctccttctgtcatgcacttgatctttgcacctccacagccttgtgttaatgcactgtccttgattgttcccacgtctatctcccactgaggatgtaagttgtagtttcctcatttttaacatctgtatagaaaacactgccaggcctcgaatgaatgagtaaagaaacaaataaatagctatatagcaaactcctcgactgagtagatctgtcctgtgtttatgtaattgtaccaatgctgtgcctaaatataaaaaggcaaaattggttccatttgtacatgtagttctttaaaactaacaaaatattttatacgctagtgctttagcattatagagaaaaaaaattgcccttatgatttgttaaaatagacagatgcaaaagagttatttcattgttgtctactttatactgaagtacaccagggaaatttttagcaggtacatctttaagaacaggtctcaaagcacaaaaagccaaggaaatattttatgatagcttcaaatttaccataaaaaatttaaagtgaatccaacccataattattattaaaaaagactttcagtggccttctactaatcaattatacacaaaatgtgtagaaaagaggtattgcaattttggaaacttttaaataaaataaatactgaaatatttttataaatattatcttgtaatttacgtatttcataaccgtgttacaaaatgccaaaaactacaatgtgtatttaacttgaagccaagtaatgacatgcaaggggaaaacttcgtttttctagagaacattcttgctagttctgaatgagctatacttaatcacagtgtgcctgaaataaagtcaggttggacagctccctagacgagtagggtgctccaaccataatttaccctccttaatgtggtattttctatccactgaaaggttcagtccattttaaaatgggaactctacctcaggtataatcaacaagatcgttgatggctccctttcattaagagaatattggccaaaagctcattataccatttctatttatgttaaattaaaggagaactagttgtacttttaagcttcttatatgtcgctccagataataaatatgccaataaaattaaaggaaagaataaagcatatttatgtaaattctaagtttataaggaaatacattagtaggcattaaaaaaatcatccaaggggaaaggtctagggagaaacatgaggctctcaggggagctgtattggtaaatgatggtctctccacaggggcatctcgttgttataaatcatagtgctgagtatgctgcaggacatgaatgtgcactagtcaatttccacttagaaaatggtaaactaaaaaccaacgttgagaccttcagataagaaacaatactcttgaatttcatcagtgcatacagtttgttaccactcagttacattgaattcacatgtggattggcattttatttttactgtggtatacttagcccaaaataatgccaacagcattgtttctgttcctcactgaaagttgggatatttccaaaggagtttccaaaagaaatgttcaactgtgaatcactacgaatatcagtatataaaatcacttgaatatagatccttggaaaatacctttaagttagcttattattggcatgtagaataaatacagaaaatatacaaatcctatgtgtacagcttgttctgtttacttcacaaaatgacatctgtgtggcacaagcaaccagatgaagaaacagactattatctgaatccagaaaactcctttctcccgcttccaataattaatacccaaggataaattactgttctgaatttttttaattgagtaaaatcttcctataagtactgttttgtatctgattctttcacttcaagtatgtgtatgggatccatccatgtttttaactgtagttattgttcatttattctcattgctaagcagtaatgtattgtgtcagtataccataatttttatgtccattctactattatagacatttggatatttccagtttcgagctattattctattgcagacatgaatgttgtcattgtcttttggtaaacacaggtgtcctgtcgaatacatttctaagaatgaaattgtgggatcatcggatatgtgtctttagctagaagctttagtaatttctgctaacaataggagttccatttgattaatatcctctccaacatttggtattgcctatcatgatgactactaacacacctttgtatatattttggggctatttagatagttttttttgtgaattgccttttctagtcttttgcccacctattatgttgtttacatttttcttattgatttgtaggagttatttttatcttctttatacattctttcacaatgcatttattaaaaaaactttatatgcactatatagtttagtttcttaatggtgtatgaatagtcagggttctccagagggtcagaactaataggatattgtttatctgaaagggagtttattaaggagaattgactcacaggatcacaatgtgaggtctcatgataggctgtctgcaagctgaggagataggaagccaacagtgcagcctccatcctgtgcccaaaggcccaagagcccccagaaaactactgctgtaagtccaagagtccaaaggctgaagaacctaaagtctgatgttcaagggcaggaagcatccagcatgggagaaagatgaaagccagaaaactcagcaaaccagcttatcccaccttcttccacctgctttcttctagccaagttggcagctgattggatggtggccacccacactgagagtgggacttcctctcccaatcccccaactcaaatgttaatctcttctggcaacaccctcacaaactcacccagaaacaatactttaacagctatccaggcatccttcaatccaatcaagttgacacctaatattaaccatcgcagtgtcttttgaagaacagaaattatagtatcattttagcatagtccaattaatcattctcttttatttaacccttttagaatgtgtgaaaggaaaataaatcctggggcccccaaatcactaagctaaagggaaaagtcaagctgggaactgcttagggtaaacctgcctccctttctattcaaagtcacccctctgctcactgagataaacgcatatctgattgcctcatttggagaggctcatcagaaactcaaaagaatgcagtatgtctcttatctacctatgacgtggaaggcccctccccattttgagttgtcccaccgttgcctcgagttgtcccacctttccgaactgaaccaatggacatcttacacatactgattgaggtctcatgtctccctaaaatgtataaaaccaagctgtgcccctaccaccttgggcacatgttgtcgggacctcctgaggcggtgtcataggagcaagttctcaaccttggcaaaataaactttctaaattaactgggacctgtcttagatattcagggttcacattttggcaaccatgaagggattctgaatggagatgcccctgatctttgacaaatctgctaccagtgcttggtaccagcatgagctaactttatggctcaaaccaataggataatttgctcaggtctaggaacacccccttcagagaatccctgacctccaaaaatttggtcaagatctaaagtttattttgctgtacaactctccttttctggagttttacttgcttccaacaaggaaggcaagatttcctgcttccatgatgatggaaggcaggtaactcctttatggagtgtgaactcactcctgtcagggaagacaagttcgagatgtttgaggttttttttttttttttttttttttccctgcttctaggatggtaaaaagctgtcttcagcctgagacccattcctagttaagtagatgaattggggttttgtctttgctaaagtttaacaactggttgtcttaatttctccttaccgttatagcactcagtgatcatattgttgagttatttggtgttgatggtggttccatctttattccatcagatttgacaaactctacctgacttggtcaaatccaaatgagaattccaaattgtgggtaacaaaacctctctaatttggctaaaattcctcacatctgcaaaagagggaaaaaaccgaaaaccaaaaaaccatgtgcttgttttccgtgtttgcttcctatcttaataaacaaacaaaaaaacaaatgttcttttatttacttttcttccaccctatacctccttcctattttgccatctgcagtgccaaaaacatctagagaagacttctaatgacttgaacccctttcaagaaatcagagcaaaggtgccactcacctgttttggggtattttgttttctttgtgtagtttcaagagtcatgggcagaatcttcttaggtctaaagctctgttttcctgtattgcatgacctgatctctttggcttgggtaccagagattaccttgtattgggagaggatttgaccttggcgtgtgtaatggtaaaagggagctacaaagttagggatggctgagcagtttacagggagtggtcttggctgttgttatttattttttttctccttggaagttgtttaaggatcttaattctagtttggagatgcatcctaaggggtcttctctattgctttttctcccaacattaatctcaattagtcttgtctatgtgcatttgcatgagaaactgaactgttgttttcataggtaaatgtgagactgcattttcacagctctgaagaaaaagggcatttgctcttctcagctgaaaggtgcccttgggtgactgggggccctgtaggagtgtctgggaggttgatccccagtggccctgcagggaaatccccaacaaaattcatttttaaaaaggctcatccaggaaaagcatataagggatgatcacccagtgttttgagccctctcataggtcatagatttctggagagagaaactgagacacgtaagagggtggaaatgacttgcccacaagcagcacacatcagtccaccatataaaaaccctaggtcacagctcagttcttccttttaagaaaaaaagtggaaacaaataatctaagtattgaggagaaaacaaggagaatgaccccctttagagcactccataggttttatgtcacgtctacttgccagagtttatgtaaaacgaaagtaatatggtcttcgaacacatttacattaaagaaaaagatccctaaggtcagtctccaaactatagagttcctaagttctcttttttctctattttcttttctgtatgctttaaatctgctgttatttttctattaagataaaaaccactgtttggatccaacaggttttttgtttgcaagctagtgaatttgtatttacctcatggctaaagttctgaaataaaagctataggatctttgtgtgtgtgtgtgtgtgtgtgtgtgtgtgtgtgtgtgtgtgtgtgtgtgtgtttaaaaggcttttataaaatttctataattttatgtttaattggtaattaaatccattttaacttccccttaccacagcagaatttttctctccataccttatgatgtaaattttacaattattggtaaagtaatgttagaaatgtcttaagaattgccagcatagatttttgtttgcatttattaatcaagcaatttcatacttatccctgccaaatactataaggtgtcaaaatgtgacataaggatcacaaaactataaacccagcccaaggcagaatgatgtttgcttatgtaagttttaatcatcttcgggcctagtagaagatgccaataaaaataaactgcattcctgaggcacaaggcaagaaattaaagctattcaactcctcaagactcaggaactattgcagaagaggtaggtgtgtgaggttgtaggggccgattttgagagataaagtaagttcagtttctctataatttaattattaatgtcaagggcacactgatgcaagaccagcatatggacccctttgtcagcttaagaaggttttcttgaagcattaactgacatctaataaaggttatgaaggttataaaaggcttctggaacttatattttatggtcaaaattggaattttataaattataaaattttgaaaaaccaatttaattggcttcatgctgtttttattggggcttattgtttggaaaactaagtctcttctctcaaagaatgaagcttttcaccttttaaaaaaatccttgactttatcactttggtcaaatgaattacttattttacaatgaagtgtgataccaagtgttttaagcctttgatatttgatgaactttccaaaatcaaattataaattatatctttttcttacctaattaatcctttaagatattaggttccctgaagtccagaactgacataatttggcttatttggtataaaaattatatggcaggccttgtcaaatatgaactggtgtttggttttctttgggctgatttgtataaatatattattgatatgtgttccaaaattatgggaaaattgtataattctgatatgatgtattgtacattatcagtaataattataattgttatgttaaattattgcatgccacagaggtaacaaatttccttatcaattgtgtctttgactctggctgctctaaaactttttgtcatccatgacaattattgtcttgttttgatccactttagaaggtagttttataatcagcataaaactcaagagcacctgttggtgctcttgaacacaagtttctgataactttggagactgtgacatcagaatagaagaaaaactttctgggctcatggagaactgaaatgttcatgaatatcaagcagaacaggaattaattacatggactgaactaataaagattgagtaatctttttgactttttgcttaaaacattgctgatcctttgtttcactttttttcagagtcaaggaaacttttcttttgagctattgacagcttttaacaaatttgtatactcctatgagcaaaatttagaacatatttgtttctttctacctgatttcttgagaatttggaaactgggattattcttaacttatggcaaaacagttatttgcataagtacaataagaatttgttctcatttataacaggacacaattggagaaactgattattttactaaggctttgactgggatggtgtgcttttctttaaggaatcaattgacttatacagcaaataaaagccccttgggaaaactggcctcatgccttgtctacacagtccttacacatcattcctgacctgtggtaagaaaagattgtcactttctaacaggcccaggagacccaagtttatcttggaacctcacatggagaggaattccccaactcataggtatttgacggtacaaatccatggctgggctcggctttaaaaaagtcttacctgagattccttctatggaataaagttccatcaaagccaatttaaaagccaatgtaaaaaaatcattattcttgccacactgtatacaaataatcaggccaagtataagaaagcaaatcagtccaaccatgatttgtctttaataaaaatgggaaactggagagagaaaaaatatgtttcaaaaaccatagtacacctgttgttagattctagtcttgcctaacgtttttcaattttttttattttctacagattggagcaaactctaatttttcttggctacaagtcttcaaaataatgttttcaatttttttccttctttttctcctgatatttcctaatttggagtcactgaaaactaagctgtgctttcataaagccctgcaactgaagctagacaacttaaacttcagaagaaagtaacagcaaactatttacttacataagcccctttcatacctgcctactgatgtatggacttcagagtaatgtggcctatctcaattttccagaatcgttcttttgtttcttgttgtttttctccttttctcctcctattttctcttcataggacatgagacttcacaacctgctaaaaatggactttcctaataactcaggacctacctgtctaggaataaaccattctagccatgagagatcagatgaaacctgagaccatagactcattttctcctaaaatgctttctcccaaagatttttttaaaaaaggtatcgagtggggaatgtgaaaggaaaataaatcttggggcccccaaatcactaagctaaagagaaaagtcaagctgggaactgcttaggtaaaacctgtctcccattctatcaaagtcacccgcctgctcactgagataaatgcatatctgattgctttatttggacaggctaatcagaaactcaaaagaatgcaaccattgtgacttggaagcctcctccccacttcgagttgtcccaccttcacctcaagtggtgccccctttctggactgaactaatggacatcctacaaattgattgaggtctcatgtctccctaaaatgtataaaaccaagctgtgcccctatcatctcaggcacatgtcatcagaacctcctgaggttgtgtcacaggcatgtctcctcaaccttggcaaaataaaattcataaattaactgagacctgtcttagatattcagggttcacaaatgctatttatgaaatgcatttatccttcagaattcatgggtgatgggttctaggacctcctgaagataccgaaaattgcaaatgctcaagtccccgatataaaattgcatagtgtttgcatatatcttatgcatatcctgccatatactttaaatcatctgtagattacttataatactgaatacaatataaatgctatgtaaatagttgttatactgtattgtttagggaataatgacaagaaaaatagtctgttcatattcagaccagaaacaatttttttaaaaaaactttttagtatgcagttggttgaatccatgaataaagaatctagagatacagagtgctaactcctttcctacctcaagttcataaagatattctcctatgtttccctagaaaagctttagtgttttatatttcacatttagatctataatccatctggaattgactggtttgtatgttgtgaggcagggatcaaaatttattttttacatagatatttggatgatccggcatgcctattgaaaagtccatcttttctgtaaaagacttttttcccagctgcaccatagtatcactttgtcataaaatgattgaacctgttatatatagctatatgcgatatataaatatatatcaatatatgaaatatatgatatagatacatatatctatacatatcatatatatcatatataatatatgctatatgtatctatatcatatataatatatgctatatgtatctatatcatatatatcatatatgatatgtgctatatgtatctatatcatatagatcgatatgatatatagatatatatctatatcatatagatctatatgatatatagatatacatatatatctatatatcatatatgacatatatacatacataaatgaatttgtttctggattttcaactctgcccctctgttctctttgccggtccttcctcctgaactaaaccatcttaattcccatagctttacagtaagtctagcatactgatagtacaatttctccagatttattttcttcttccagtttgtcctggctattattggcccttttcatttttatatatattttagaatcaatctcttaacttgcaacaaaagtgctgaaatatatgttgcatgatttgatcaacttgaaaaaaacttatatttttacaacattgagtttagcaattaatgaacatggtgtattcctacgcctatttacatcctcttttatttctctcagtaatgctttctaatgacatattttttgctagatttatttctagctaaattgttttaggtgtttttcaattggtttcatttaaaagtttttattttttgcttttcttggaacataaaatgcaattgatcccaaacagtgaccttatatctagagatcttaacctcaattcagttaattctaatggcttgagtgtgtattagttgtctttttgtcactattttcatgtatgctcccaagttatctgaaaatagttaaaattttatatcttccttttcaatccttttgcttttttgtggtttacttatttaaattttaatttaagttctggggtatgtgtgcagaacatgcaagtttgttacataggtatatatgtgccatagtggcttgctgcacctatcaacccgtcgtctaggttttaagtcctgcatgcattaggtatttgtcctaatgctctccctcccttagcccccaacccccgacaggcctggtgtgtgatgttctctttgctgtgtccatgtgttctcattgttcagtctcactcatgagtgagaacacgcagtgtttggttttctgttcctgtgttagtttgctgaggatgatggcttccagcttcatccatgtccctgcaaaggatatgaactcatccttttttatgcctgcatagtattccatgatgtatatgtgccacattttctttatgcagtctatcattgatgggcattggttctaagtctttgctattgtaattagggctgcaataaacatacatgtgcatgtgtctttatagtagaatgatttataatcctttaggtatatacccagtaatgggattgctgggtcaaatggtatttctgattctagatccttgaggaattgccataatgtcttccacaatggttgaactaatttacactcccaccaacagtggaaaagcattcctgtttctccacagcctcaccagcatctgttgtttcctgacgttttaataatcgccattctgactggcatgcgatggtatctcaatgtggttttgatttgcatttctctaatgaccagtgatgatgagctttttttcatatgtttgttggccacataaatgtcttctttggagaagtgtctgctcatatcctttgcccactttttgatggggtggtttcgttcttataaatttgtttaagttccttgtagattctggatattagacctttgttggatggcttgcaaacattttctcccattctttagattgcctgttcactacgatgatagtttcttttgctttgcagaagctctttggtttgattagatcccatttgtcaattttggtttttgttgcaattgcttttggcattttagtcatgaagtgtttgcctatgcctatgttctgaatggtattgcctaggttttcatggttttgagttttacactaagtctttaatccatcttgagttaatttttgtataaggtgtagggaaggggtccagtttctgttttctgtatatggctagccagttttcccagcaccatttataaaatagggaatcctctccccataacttgtttttgtcaggtttgtcaaagatcggttggttgtagatgtatggtgttatttctgaggtctctgttctgttccattggtctatatatctgttttggtaccagtaccctgctgttttggttactgcagccttgtaggatagtttgaagtcatgtagcatgatgcctccagctttgttctttttatgtaggattgtcttggctacgcaggctctttttttggtaccagatgaaatttaaagtagttttttcttttcttctttcttttttaaatcatttttacaggtgttgacttttgcttttttaaaatacctttttgtattggctagtctttctattaaagtaataaacatagttatagcaggtaagtaataactaatttcattggaagtttttcagtattttaccatgaagcatgaagtttgctgtaagaatttcttgaacactctttatctaagaaagttccattccatacctagtttgctacgagttttcatggtaaattgacacagaatcatatgaaatgttttcttttcttatatcacataacttttctcttttcttctgccagtgcatatcaacatccatttatttttcaatgttaaaacacacttgcattcctagaataaatccactttttgtgatgtgttaacttattatcaaatacatttttatacagcagcttactcgtgagcttgacagtcactgggtcaagtattttgctccatattttaacatatattgaattatttttgatatcttaactcttgatgtttttgacattttaagtcttttaagaagtaaaattgaaaaaatctacttattcttcctattgttatggtagacatgctcatgcaggtaatacctcagaagttttccaggcattactgtctggtaatgtgtagataaaacagactgttgtgttcttacactttggataacaggaatttctacaacttctccaggcttcacaaatcagacacacttttttcttaatgcccaagtagcaataatccaagctactatcctacatgtctatgaagtctttaacaagattttcctccaagaatacattttagttggataattttaccttacctagtttttactcattttctcagaatatcactccaaaataaaagctattctttatctttgcataaccaacagttccattaaagtatttttctttaattaaacatgtagtttatccacaaaagggaatccaaacttctcattctgtggaaaatttgaaaaactacagtctagaagattctgttattatattgccattcccatctaggagtgagttctgccatttttatatgttacttattgtgtcttctttatatttacattattttaagtatttttatattatgatactttgtttatattttaaactagaacacaattgacagaaactgcagttaatctaattatggattagacagttgcaggaaacattagtttactctaggaagggaaacacaaattgagttgttgtaaggacacaataggcaaactgagtcatccaaaaatgagaaataaagtagcagcaggtcacagcagaactaactagaactggaaattcaaacacgagtttacagattccaccctgaaaaggcttatctctgttttttcatctaatttctttttagctttataattttgtacatgccctagcatgactacctctctctcccattttggcgtggctttactattcatgtattcattgtttttttaaatattagggagggaagactcttatctttcatttcttatgtacccccatgaagactttcagctgaaataactcatctctcactcgtttttcttttatttttttatttatttcttctaaaaaaaatgggatacatatgcagatgtgcaggtttgttacataggtatacaagtgtcatggtggtatgctgtacctattgacccatcctctaagttccctcccctcaccctccacccctcaacaggccctggtgtgtgtgttcccctctctgtgtccatgtgttttgaatgttcaacctccacttatgagagagcatgcggggtttggttttctgttcctgtgttagtttgctgaggatgatggcttccagcttcattcatgtccctgcaaaggacatgatcttattcctttttatggctgcttagaattccatggtgtatatatgccacacttctttatccagtctatcattgggttggttccgtgtctttgctattgtaaatagtgctgcaataaacatatgtgtgcatgtttctttatagtagaatggtttataatcctttgggtatatactcagttatgggattgctggatcaagtggtaattctggttctagatccttgaggaatcgccatactgtcttccacaatggttgaactaatttacattcccaccaacagtgtaaaagcgttcctatttctccacagcctcgccagcatatattgtttcctgactttttaataattgccattctgactggcatgagatggtatctcactgtggttttgatttgcatttctctgatgatcagtgatattgagctttttttcatatgcttgctggccatgtaaatgtcttcttttagaagtgtctgctcatatccttcacccactttttgatggggttgtttgtctttttcttgtaaatatgttcaagttccttgtaaattctggatattagacctttgtcagatgggtagattgcaaatattttctcccattctgcaggttgcctgttcactctggtgatgatagtttcttttgttgtgcagaagctctttagtttaactagatcccatttgacaattttagcttttgctgcaattgcttttggtgttttcgtcatgaagtctttgcccatgcctatgtcctgagtggtattgcctaggttactctttattgactccacatcttgaaaggagaagggattattttgtttagcgagtttgaaataacttgttgagcatgctctgctagcacctttctcctgactgtgttcagttgtgtctgcctattgaaaggaaagtttcttacctactttcatccacatggatctgccaatgatgtggaaggctaatagggttccacttgtgccagtgcctgggtgaacaagtatgtccaatttaggagtcaattcctaggaagctattaggttttagatctaaaattgtaatctccaatcaggctgttttagtaataaaggtgatattttgaattccatttgcttgctattgcttctttgtctcagttgtttccaaaagaagaaaaagatctattatttagtaatctacatgaaccccacatagagagaaaatagagtacataattccatcatataaaaaataaatttaaaatacatgaagagttaaatgagaaaaataatatttaaatatacaggcatatctcagagatactgtggatttggctccagatcactgaaataaagcaaatatggcaatgaaacaagtcacacaaatttgggggggttcccaatgcataaaaaattatgtttactctaaactgtggtccattaagcatttaaacattatgtctaaaaactgtacatattttaatttaaaaataccttattgttaaaaaatactaatgatcatctgagccttcagtgactcataatctttttttttttggtaaaaggtcttgtttgatgttgatggttgctgtttgatcagggtgtggttgctgaaggttagggtggctgtggcaatttcttaaaataagacgacagtgaagtttgctgcatcaatggattcctcctcgaacaaaagatttctctatagcatgcaacgctatctatctgatagcattttacccatagtagaactttcaaagtttgagtcagtcctctcaaatcctgctgctactttatcaattaagtttatgtttgggtagtattaactggagttaattaaatatggagtgactattatggggaaacactgtcagtttctgtgcagaatcccatgatagacatttctagtagtttcaacaatgtctggggctcctacccttctaggctaatgtgaacgcatttgagcttcatatatcaacgagtccatttcacaaacatgatattcattaaaggaagcaaaaggcagaacacattcagttgattgtatttgtatgcattacatgtagcaaaattataaggaaaataaaagggatgataactattgaaatatttcttaagctaagtggaacatgcataaataatatttaataatgtgctctatacattttatgtatataaaatatagtttcctccaataaaggttatcttattctgaaatcatgggtggtaagtaaagcttgtgaaatatggattataatatgatacctgcagtcatcaccctggcacaactaacacttactggctccatattccttactaggtagaaggcaaatgtctcacttagcatggcatagttcttctacagttagaatcttactttcctttctctactcctcttctcttttcttcttcctgcttacaacacgttcactgagtaaccaatggatcaatctcagttccttgagtgtaattttaaaatatttttacctaaaatactttgttccttaacttctaaccatcctttccaacacagttaaaatattgtctttgtgaaactatttccaattctcatactgtggtatatactttaaggtattctaatgggcttacatatctgtattctccattaaggatagctcatggaaggtagtgccctgtcttatttgtcattgtttccctaatacttagcccagtgtctggcatactaaatgcctaatgttagacaaataaactacttggaagagctgttgaaatgttaaaatgttcaaaaagttgaagggacaatttctgaattaatgacacaatgaacagtatcaaaattcagagaatgtcactgtggatgagagtgatctggaaagattccatcaaagctggtggctctgaggtaggtctaacaggatgggtaagatttgcagtaattgaggagagtggtgagcttcccaagctaaccagttatgagagcaaagggttggagaaagggaagactttcttcattctgcagatctccatgcatatgcaacctcttttaggaagctagtgtccttattctgtcttccgtagactgttcacatttcctcagtgtttctggtgatttctctagaatcaaagactgtgttagggcttcaggtccatgagaaatgaagagagaatgggataatactgtagatgaagctaagcaaggatactggtctcagttagaaggtggcttcagcctgatcccacaggatcaggagtgtcagtcacaccgagttgatcccaccttgaggaaaatgcagtcgtttatacccccagattagccagttattaactacaggctgtctcgaggggagggtgccaatctcctgggcaagagaactcccatttggatgaaggcaattctctaaggagggaccagctgggaactatgagcatgctcaacatgggtgaacttgcctgctaaggtggatctgagcaaggcattaccaaaaaatctgctcagttaccctagagtgattatacatttttgtccacgcttctgctttgatgctactctgtgtcatgctgttgtatcaccatccccatcttctgggctatttattctgtttttgtcaggcagtattgctttcaaattgatcctgatcttctgaacaccactaaatctcctggttattggcactacttcttggcactatggccatttctattggataccaccttttatttattaccaggaaacatcagctcctgctgctgattctgcagctttccgggtgtcaagttctattcagggtcaaagcctgggagagtgctccttgtattgtgttgcattgtatttgttaaatgaatgctcaaaggcagggaagaatgtaccccaatgcttttgagagttaatagtataggtactctttcacttgctacttagagcactaccctaccaaatgctactcagacttccctttctccagtgactaatgctttgttattgaaacactatgatcttctcaactttctgctccctttgggtgcaccccctcctcactggtctctcaatctctcctgcaaatggacttttggtaggtctgtgccatcaaagctttaggctgccgaaacgtctgaattccagtagtggcaaaaccataaccccagctacatgtgcaaaactctgattaagactaaattatttagataatagaaattgtagttaattcaatatgcagtgacaattgtggggaaaacactgtgttatgttctgtgcagaatcccatgatagacatttctaacatttttatcaatgtctggggctcctatccttctaggcaaatggaaaacagccactgagctgtgagtggaaatgacttatgggatgaagcatttaattaccagtgtcatttctagattgaaatgtttaattgctcatatgagattcccttgtgctctcatgcccttgctgtagcaagtatggagaaatcctgtggacatatggtggaaccaatggttgagcagtcttcattgcgtgaaagagtttctctcgagtttctcagacccacagtggatgttgcataaataagagaaatgagaaatactgtttttctgagttaagccattaagatttggaatctgtgtaagtatagcataagctgtactaacctatcttcactaatgaaaacaaccctgttcttttccctcctgttacccattctactaaatagtatggtctccataatgaagaattttggcgaaggctacaaattagaaaactttatagtaatgagtactcactttccctgccctcttttgactcattgtatctcctggcatgttattaagaaatctctatgtttaaatagaatggtttggcaaaaatttactgaacataaatagattgcagttggttaatttgctacagttgttaaaataatacctgagttacaaaataatttgcctgcataatgtaagaagtgagtgatcatgtaggttgcaagaccctagaaagccaaacctttcaaattctattttttaaatgaagttggtcagaagtatgctttcaataaaagtgttcattttggaaagtctggtaactaatgctaagagttatataaatatatagtaaaatatgtttcctcactggaatcttccaaaataaataaatctaagaaatacctttgtttatactgttcttggtgagctgtactgaaataaaaagaaagatggaatatgagatatttatgtaacaaaataagacttatggaatattattactgtcaagataatgaatatttcaatataaaaagtctctgtatggtatgtgtgatatggcatttaatatttatctaaacacatctattttttagaaaatacataaaactccatagacagtgaaatttgctgctttcaaccaatggctaaaatttgcatctgtcttatgttggtgaattaatctactccgaattttctcatatgaaaaaaattaaatcataatatatatatgataatttatatgatgaaagagaattgataaacagcttcagagaaagatgtatgatatcccaaaatcagatagagcttacactgttggccaggaattagcagttgtttggaatatttcttccctgtaagcacctcacgacatcaaattgtagactggcttttctattacagtcagagaagacccttcatgcggcatttctatagagagaaatttcactgtggtggcaaactcatctatttatttaacactggtatttcagccatctgacaaatggccttttatccaaaaacaaagacaatgaaacaccctttttcatgaccactattaataattgtagaattttggtgtttaaatgcagtattaaaaaatatgtacataacaacaactaaatatttactgaacatgaattatgtgtcaggcattatgttctgtatgaattattttatgtaattctcaaaaccctcccttaagttaggtactattattagttccattttacaaagcagaaagcaccgatagactaagtaacttattcaaaggcataaatttagtcattaattatacatgaattgaacaaagatttgtctggcactaaggttacagaaatgggtaaaacatgagcccagtccctgtggaacttagtgggagacatagacatgtaaatggcaatttaaaaggacatgaaaagaaccacacactcgaaacaggaactgtaatttgagaaatagaaaataacatttgagctgaaagtaagatttcagcagaaaaaaggggaaggtcattcccgacatcatatcctgcatgtttagcaatagagaggtatgaagggccacggagtttgggaaatgctgatgagtgtgtatggctggaatggaatgtgtgaggagaaataagagaaactctgtggctcaattcacagagccaaaatcattcggttaatctttgcttcaaacacttttaccatttacttacctccttttctttcctcctctttatgtgtttactatttccacaatagtgcttacgtaaatattttttaaagtataggatgctcaagatgacatatatgaggaaatactatataatagattcaggcacgtaaagaagtgagaaaagagataatattcctttaattagaccaaaagtagtttctaaaattaaatatctaaaaaatccctgaacattccggatgatataggaaagcaagaaaaaagattgcacacacaatttaaaattctgatttctgagtatcaagcctacttgtgaggttggacaatccctaaggttatctagggcatttgaaatataccacaactcctggggaaacccctatagaaaagcaaatttgttttagaaaacaaaaacaaaaaccaaccaggactctctcagtttatgtttaaatatgctaaagtaattcatttcagaagacagtgtgccaaaaaattaagtaaaataaaataaaaaagaaaattctaagattatctagagcaatatagagtaattcaggaaaacatacatgcgtttactacaaatgagaaacgcataaagcgtaagtcatgaagggtgttttctaccaaaattatgattattatctatcaaaataataatttctaggaaaataatgataaaacaaacgttaattatttctagccctttctagcaagacaagaacctgctatagaagtaaggaggccaaacatgaaagaaaccatgtatagtgcaacaggtgaaggcctgcaggtatattaaaagtaaatgcttgttttacttttttacccttcaagaacagagctattttgggaaacgtgtctgacataatagtatgtggtggcaaagactgatgaaataatttgtgcatgaaaataataataaacagcatgagttagaaagttatgaatgcagatatatgtcatatatctgtgtcatatatataaaacacatgacacacaaaatttatacagagaccccaatgcatatagtttcacagaatataatatagatggaaaagagagaagaagcaaagaagaaggcagaagagatgtggcagaacttttttccaaaaatggccacaatatttccatcctatatgttttttgatatgccttccattgagagatggggtccactcaatattttcccctttaatttatgtctataactatgtaaataacatgactgtgtcaaattctattgaagagaaatatcccaaggagaaatatgatgtgtcgatggttaaaagaattcgtctgatttttgagggtaggtaatgagaaatgaaagtttccatctcgttctctttggatactctgctttggggctctgagccatgatgtaagatgtttgaggccgccatctggtaagcccaggccatatgtagattatgtgaccaacagctccagctgaggatcctgccaacagctagcatgcatccaggtgattcccactcccagcctttaagtccttccagctgaggcctcagatatcatggagcagagacaaatgtggacacatacctctcatgagtaagtaatgatgtttatttaagaatgaaataaaaatactatttttccttttaatttatgtgtattgtattttcatgagactactactgtaagttgttgagacataactacttattagttgattggacataataaacaaaacaattaggtatttcatggagcctagggacacagacagtgaaaagaattacagagacactaagggcaccatgaataaagaaggtttgggctccctgaattaactcatttaattttcatatcaaccgaacaggtgattccattctcatttccattttataggaagtgaggcatagagaggtttacactatctcacactgctaaagagtattatgcagggtttgaacccagtcaatctgacgccagagcccacaccccaaaccagtacaactactgcttctatgtctacagccatgtaattaacataacagtgtcaaacaaactccattaaagagaaatatcccaaggagaaataatttcaatcagaatattataagaagtatatgttcaagctggaaaaggaagaaattttgtgaatcattgtacaaggagaaacctaaagccctggtgagcctcaaagacaaacacgtttagtcatgggcagagtcagtataagaacctatttctccctgcttccaattctgatatacctgccttctaactgaagaagttctgtccaggagtggcaatcaaaaaataggatatgcagatactcataatgctataaaaggacatagaaaaataaacacctgaatgtgaagtatagcgacatggcagttattcttgtagctgacaagaatcaatagattaaaaatcagttgtttttctgctgaactcaggggttttgcagtgtttattctagtcacaaagtagagcaactgctttgattggacagtcaaataattctcattaaaagtctctaatttgagttctctgcttccacaatctgtaaaatactttcttcttttgtcctccctagcagacgatataatactcatttcttttcttgttacctggcttcctcaccagctagacgtttctaaacggctgggaccatgccttttgcctcagtcaggatctctagtgtcagtcaagaacagtgcctagtatgtactaggtgcttaagagatgcttgctaagtgagtctgtaacaaatgtatgttggcaggaagctatatgtgagctatcatataatttatttaatcagcctaaatacagacttacctccaatgtctctgtacagaaacacctgatttcaactttacagaagcaagaaataaatatctgttatgttaagtcacagagattgtgaagtttatctgttataaaggcttctattaccttaggctaaaatgacctctgttttcaacaaaacttaatcaagagtcaggcctcatcttacacattcaagctcacttgcaaccattatccagatgcaggtcacacaccaggtccaacatgatcctaaacaaatggtagtttttcggtactttgtgattcatttacttcatttatatcagcctcacatattgctttatgaaaatgattcaacagacttgcagtctgatctgaaagtattttatgagacactaagcacaaggagaagcacacatgtcttctgagtgctctgataactcaagatgattattctcacctctttacctttgctcataatgttcatgttgcttgggatattcattttctttctttttaacaataccaaactgtttcttgatttcctagcttacactccactttgttgcactttgtctaaaagtttcagaccctcccaccactttttttttttaacttaaatagcatgagaactctggactataccatttgactcatgactattctgtcttgcttcacatcttatttgtttgtctggattccccagcaggacactaacgtcctttactgaagaaaccagtcattacagtatcacgaggtctaatttggtcctaaacaaatgatagtctttcagtattttatgattctgttacttcattgataccagccttacatacttcttaatgaaaactgattcaacagacttcaaatctgatctgatagtagtatttcatgaggctctaagtacaagcaaaagttggtaatactaaagaggaaggagggctcatttattggaaaacatgtatgttagaccatacattgtagcagaggaagaaaagcagtatgagtgggtggaaggttagctgtagttcatggtcaaatgtggaaaggtcagtagttacaaggaaataaaagagtcaaaagaccagcgcaaaaggagctgaagcttggattacattgagttaagctgtttgtgtcccactgatgcccatttgaacactcataggctttattctttctatttcagtattagagaattatatggtagtagcttcttatatggtagatcttcccttaggttcgctataattgcagttttggcattaaggccaatattggcggtgacactgatgaatttggattatcctgagattatgagatatgtatgggtttgggcatatttgcagtatggtaacgtcatcaaaggatacagtttatgtttcttagcaacctagaatcgatcagcatcttgatgcaattttatgtggctctttaattgctgattttgtagtgttcgaaccttctaatgatgtaacagctgaaagaggatgtgcaaaaaggcattgtaaaaaaaaactttttggctgctttttgttgggcaccaaggaaacattttggctgtatctttccatctaagtgaaaagaactaaagaaatgttctttcttctccatgcagtgtaactaaattgtctgggaaaaaatcagcattcacatgtcttggacaagtgagaagagtgctgtttaccatcttgcatcattagatatgacacttttatcatgctctgaaaagatataaaataggtcattggaataaggacacagtatggaaaatagatgaaatcagataataaattgcaaatctgttaagccacgctccatttttatccttctcttttttctttttgtcttcccctgtggcgtggaagagatacttcccttcacgtcctgccttttgcttcaccctagacagatgctctcccagaatccaagataatacatgtttgtccacatggtagactgcactagccttctccaatgtaggataaatgtgcccgtatgctacaaggaaacagaattattgaatctgctcttggcaaactaacactttttttttttttttttttttgagacagagtctcactctgtcactcgggctggaatgtagtggtgcgatctccgcttactgcaagctctgcctcccgggttcacgccattctcctgactcagacccctgagtagctgggactacaggccactgccaccatgcccggctaatttttttgtatttttagtagagatggggtttcaccgtgttagccaggatggtctcgatctcctgacctcgtgatccacctgccttggcctcccaaagtgctgagattacaggcgtgagccaccgtgcctggccaaactaatactttttattgtgtgccataggtcccataatgccatttgatattaaccatctccagtaacatcaatagttgcaggaaatcagtagaaaggaaggactattgagagaacaatttggccatctctttgcttccaggtatatttgtatcacactgcaaagcaaaaataggctaaatgttgaaataccgatgtggaaaactatctttaaaatgcaaataaaatttggaagttttattccatcgtttgggctattttcacttgctctgtccttgagggcagcacagcaacatggtcacccttctttgaataaagaccaaattgttttaatggatcttcatctcatagaagaggtaaaatggcagagatgcttctgtggtttgagtatttgtcccctctaaaactcatgttgaaacttaatcccagatgtggcagtattgagaggtgaggcctttaagaggtgattgggtcatgagggctctgacctcgtgaatggactaatccactcatgcattaatggtttaggaggttaacggattaaacagttattgtgggaatgggactggtgcctttataagaagaggagagaactgatctggcacctcagccccctcgccgtgtgatgccctgcactgcctcaggactctgcagggaatccccaccagcaagaagaccctcaccagatgtggccccttgaccttgggatttctcagcctccataactataaaaatattttcttgataagttacccagtatcaggtgttctgttacaaggaacagaaaacgggctgagagacatgcccagtgaggatggtggctaggaagtgaatgacacagttgctttctgcctgctgctttcttgaacagggagacacttgtctaagtgatctgcattagaggagtgcagatcacaaacaaagacggatttatgtgagtaaagaattatatataccctaaagcaatgtcattatggcaattatatttaaggattttggtaaagtcttcagaggagtataaactattaaaaaaaaggaaacagctgttagaggggtttatatcttaaaataacaaaggtacttgcatgtgtgaagaatgccaacatcttaaaaacatcttcaatataattgatattgatgacttttgttttcacttcccaaccacctctaaatagtttcagtacttctgaaactttattttatgtttttaagtgtttttttttttataagtcttcccagtttggtctactatattaagctcaattgtgaagttattaagctcttggaatgggcctaaactacgaaaatttgaacaacacctagaagaaattaatagtcccataaacattttgccttaaagtaaaagatggttccaagatgtccaacctgggaagaaagatgataaaagtgactgaaataggataaatagaaaaaaaattaataggagaaaaaataattattttagcttgtggataaatatctgttataggacttctacctgtgaatgtttaatggcagttggaagaatagatttggacacgcaagagttaggagtagagatgccagtttaataggcatctacattctcttgaaggttcgtaataggtaagtttactgtgatctttctctctcattccctagcctctactcagctttgctgaatcaatttcttctcccgaaattttgatattttttctttctaatatgctacattatacttttgcatgcagcatgaggggttagggtcagggagagagaaaatgaagagatttctgtttatttctgttactcagctaagtatcagaaacaccacagggggttaaaaaggatgtctacggaggtgcttgcctgagaagtcaccagaggaattgtgtgcaaacacagaaaccctttggtaacatgagctgtgtttccttgttaaattgaccctgctgtctgacaccctctgttgctactgttacatcacagctaggtcaacatccagattcctttaccaactatgtgagaatctactaaaagcattctctaataatacagtcagccctgggaaagacatctgagctttaattaagcaatgtatgtgggggaaaatttctggtatcttgtttaatagacaggtgtaacatattcctctctccaaatatgcttttagatgacatggggtaggtttagagagatttataacaaaatgaaactgatgtggcagtagaatttgttagcccattcttttatgtttctcagcagagatctttacgtggtaaaatgtcagattagggctcagcgtaatgatttttggaacatgataatgttatttcagaacacttcatttagaaaaatatctttgttcgaatacttcctgatattaatttaatttgctttggtgctcgtgggttataggaagtgtagctgcacacttctttgcacttgcctcacaaaacttccaacagaaaccaaccaacacacatctcattaatcttcttaacactaagcagaaaagaccaaattgaaaatacggcgatctttccatgaatgcacatcaggactggtttgtttatctctgagcaggcatgtgtgatgaaaacagtatgtcattatgtagcttcctaagtggagagctggaactttgtgaagaacaaggagcctgccgtgaggttggaagtttttacttctttgcgctatcatttctattgctttgactgtggtatcttccaagtgtcaggagttacttcttccctaaaagaactctggttgggctgggaatatcggctcatgcccagcaccttggaaggctgaggtgagagactcagttgaggccaggagttcaagaccagcctgggcaacatagtgagacaccatctctataaaacaaaacaaaacaaaaacaaaaacaaagatccctcaggcagtttgttgagaataaagcatgtcttaagccacatgcctttatttttttacccttgctctgtctcgttaaactgttctctcaaaaaaattcatcatctgaagtttaatattttttatgcttcattccacaacttcttagtgagtttctaaaattaatacaaacaacaaaaacctatgtcacgaatggaacacaagcaaataaggctcagacatttaaaagccgatggcaatgtacatcaggataagattatgttaaaataaggattgtagactctgtgtgatagtcttcgtgcttgattttgtgctgattgtaggatataagtataaagataataatccaaattaaagtgcccatctactgtaacacaagctattatctctatatgatatccaacacacgacagatatttgataacttatgacaataaatatcctaagttcttacagccatatgaagcacctagaattaccaactatgaagctgttagccatttacacttgtatattaagttaaatatttattaggattagaagtcaaatagagggctagtagaatattggaaagtgtgttttccctttgagtgtaaagctccatttgggatggagtgttgagtggtaaagtcttttcagcatgctttctgaaagttttctctttactctcattttcacctgggtaaaaagaatgtaggaatgattaacagggtggttaatgtgtagcagctgagacaaggttctacagatatagtgtgtagtctggtaggaagaaccatgtccccctccacccactttgttcacctcccaatccatggaaactatgaatatattactttagatggcaaaagggactttgcagaggtgattaaattaagaaccttgaagtgagaggattagactagaatatccaggtgggaccaatctagtcaccccagtctttaaaagcagagaaactttgccagctatggccaatgagtgctatgtcgatgggaaagtcagtaggatgcgacttgagcgtggaaaggggccacgggccgaggaatgcgggcagcctgcagaagctgaaagctggaaaatgcaaggaatggagtattggtgagttgaaattggcttaataattccctaatactaatgtgcacaacaaactcatggactgcttgtttaagatgcatatttccaggccccatcccaggcattctgattcattcaatctagtgtgaggcattaaaatctgtaatttaactccatttcaacaagtgatcaagataggctttgaagtccatttttgtttgatcttattaaaagtaagttgccatatttaacatttaacagtcttattttctatttttgtatttcagaatcagggaaaagtcctctctccctctcacacgcacatgctcacaggcacacatgcactcacacacacacatacacgttctctcacacacacacacaattactcttgactgctttctgttagttggcatgatgtcatctctctagagagtcataaattttggacctcaatgtttgaaaactgaatcgggaatacatgattagaaagatcaacaatgtcttctcccaggacattcccatatgtatttgtttaatctgtgttttctatgctggactgtaagcccatcagagtgaatcaaacaggtacatcagtctcattagcagcttcaccagctaatgaatgtcagacaccattaaccaagaaatactttctattgaggaaaatggaaactacatgagggtagtttgttgtaggggagatgcaaggcagggatagattggggaaatatgacccagaagaaatgaaatcactaccttgtaaagatacctgcactctcatgtttattacagcattagccacaataatcaagatatagaaacaacctgggtgtctatcgccaaatgaatggataaactgtggtgtgtatatacatgtatacatacacaatggaatattattccacctttaaaagggagatcctgtcatttgccataacatgaatgtacctggaaaacatattaaatgaaataagccagacagaaaagaaaaatattgcgtgatcttagttatacatggaataaaaaaggtcaatgatacagataaagaataaaacaatggttaccagggcaaggtgggaaggaggaaatggggagatataggtcaaaggatacaagatagaagatatgtagcatgaacaagcctaaaaatctaaggtataacatgaggactatagttaataatagtatatggcattcattatttttgctaaatgagagattatagctgttcttgccatagacaaaaaaaaaagagtaactatgtcaggtgatggatacgttaatttgtttcactataataaccattctactatatatgtatctcaatgctatcttgcataatttaaatatacaaaatacacaaatttaaatatacaaaatacaaaatttttaaaattttattttaaaaatgaaatgattggaaagatatttaggaattaaaatcagcagatttgccaatctaatgaaggattacagaaaactattctcaatctgtaaactaggttgttggatggagatgatacctgcaaacaaggaagaagcacatcaggtggaaggctaattttgtggattatgtgtttgaaaggcctgtgggaggtgataagcagggagtaattgcagatgtatttaaatctaaaatgctgcagtgtgatagcaaaacagtggcccccaacgataactatgctgtaattctaagaacttgtgaatgttatcttacatggcaaaaggtactttgcatatgtcattaaggttaagaacctacagatggggagagtagctgggattacccaggtaggcccaatctaatcatatgagtcctttaaaggaaagagttagccagctgaagagaatcagacatggcagcagcattgagaaggtggggcccttctgttgctggctttgaagatggagaaaggcagccccgagccaagaaatgcaggcagcctctagaataggctggaaaaggcaagaaaatagatttgctcacagagtctccacaaggaacccaggcctgctgaccaccttgacttttggcctggtgaaacagattttagactcctcaccttcaaaactataataaagtcatgccattttaagcaccaagtttatgataatttgttatagcagcaatagaaaacaaatataccaacatccttcctgccacccccaccaaaagaaaccgaaatgtatgagacttattgacacagctctcttgggccaggttttctggagccaagaaaggaggaaactcttctcattaattccctttgtgggacattttcttaattgttggtctgggttttcactgacagaaagctgcagagtgaactgttggggaagtattctttggtgcacacagaaaatcaagacacatttatattcagtcaatgacagagtgaaaaccagacttcaagagagaaatccacactctctgagccagttcccattctcaatatgtagcagtttcaatttgccccatcactagtgaaactcatctgagggcttcctgagaagtcaggtgagctgcatctatgaggagtctgaccccggcagatctgtgagcatggacatgtttagaagcaatgttctaggctgcatagtttttttttttttttttcctatctctcttccttgttcaacattacaatccactctcaagtgtgtatggagaatcggaaaagggcctgtctggccactgtgggaaaaaaaaacaaaaagagtaccaggcgagaccacagtgatggtacttgagatgggcacaagctgagaacgtgcatctagtgaagtggcctgatgtttaaccttgtggttaaaagggggttatgggcttttgggtggataacaatctttccttaaataccaaggagagtgcatcctgtcagcataccttgtcactgctgatattaccgtggattgcctggctgcaacatcgttgtccattttctccactgtaaagttactctttttcaatctttccacgttatactctttaaaaggaagccactatgtacagcctgcatggaaggagtggggagttatgttctgacttcttgaatgtagagtatctacacaagttatttggaatttttctacatgggatgtttgtctattctcttccatttattcaattatttttagtatatggactgcgtgtttacttacactttggtttaccatttgttactatattttgctgctcaaattgttctagctttggccattgcgtgttgtttcagttggcacctatgtccttttgacataccatcatcaatgtgttttgtatatttcaagcacttctttaacttctggtactacaaaatgctccaggctcatcttataaatttcctgctgtgttactgaaatcagtcactctttctttccaagaaattctggttacttttgttggtgaacagtattagaaatcaagatctgggttagatgtactcattgctactagggaattgttgcttctaaggcctcctcagctagcagagtaataaaatatgagtatactaacttgtgtatatatatacttaaatatttcatgtgtaactatatttgtctagattaggcagaaaatgagaccatacagatgcctacaactccagtccattaccacatggatcattctacgttcctgcccttccctatctctaacctcagactcgaatattgacaaacttggctcccactgctcaccatccattttactgaactgttcaattcacgtatacttatatagaggtttcagatttattactcatacccccaagaaaaacgactttatcaactcactttatcaactacagcacagtgcttgcgttgaggtctgttaaccttattcttgcacatcttatttccaaggttaattaggtcagcactttaccccgactcctttcaacaaggctgtttcacacatttgtaatacagttagattcttctgtcataatcttcatttgatcatgtgatcccacaactatttaagtgatttaaaaaaatacatatatttaatggtgagtttttttctgctataaagttctgtgggtacagtgtcatagagccatcattttagttccatatatgatggtttatccacccccaaaactcctgtttcacctatgtaaccactctttagtccctagcaccactgatctattatctttataatttttcttccataatatcatatgaatggaattatataatatgtagcattttcagactggttgctttcacttaacagtacgtatttaagatttccatgcctctgcatagcttgatagctcatttcttaaaatcattgaatagtatcctattgagtgggtgtaccacttctggtttatccatttacatttacttattgaaggacatttgtattgtttcccattgttttgcaattacaaataaagctgcagtagaaattcatgtgcaagtatttgtgtggacataaatcttcagataagttagggaaatagtaggaacttgattgttggattgtatggtgaaaccatgttaaactttgtaagaaacttcaaaactgtcttgcaaattggccatattattttgtgtatctgccagcaatgattgagagttcttgtcgctttgcatctttgccagcaattggtattgtcaggacatcataattttagttcagggagacttatataatacttctcatgtaaagaaccataagataataaatttgcattgtcttaaacacaatatgtatactcatttgttatagaagcaatggaaatccaatacatgtacacagagtttcttttaaagaatatggaaatgtttgtgtttatcttctggtccacatccaattatgtcttccttaggggctgaatgccataatttcatcaataacttacaaacctatttgtgagcagaagagataataatattattgtatttcttctctcactttgtaagaaagcaccagctagtaatatgccattatgagacattagtttccaaattccccagctacctacctataatataaataaatcttaataactactgattttaaaaatctactttgaagctcaagaaaatattatcaaaaatgtttatgtagcaagttaaatgtaactttgttttttcttttccaatttctttttaaaatgtctcttcgcttagtctcatttataggacttccttgacactttcagttctttgaactacaccttttgttaattttttagatttattaagattttagggaaaaataaagaaaattcaagagtgaaaaactcagttattttgagaaatattttttatgactaatataacagtgcagaactaaaaatgtcatctataaacattggtttccgtagatctgttcctctaagcaatttcttactgctttttgcttttcttttaatacatttcctgtttctagtctataatttctgcttaattctttcctatattgggccgtcaactcattctgtcatctgctttatttccctctacattaaacaatcacttccagagtactttcattcaatatttatacaaaaggggggttttaattgaaattcattagaaaaaaagctaattactaactttttaaagaatagattctttttcaccctccattgagagatatgttacaagcaatgtgctaaaactatattagcatgattttaacacatgaattccctgattcccaatcctttcacagttctcctttatatcaagatttcataagcattatacattaaaaaaacagtgagaagtacgtaatagagtatacctaccaatatttagtatattggagaaaagcaggaatacaaacatcctataaatggcaacatatctgatcatgagatgactggaataaataaaagcacaatttatacttaatttatactcacctgagatgtagaacagttaatgcttagtctttgatcgcagcagaacatacagatgatttctgctaacatcaaagatgaaaagagcattaattgttctacttttcagttgaacatattatcaactacagcaagacatgatattctttactttagaactttacagtctaaagggagaatgacaaatataaatgtaactataaggtaaaatatgatcactatcataaaataaagggtttgatgacctcaaaggaaagagaaagtgtgtctccttgagggaaccaggctaagtctcaaggaggagagaccatttgggttggactgattaaaaagttgacaagaagaagggaacatgctgagcaaagctagagcggggaggtaatagtgatagttaagaaacatgaactaatccagcacaggtttggggtaggtcaggagtaagcaataagtaaaaaatttggctagatctatatttattgaagtccttaaaaatagccaccaaagacttttgattattttaacaaagctatctaaggcaaattggatgaaatattaacatgattgggttaagaggtcatctcagttgtctctctaggtctagatttcaaacgatagtgtgcatacttgtctctggagcaaataaaaaagccaatgactgtgactaggcccaacccttgattatgattcacttcataagctatggggcccagaaatccatattttttatcaggtgactctgtgcacattagtttgaagtttgagtgtctaagtgaaaggagaaagcctgaccttgagtgtgtcagaagaaatggctaataggttataggtgagatcaacctggcactctgactgtaaaacctgaatttttatacatgactcagtttcagttctgaggcttattttactgaagcatcaaaaacaatcaacgtttcttaaactatacagtgctaattctcagaattgcttcctgaaggtgactgtaaaactgagcactaccttaacatacatggtttgtggttggatctaacaggttgggactaaattgagactgcttcttatcctcctaatgtcttaaaagcctggttgggctgctaagagagattacaggaaaagaatacagatgagtttgaattctcccagggcagggatattaactaatttgtctcttgtaacagggtcaatgtttgtggaatgaataaatgagtgagtgaatgaataaacaggaaatgtggttgacttttgatgaaagtttataggacagtcgttcaaacactatcagaaaatctaatgtcaccaatgtcctataaaatattgttccaggaaggcgctatgactttctaccacaactggaagcaaatgtaacacaaaaagcaaaaacctccttattctttgttggcctatatctcctatcccaaaaaatacttcctttttccttggaaaattctggcaaagatgtcatgaagctcccccttagaagagagcctcaaggcaatacagtttgctacaaggcaaactttatttgctcctaagaattgtagctgcaataaactctgcatgaacagtatttacaaatattccatcacttagtggaaaaaaatcttgggtgctgctaagaatgtgtctggctggacaatgttaaattttggaaaacaactattttctaggctgtttactagaatataactatcatcaaaatatattcatggagcattttttttaaaacagtgagaatgcctgtagttcagtagctactgaagtaatctctcctgtgaaaaggaggaggccagcaataaagaacagcatctctacatttatacccatacagtattatttctaatatgttcgacttgaattctcacttagataaatagattccatatgaacctaattaactggcgtttcagtttccaaaatgttatgtaaaatgtagtgttttaaattgaaaaaatgcagatgggaatcttgaaggtgtttgatttatagctgatgcaacagttcctttttctgttacagcagaatactaacattatgcttagatgatttaaagtagatgctgtttattttatttgactttcactaggattataaagatgacagtgctctactacagaagagattttcttattctaacagacaaatgcatttctagccattatatcacggcatacattttcacaatgtaaatagctatttaatggaaatgatgaggccactaatgtagacaaagtagctattgtctgagagcccctgagtcatcttgtgtcacagaaaatatagttattagttttaatcataaccctatggcattttagaaaccttagtatctaacttcaatatatagagatatataattaggaaaatacttagacttaaattccacattgactggcattataaactttgctttctagtaataattagatggctgatcagaaactatgtattacatggccttccttatgaaatgaggcagcttttaaaattatgtatcataggccagctgcagtggcttatgcctgtaatcccagcactttgggaggacgaggctggtggatcacctgaggtcaggagtttgagaccagcctcgccaataggatgacaccctgtctctactaaaaatacaaaaattagctgcgtgtggtggcatgcagctgtagtcccagctactctggaggctgaagcaggagaattgcttgaacctgggaggcagaggttgcagtgagccgaaattgtgccattgcactccagcctaggtgacagagtgagactccatctcaaaaaaaaaaaaaaaaatgcatcatatactattttaacaatggtcaattatcacagtcaattccatttaaaagtaatttttgatgcaaaaatatgtcatatcgaactattttcctaatgggttacaatattgacattatattcttaggctcttgcaaattataattaaaggtatattctatctggaaaatgaatgtgtcagtgatttctttcttttttttttttagataactgtgtttgccatatgtttatcatctaggcatatgctgaactgttgtgtatgttcaataaataataagaatatgaatgtattttagatttgcttagaaatataatcaacataggctgggtgcagtggctcacacctgtgatcctagcactttgggaggctgaggcaggcagatcacctgaggacaggagttcgagaccagcctggccaacacggtgacaccacgtctctactaaaaatacaaaaattagccaggtgtggtggcatgcatcttagtcccagctactcaggaggctgaggcaggagaactgcttgaacctgggaggtggaggttacattgagccgagattgtgccattgcactccagcctgggcgagagaatgacagtctgtctcaaaaaaattatgcatcatataccattttaacagtggtcaattaccacagtcaattccatttaaaagaaatttctgatgcaaacatatttcataaaattaaccatatggcattttagaaaccttagtatcaatttttttactgcctgatgggttacaatattgacattatattcttaggttcttgcaaattataattaaaggtatattctatctggaaaatgaatgtgttagtgatttctttctttctttctttctttctttctttctttcttttagaaccatgtttgccatatgtttatcatctaggcatatgttgaactattgtgtatgtttaataaatacttaataagaatatgaatgtatttattagatttgtttagaactgtactcagaataggctgggtacagtggctcatgcctgtgatcctagcactttgggaggccgaagcaggcagatcacctgaggtcaggagtttgaggccagcctggccaacatggtaaaacccccacctctagtgaaaatacaaaaattagcctggcttcatggtgggcacctgtaatcccagatactagggaggctggggcaggagaattgcttgaatccaggaggtgaaggttgcagtgagctgagatcgcgccactgcattccagcctgggtgacagagtgagactctgtctcaaaaaaaaaaaaaaaaaaaaaaaaaaaggaaatgttttcagaatacactggaattttggaagacagacaaaatgaatataagcataaaattagattaaatactggcagctaactgcaggccccagtcctgtaactaaagctaagaagacccctccttgccccaacaaaaaagaagtgtgttttcactttcactttcacattcttcacaatgttcaatataaacactgaagttatattgagtagcaacttttatttgacatttaattttttgttttatcatgaattttctaatttcagttgagttttttgctatttattggcttagaagtgttttggctttcatatgctagacaatactttgagtaaatacagtgaaggactgtgagaaagttaaatttgtggcacttttcatctaaaacaagaaaaaatggaaattcccaaagaaagatgagtaactctttaagccatttctgctgaatggatgtttcatactaatgttatggggaagtattaaaatactgtaaaaggaactaatccaagtattagtgtcttagaagaaaagccactgggtgcttaaaacatgggtggagatttcttagtgtgtattgattgtttatgaaatgtcaaaatactactaaagtgtatgagaagaaaataaaagctactagcatttgaggacacatttacatgacagatcttacgagcgtatttcctggaaatgtttcactgattgatttcatcactcatttatttattgcaacacttattcaatactttacataagttaaattgaggagattcaaagaggagctttgttctttggcctaatggaaccaatacagtgcttccttgtgccccagtgcttcagagttattagtgaacatagttccttccatttgtactttagcccctctcttaattttcagaaatgaatccaggcagtaaacaaggctgactaacagatagcaggatgcactcacaattgagatactgttattgagccaatttccctgtctgacacacccttctcttagaaggatgtctttctgtggctcctacatgaaacaagtaaaatgattcccaacaggctcttctaccagggtacaaatcacacccaaacatgatggcattgggcaaagcttaggctccaacagagattttctattaaagttagattgagttcaggttgggaagcatatcctctgtcaagccaaggagtggcttggattttatctcgtaggaaataggaataggttctttggaaaaactgaaggatgaataggacttgggtggataattgaatgggttcttgggtgaatgaactgattgaaacgtgattatggaaaaatgtagcattaaatatgtgcttttcctgagaaattttaaattggtttaaaattagctaagcaatgaccttggaataatggagcttagttcaaagctacaattcacaattgttgtcaactcttcactttaaaaagtgaatattgttcagatgtgcaaaagggttacacaagagtcccaaagaagtcacaggccagaagtgtagctgatgggtgataggaaaaccaggtctgtagaaaaatctccctgttcattaccatcctcctgagtttctccttccaacatccttatgttctacttgcgtattcttatcattttgcaacctctttacttctgggcaaataggaaaacaggcagctttatctttggagttgactctgaggaaaattcttctggtgtcaaaggaatgatttggattaaaaatctgaggctgaaacaattttaatgtttatttaaaatgaacttttccactaaacctgtctcatcagataacaacactaaatatcatagcttacacacacaaattttatttggccacaggaagaaaatagggaatagaattcagtaatcagaatataccacactgatgatactatcttattaccatcagtaataaaatcaaaatattactcattcttcttcctcagaattcactcacagggtttgcatagatcctatgagtcatggtagcatcttcagccctgggaaactgccctctcttttttggctccacctccaccaccccaaaaaccacacggagagatggagaagggcttgattaagaagctgcgaagttgccttaacattgttgttttcaaactcacactgcagacacaatgctttgcgaacttaagataatcatatttcagatagagataccagaggccgtttctccagcaggttcctgcagtggtttttatgtcttgaaattccaattcaagattggtttgagccctggaaactgagatattagaacaatcagattatctcatcaaaacagattgagcatacttttataactcacactgatcttggctacaaaaggattttggtagatgattaaactttagaaagtgaaagtaatatttagtttgatctttatatgaggcaataattctatcaattataaggatatttcttctgaaattttcactttatctttagtacctatttttccccagtatttttacccatatttccctaaaattgagatacctgggctaaaactgttttttttcctttatatgtttctatgcttcgctgtcaaattaggttcaactgataagaaaaagcaagtataagagcgagcttttgtttccttagctgtactccttgaacccacttctccatcaccttcccaccacccaccccattgacaaagatatttcagaaaaactttgaagactgtagatctgatatgaagtagtccaccatttaaagcattctccagggtgcaatatcgcccctaacaatgggtcagtctttaggggtggggggagcatcggttctcagcaggcaaaatcttagctattaaattggctgtggccctccagaaaatttatgtactacatatctgtacatatacaaatatgtgatgtatctagggtaataaaatttcataggagctttggataagggagaaatagcctaaaaagatgctgtaaggaagcagtagtaaaacttaaaaaggttaacaaacactgctttaaagactatagcctcctattctcttctaaaagaattgcatagaaacagtccctttcctagtgcccgctcatgagctcctttattttgtccttctctgttttcctaatactgtgtttctatatggtttgaatatcatgtattcagatttgacaattttcttctgcctgcaagcatttttagtagtacttctgtctttgctaaactaatttgtaattaggaaagaacccatctagagtgtatgcttgttaaacatcctgttgattcatctttttgataactgaatctttctttatcattactattatatcactttgccttaaaactgttaatttccacagcatctctggctaggaaatcagggttgccttgagttatttcacgggtgacaatttccttttttgttcaaatctctttttgtggcatatatgccatttctcatttatttaaaatatgatttgacaacatattttcatccttattttatatgtacagttgacattttgcacaatgcaggagttggggaaatcaacccccctctgtgtctaacttttgactccccagaaacttaactactaatagcctacccttgactgaaagccctgacaataacatacacacataaacagtcgattagcacatattttgtatgttacatgtgtgatatactatactcttaaaataagctagagagaagaaagtgttattaagaatcatacagaaggggaggtaggtgcactcagtgtcacttttattttaaaaatctgcacataagtgggcccgagtagctcaaatgtctgttgttcaagggtcaagtataaatatatacacatatgtatatgtgtatgctaaattgtgtctatagattggctaagctgaaaagcacagccttccttaaatatccaattatatgtgcatattgcaagctgaccaaatattacatgttttccacatgtatatttagtgatcagttgtgttcttttttaaaaaaattgtcctcattcagatgtttttaaaacatgaaattggctttttaatagtttgttgtaggcttctttttaaggaaaactgatatatagttaagaaaatgcaattactattcacaaggggaaaagcacaaatattaaatgcataagttattacagcaaattaacatggccttacaaatatttcatactgataacttccaaatgtacttctccaacgcagatttctcccccaaactctagatcaggagttagcaaactgcagccctcaggccaaattcagccacagcctgttttctaaaataaagctttactggaacacagccgtgtcattctcccacgtagtgtctggggctacacaaaggcagagtagttgtgacagagaacatctggtccacaaagcctaaaatatttactatctggtcctttatgaaaatatctgcggacacctgcttctattcatatatccaactccctctttctatcttcacttagatgtctaaaagtgtaccgaatctaaaatgctcaaaaccaaattctcatctttcctctaagtctgctccaaccagagtcctatccatcccagttcatgttaatcacctttcaggttaagtgagaaattttagagtcacgtctttactccttactttctctcatactctattttcagtccatcagatattaagcctcctattggatttattttcaacatactcagaattcagtctttcatcagccactctgctgctaacattctggcttgaaccagtgccatagtttaggttactaccatctttacaacatacatccagagtaatcctgataacatggaagtcagagtatgtcccttctctacttcaaaccttatagtagctcctgatttcccttaaagttatagccaaaatgcctgtaatagcccagaagccctacatggtctggctctcccctagtacctccctgacctgctcttcaccacgctccccatcacttgctctcatccagcctcttgagcctccttgctgttctcagaaacgccacacgtgcttcaagcctttgcctgagctgtcttcggcctggaatttgcatcattttcatatccacgtaactcaccctctcagctttttcgaagtcttttctcagtgaggcatagcctggtcatcttatttacgactgcaaactgtcatccttccagcacctcctccaaagtctttatcccttcccttcctctattttctccacagtacttactatccttattgtatataatttacttattatatctattttttatttcttgcttcccccccgttagaatataaactctgttaaacagggttcaggagacgttttatttacatttacctatctttatcctgagcacatagggtgccagcccataaaaggcccaaggaaatattttgtaaatgaaaaatgaacattgatttaacatttttcagtgaaaagcataacaaacatttttcagctaacctttttaaaggccttgtatgtgtgactgcatatgtatgttcttttggatattttttcttctctcatgatactataattgtaaatatattcaaactatgatagcactttcttatgtaagaccacttcaacttagtatctctgagattactgctttttcagcctttcttctaaatagtcagtacagtatttccatgtcacattgagaattgctgatgttcgatggtgatctattagccatcttatccttccaaatctgttacttctatctaaataaacttaaattctattaatagaattcttatatttgaccctatccacatttaagaaaatacttccccatcaaaactttgccttaacctaccctctttagaaaccagagcctgaagcaaagattataatagttaccctttactgaggaagtgcaagcttggggcagggatggtagaaaattgatagtaagacaaggaaagatgcaaagcaatgcaacacaatgggctattgcactagctggccttctcaacaaattgcaaaaagaagcagtaagtgccctgagtaggcatgttctggtaggcaggaatttctttgcaaggattgcaaggaaaggccgtagttcaaagtagccaaccaaagagacaaagggagatgtgtctgcctggaaccttctgactcctacttcctggtggtcgaagtttgcctcagagaattccctttcctgctatcataccatcttaccctccagggtgcaggtgaggtgacttggcaaggatgagcatggcatgtgagaaattagaccacctgggcccagtatttaaatctgacccaagccagctctgaaaactatgcaagggtactggtaaagtcactgatggtctgcaaggagggtagattcttcagaaataggacattgagggaatctgagaaggtgtacaaagtttatatattaatacaaagccaccagctccagttatcagctttacttaacctcaagccatgctcagaaaaaaaacactccctttacctttattcattcaattcctccaagttttctaactcttcttggtcacaacctaaatatttggcacatttttttttttttttggagatgtagtctcgctctgtcacccaggctggagtgccatggcacggtctcagctcactgcaacctccacctcccaggttccagcaattctcctgcctcagactcccaagtagctaggatcacaggagtgtgctaccacgtctggctaattttttgtatttttagtagagacagggtttcaccatgttggccaggctggtcttgaactcctgacctcaggtgatttgccagtctcagcctcccaaagtgctgggattacaggtgtgagccaccatgcccagcccatagttgctctctcacttctaatcaaaacactccaaaccccactcctggtcttacaccccattagtttttttttggtcttccttgctttattatccagagtcagccaattcagggttgtgtttgcttggaggcctagcccatactcaggaaagtctccaacacttatctgctttgtctgttcctacttctgggttgccaagcatactagaaaaactcacataaatgttatgcaaatttatacattcatactatttaaactatctacactgctgtcctgtaatccttctgttcatctggaatgaactctgcaatattttcaccatccaactgcaaacattgtttttctgaagccacaaattccaatttgttatctcatttattttttaaaattttattctggtaacagcacttaacatgaggtttacctgcttgacaaatttttaactgtacaatacagtattgctaactattagtaacattgtacagtagatcttttgaacttactcatcttgtattaattgaaactttatgcttattgattatcaactccctatttcctcctcccctcccatctcacttcctacagattattaaatttactgatttattatttcacaaacattcagaatgggccatcccaatacagaaatcttttctaagttcttttatcggagtattgtttttactggtgccatgattccatcctgaattacctcctatagaaatttacctcaacaattagtcactcttatatgttttctctctcccatttttatgtatccatcatctgaagctgctaaccagggcctcttctatcctaaaattgaaacatacaagaaggaagtgaaacaaggcaattagtcactatttcatttctttgtgtgtgtgtgtgtcagttaaaacctaatacagatttaattatatggcaaagacagtatttcatcagtatatattgttagagatatttagataagacatagcttgggaatggaaaaatataaaagtacaaacttcagcttttactatgtgaattatttcatatggttaaacccaaagtggcatattcaggtgctagcagtaaaagtgatttgagtaagtgcctagaatttgaccaggaagcataattcaacaagcaagtaagctcatgttcctttaggagacaaaaactgagttgagatgcaacctgactagtgtgtaattgtaaatttttttctcttcacttcatcaattagtattcaacctcaatcattaaaaaatgcacccatttcctggttaataattatttatataaaaataatagaagcacttcaggaacagtggtatgagggactccgtgaactcactccccatagaatcaatcataactagtgaaaattataaaaatcaaccatttacagtatctgtatattgtcctaagggcacagaccaagtggagaaacatttattcaagaaaacctaaatctcagaagagtgagcgtctatagttttgagctacaacctcatttccagctccacgtgttggaagctggaagctctctctgggtagctgtaacctagaaaactgggctctttttttccccatgttcttgtccaggagagtggtctctccctgacaagccacttgcatttctcactgccccaactcccaggctctcagctgtagaatctctatttaggccagcatggccgatagatcttgggctccctgtacccatttcccactcacaaggtggaagtgctggcccagccatggaagactgagaataccaaaccctaatcattcctgctccagctcattagtgagagcagagatttcatgtcagaagaagctagcagagaagaccagagactcaagtcccaggcctgtgaactgtcagaggggtattgttttggtgtttttgattgtttgtttgtttgttttgagatggagtctcactctgtcgcccaggctggagtgcagtggaatgatttcggctcactgcaacctttgcctcctgggcttaagcgattctcctgcctcagcctcctgagtagctgggattacaggcacccaccaacatgcccagctaatttttgtatttttagtagagatggggtttcaccatgttagtcaggctggtctcgaactcctgacctcgtgatccacccgcctcggcctcccaaagtgctgggattacaggcataagtcacctgcgcctggccgggggtatcattataagagaagctagccactgtccccacccccagctcaggagaagtggtgcagagtttcctcccgaaggcaaacagcagcatgtaggaagagggaactccatagctctctctaggggaactgactttatttggaacagaacatgggaagctttactcttaaatgtgttctcaaaaacactggaaatttcagtggttaacattaagaggatgagaagactatagatcaacttataggcaagatacacaaaaatatataaactcctaaaactcaataagaaaataaacaactcaatttaaaaatggggaaaagacctaaacaaccacctcacaaaagaagataaaaaggtatatctcaaataaatatatgaaaagttgttcaaaattatttcatgaaatttcaaataaaaacaagatatggctatatatgtattagaatggctaaaatccaaaaatctgataacaccaggtaatgctggtgaggatatatagtaaacagggactgtaattcctattactggtaggaatgcaaaatggcatagacaggcagttttttttaatcaaggtaaacagtcccaccatttgatccagcaaccacactcctgtgtatctactcaaatgagttgaagcctgggcacagtggttcatgcctgtaatcccagcactttgggaagcctaggcaggaggactgctggagtccaagagtttgagcccagcataggcaatatggcaagattcagtctctacaaaaaaaataaaaaaagttagacaggcttgctgtcatgtgtctgcagtcctagctactcaggaggctgaagtgggaggattgttaaggccagggaggtcgaggctgcagtgaacggtgatcacgctgctgcactccagcctgggtgacagagcaagaccctgtctcaaaaaaataaataaataaaccaatgaatgagttgaagttatgtctacacaaaaatctgcatgtgaatgttcatagcagcttcatttacaattgccaaaaactggaagcagccaacatgtcattcaataggtgagcagataaatgtggcctatctatacaacgaaatattgttataacttgaatgtttgtcccctcccaaactcatgttgaaatttaattgccattgtaacaatattaagagatgggacttgtaagaggtgatacggccatgagagctctgccggcatgcatggattccttgtaaaaggatgagttcaacccccttgcgtctctctcttgccctctctctgccctctgctttctgccatgggatgacttggcaacaaggccaccagatgtcagccccttaatctaggactttccagtctctgaaattgtgaggaaataagtttcagttctctataaattacccagtctgtggtattttgttacaagagcacaagatgaactaagataagtattatctagagataaaaagaaatgagctattaagctatgaaagacatgaaggaaacttaaatgcatatcgttaagtgaaaaaagccagtataaaaaggctatatactgtatcttcccaactacatgacattgtaagaaatgcaaaactatatatagagacagagaaaagattagtgtttttcagaaattcagggggagggatgacagttatagcacaggagatttcttagggcattggaactattctatgtgatattataatggtagatacgtggcatttcacattagtcaaaacacatacaactgtacagcacaaagaatgaaccctaaagcaaactatggacttcaaatcctcaccagtattggtattactgagtctttggattttagccatagttaataatgtatcaatattgttccactgattgtaacatcagttgtaacaaatgtgctacactaatgcaagatgttaataataggagaaactggggaggtaagaagtgatggaatatataggagctctctgtactatctgttcaacaaaatcttaataaatgaaaaacagctgatggaatgtaataagaaaggtttctcaaaaggcgccccccacccccgccattttttgccatgtggaccatgccatgttttggcatgattactttcaacatctttgtaattttaccacgtttactttcaacatctttgtaattgtctatagtcagctctgagagatgacacataagattttgacctgatgtcagactcctcaatgatgaatcaactacagtgtttcccatttcttataagagctaacttagctctagaaaccaaattaccaaaatcaagaagaaaagataggatgtcactaccaccttaaagcaatttttaaaaataattataagggaatactctgagcaattgaatgctaacaaatgagttaacatagatgaaatggacaagttcctagaaggacacaaactactgaatctaactcaagaaactgaaaatctgaatctacctataataagaaatagattgaattagtaattgaaaacctgtccacaaagaaaagtacaggcaaaaatgacttcactggtgaattttaccaaacgtttaaaagtgaattaatgccaatccccaacaaactctccaagaaacagaagatgttttccaattttgtctatgaggccaatattaccctaatacaaaacctgaaaaggcatcatgagaaaagaaagtgaaagtgacaaatcaatatctcctaaaatataggtgcaaaatcattaacaaaacactatcaaaatgaatgtagcaacacatacacaaaaggattacacatcaagaccaagtgagatttattcaggagtccatggttcgtttaacaccccaaaataaatcaatgtaatagaatatattacaaaaatcacatgtcaattgatcaataagaagcatttgacaaacaaaatatcctttcatgtacaagtgtgcaacaaactaagagaaaggacctttcttaatcataaaatctatgaaaaagtccatagctgtcatcatatttgatggtgaaaaatagagagcttttcacctaagatcaggaacgagacaaggatgcctattctttccacttctatccatgacagtactaggtgttctatccaaggaaattaggcaagaaaaagtaataaaaggaatctagataggaaaggaaaaaattaaactatctctaatcgaagatgacatgaccttgtatataaataatcctaaggaataaaacaaactctaacaactaacaaacaagttcaacaaggttttaggatacatcaatatgcaaaaatcagtggtatttctcatataaatgtgttcagcccctgtcccacatccatggatttaaccaactgcagactgaaaatatttgaaaaaaaattgtactgaacatgtacagaatttttcttggtccctaaatagtataacaacaatttatataatatttacattgtattaggtatcataagtaatctagagatgacttaagatatagaaaagatgtgcataggttatatgaaaatactatcccattttatattaggatttgagtgtccactgatttcggtatttacatgaggtcttagaaacaattcctcatagataacaagggacaactctacattaacaatcaggaaatgaaattaagaaagcaattccatttacaatagcacacaaaagaataaaataactataattaaatttcacaaaagaaatgcaatacttgtcaactgaaaactaccataaaacattgtcaaaagaaattaaagaagacataaataaatggaaagacatcctatgtttacaggtaagaaaacttaacattgttaaaatgctaatacaatcctcccttgatatttgtgggaagattggtttcaggagcccctgtggatagcacatgcatatctgtgcaatagaatgttatttggacataaggaatgaagtattgatatatactataatttgaatgaactttgtccattatgttgactgaaaccactatagtaagagaaaagttacacaagactgcatattgtgtgattctatttatatgaaatgtcaagagtaggcaaacctaaagagatagagcatagattagtggttacctaggactgtggttgtgactgctaatggatatagggtttcttgctagggtgatgaaaatgggctaaaattagattgttgtgatggttgaataactctgtgactataataaaagtcattgagttgtaaacttcaagtggttaatttttatggtatgtgaattaaatctcaataaaaatattataaaaaacagtagggtaaccacttaaataatgagtatatgacttccaaactagtacagggaacaaaaggctcaattgatccaacagaaaacaaaggagaagaaaaataaactgggatatgaattgtataggagaggataatagaaataaatgtaaacatactagtaattacagttcaagtaaatggaataagctcagtaataggtagtgtcataccaatttttacatgatatttactggagatacataaagcctaaaggcatagaaagattgaaagtaagatagcaaactaaataacatgtatatattaagctagaggaaagaaaatgctgttatgatatcaggaaaaaaatacaatttaaggtattttttaagaacacaataattattagtgataaagtgtatctctacacaataatagacttatttttattattattatttctttagaccaattcttgctctgtcacccaggttggagtgcaatggcaggattttggctcactgcagcctccacctcccgggttcaagcgattcttctgcctcagcctcctgagtagctgagattacagacgcccactaccacacccggctatattttgtatttttagtagatatgaggtttcaccatgttggccaggctagcctcaaactcctgacctcaggtgatccgcccacctcagtctcccaaagtgctgggacgtgagccaccacgcccagcaatagacatcattttacaaagaaaatgtaattattctaaatgaagtgaccaaatatatgaagcaaaagttgacaggattactaaaagaaatagacattctgtaatcatggcggagatattagcaaatctttcccagtaccttcatagatcaagtaaacaaagatagcagaaattactagacgattaagcacatccctaaagagtttaaagaaacccaaagagtttaaagagtttaaaactgcatgtttaactgatttgtacataatagacaataaccaaaacagaaagaagttatgtttaaagtacatttctatcaggtggtggatcttagtttgcttgtttgatgtttttatggtttatttttataagtcgatcaatgtggaaagttgacctagcatttatcaaatgcctagtgtgtaccagatgttttacttctaatcctcagacaacctcatgagaataattaccttcatttaacaaagaggaaacaaagacttgggaaagctaagtgatttcctaaattctcgtaactggtagagttcaggtttggacttaaatttgtctcatagagtcctctcctgagtatattttagaagtgagatattgtttcttgattaagtgcttaactgctcccttgaaacaagatactaaattttgagcatgggtaaatgtatgtaattctaccctaaagggaaattcatatgaagtccctttttttgtctcccttttcctttcttcctttttcttcctacaagcccaaatccctataaaaaatgaagagttaacactacccatcattacaaattagttgctgcaggctttagtgcagaagaacatgaaagcccaccttaccaatattaggtgaataagatgctagtgcttataaagtggagttaaattaacctgatttaactaagagatgttatgccaaagagtataaaaattgaagagaaaagacaagtctaactttcttagaatatgtgtatattagatgaggtataataggtgacacttagttagccagcccttgtgttttaaatatataatcttatttgcgtattccatcaatcttatgaaaaaggtactactatatttgacatgtcataaatgagaaaaatgaggctcagcgcagttagataactctacctaaagttttactgataaataagtagtagagcaagaatagaccccaagaatccacgatggtaaccacataaaccatattttcctcaaaggtatgtgaaggtctcctaagagcagaaacttttttttttctggtagaagcagactttcagtctatattttcttccattcatttttgcacttctgatccagatcacacctttatttcactcatccaatctactggacaactttgagcttttctagatttctttttgggggaccgactgtgactagatgtgtgttaaaatggacaattgttctgtttcctgaagagattccagtctcttactcttataggtgttctacagatgtagaattaggaaaagcattgtctacatgaagaaatttagaaaacacaaggaaaaccaatcagaaggccaaagttgaggaagactcatgtctaagaaaatgaaggtgtacatcaggcttaggtaagagaagtctaggatacaggaaagaggggattcaaatccaatccaaaagctgaacattgaccagcaccatactaaaataaacgtaccatatagaattaatgggaagatttttaatctcacatgtagtctaatgcttcctgcttctcttcaagttctaagaactaacaggcaagtacttttagttgtaggtgaagtttaagagagatcaggactaacagaagtatgctgtgtgtttggaatgtgtgttcttccgccatctgtaggacatgagtgtctcctattgggtgcctgtagcctagcttgtttctttctggaatctttagccatgcactacatcaattataggaataatagctatgaaagactccacgttttcccttcttcccgtatctgaggtgagaacgatatagattaggtaaaatgctgttcccatttcaaatattcagcctgacaaagcaacactgctttctcaagcagttgcagtgtactacaatccagtctttgggattagaaatccaaaggactcagactaatactacgcaaatcacaagtttccttttactggtttaatcgttgctgataaaaggtacaaatgaaattactgtatttgtttagcattaattgtaatttttgaaatgtactcaccacttactaaagattataaagcatgacactatgttaaatgaagaatctaatgaataatttttttttttttttttgagacggagtctcgctctgtcacccaggctggagtgcagtggcgcaatctcggctcactgcaagctccgcctcccgggttcacgccattctcctgcctcagcctccagagtagctgggactacaggtgcccgccaccacgcctggctaattttttgtatttttagtagagacggggtttcaccatgttagccaggatggtctcgatctcctgacctcatgatccacccgcctcggcctcccaaagtgctgggattacaggcatgagccacggcgcccagcctagtgaataacttttaaaaacattctgccagtgacaagtaaaaaaaaaaaaaaatactgaagctcccgtattgcttcatatgtgtttattgatattttccacaatgtccaaaataatgtattttacatagcttctgctcatgaaatattagttgatttttttttttccatggaggattcatttcaagttatttcccaaaccttggtgagccaaaattcaatctgtctctcagaggtggaaacacctacttgtaactaaaaagtcactggggcttgtgtattgatgccagtaagactcattcatcattgttgatgatgttggtgcacctgtttataagttacaggtatagaaaagcctgaaatagtaatgttttacccagacagatatggggacattttctgttttcttctagagagaacactttttctcattttgtttcaaaatgactttgcagacagtgagagtgaaaggtgttttattcttactattgactctcaaatttgcagtaaaccacgtggtttctttcttagaaacatagaaattatgagctggaaagaaccttagaaaacagccccattattttacagatgaggaaacaggaacccagaaaatgatgagcacctttccaaggtaccagatttagttagcggctgagccagaactggagtctatatttgccttattctacctccagtgttgtttccccaccacacacaatcctgttctgcatatctcaagccaaaataaccagtcagttcaccaaagaaagtccagttgattgtctgacctgttagccagtactgagctctgcaaaattccccattctttgtactacataggtgacgctattattcattgtattagacggtgtctacttcatgtagacaataaagagaacattacttttctgaactttgtaccacaatatgttgtattttattctaagaaacttaatcctattttaggaacactgaattctgtaactgattaggtttcccttttctaattggctgctagacagctaagaacaaatgtgtggcctaattttattagtggaaagggcactgtgtaatctagtgttctgttatccttagtcctgcctttattttacatcgttatctttgattctttttcttttgcttttacacttactttgtaccatcttgctttatttgatcattgaaatttaattctttcttgtgacaacataaatataaataaatgcagatgggattggttttaatatgcaactattttattatgatagattgcttcaatattccagtttattttgaatatatctagaagtctttctaactcaacttgattagtttaccctcttcaaccttgggctactctcattttgataagtttacatcatgaagatgacatgaggaaattaaattattttgtaacttgtttacataatttgatttgcctgaactacatctgaacctgagttcaaacttacagaagataaataacaagtttgctataaaaagtgtctcataaatatggagagaagttaactatcatgagttttaaaattctttttaccaggtaaaatgtttgctttattgggcatttccttggagttgaaaaagctgtctgtttagcagataaatttctgagagatcaataatattgacttaaatttcaaagggtgcttttttccgaatattttacatattagcattgaagaatcccttaaaaagataaagacacatggtggattatggagtagctcagaatttgtctaacaatccttactcatgtttgcaatttgttaagggcctagtaatgatctgattttgtttgaaagttaatttactttatgaagtaagatttgctattcctaattattctattcacaagacaacaagaattcaaaagtaaaatatttcattagttctttcttcctgattgtcttccctcactttttctaaggattcagttattcacatccttgtctgttatgtgtgtgctgatactattacttgtaggtaactccaaagacttgagaagaatcaacatgttgttgagattctatgaatttaaagcatcctgagagccacaagaaagtgtgtttcttttttttgttgttattatactttaagttttaggatacatgtgcacaacgtgcaggtttgttacatatgtatacatgtgccatgttggtgtgctgcacccattaactcgtcatttaatattaggtatatctcctaatgctatccctcccccctccccccaccccacaacaggccccagtgtgtgatgttccccttcctgtgtccatgtgttctcattgttcaattcccacctatgagtgagaacatgcggtgtttggttttttgtccttgagatagtttgctgagaatgatggcttccagtttcatccatgtccctgcaaaggacatgaactcatcattttttatggctgcatagtattccatggtgtatatgtgccacattttcttaatccagtctatcattgttggacatttggcttggttccaagtctttgctattgtgaatagtgcagcaataaacatacgtctgcacgtgtctttatagcagcatgatttataatcctttgggtatatacccagtaatgggatgggtgtgtcaaatggtatttccagttctagatccttgaggaatcgccacactgacttccacaatggttgaattagttaacagtcccaccaacagtgtgaaagtgttcctatttctccacatcctctccagcacctgttgtttcctgactttttaatgatcatcattctaactggtgtgagatggtatctcattgtggttttgatttgcatttctctggctggtgatgatgagcattttttcgtgtctgttggctgcatcaatgtcttcttctgagaagtgtctgttcatgtccttcgcccactttttgatggggttgtttgtttttttcttgtaaatttgtttgagttcattatagattctggatattagccctttgtcagatgagtagattgcaaaaattttctcccattctgtaggttgcctgttcactctgatggtagtttcttttactgtgaagaagctctttagtttaattagatctcatttgtcaattttggcttttgttgccattatttttggtgttttagtcatgaagtccttgcccatgcctatgtcctgaatggtattgcctaggttttcttctagggttttcatggttttaggtctaacatgtaagtctttaatgcatcttgaattaatttttgtataaggtgtaaggaagggatgcagtttcagctttctacatatggctagccagttttcccagcaccatttattaaatagggaatcctttccccatttcttgtttttgtcaggtttgtcaaagatcagataggtgtagatatgtggcattatttctgagggctctgttctgttccattggtctatatctctgttttggtaccagtaccatgctgttttggttactgtagtcttgtagtacagtttgaagtcaggtggcgtgatgcctgcagctttgttcttttggcttaggagtgacttggcaatgcaggctctttttggttccatatgaactttaaagtagttttttccaattctgtgaagaaagtcattggtagcttgatggggatgacattgaatctataaattaccttgggcagtatggccattttcatgatattgattcttcctacccatgagcatggaatgttcttccatttgtttgtgtcctcttttatttcattgagcagtggtttgtagttagcaagagcaaatacgttcaaaagctagcaaaaggcaagaaatagctgaatcagagcagaactgaaggaaatagagacacaaaaaacccttcaaaaaatcaatgaatccaggatgtggtttttttgaaaagatcaacaaaattgatagaccgctagcaagactaataaagaagacaagagagaagaatcaaatagacgcaataaaaaatgctaaaggggatatcaccaccgatcccacagaaatacaaactaccatcagagaatactataaatacctctatgcaaataaactagaaaatctagaacaaatggataaatttcttgacacatacaccctcccaagactaaaccaggaagaagttgaatctctgaatagaccaataataggctctgaaattgaggcaataatcaatatcttaccaaccaaagaaagtccaggaccagaaggattcatagctgaattctaccagagttacaaggaggagctggtaccattccttctgaaactattccaatcaatagaaaaagagggaatcctccctaactcattttatgaggccagcatcatcctgataccaaagcctggcagagacacaacaacaaaaaaaagaattttaaaccaatatccttgatgaacattgatgcaaaaatcctcaataaaatactggcaaaccgaatccagcagcacatcaaaaagcttatccaccatgatcaagtgggcttcatccctgggatgcaaggctggttcaacatatgcaaatcagtaaacgtaatccagcatataaacagaaccagtgacaaaaaccacatgattatgtcgatagatgcagaaaaggcctttgacaaaattcaataacccttcacactaaaaactctcaataaattaggtattgattggatgtatctcaaaataataagagctatctatgacaaacccacagccaatatgataccgaatgggcaaaaactggaagcattccctttgaaaactggcacaagacagggatgccctctctgaccactcctattcaacatagtgttggaagttctgtccagggcaatcaggcaggagaaggaaataaaaggtattcaattaggaaaagaggaaatcaaattgtccctgtttgcagaagacatgtttgtatatctagaaaaccccatcgtctcagcccaaaatctccttcagctgataggcagcttcagcaaagtctcaggatacaaaatcaatgtgcaaaaatcacaagtattcttatacaccaataacagacagacagccaaatcatgaatgaactcccattcacaaatgcttcaaagagaataaaatacctaggaatccaacttacaagggacgtgaagaaagtgtgtttctgagaaataaaccttatcaaattaagcatattataaaataaaccatgagaatattgcatctgttgggtcagtaagttctcactgagaaaattagagaacacaacatcacatggtatgttgcttaagttatactcaccagatcaaacaaaatttaataaatgatggaataaacacactgttatttcaaaaaataggcaagttagatctagggctgcattatcctatagagtagccactacctacatgtggctatttgagtacttaaagtgtgtctagcataaactgagatgtgttgtaagtacaaaatacatgctgagtttcaaagatgtagtacaaatcaaaaatataaaatatctcactaataattgatttcctataggaaatatctcactatattgatttcctataggaataatattttagatatacttattgaataaaatatagtaataaaagtaattttaccagtaaaaacttgaggattggtagaaaatgatacagaaaatttcaacaagaaacaaaattagttttaatgctcttattggtctcccagtaattttattcctggaaatttattttttagagacagagtctcactatgttttccaggctggtctcaaactcctgggctcaagtgatgttcccactgtggtctcccaaagtgctgggattacaggtgtgagctgtcatgcctggcctcttattcctggaagtttaacaagcaacagtagtaaaatctatacgtacatcacatataatgaccacaagtatacagtgatagcatgcgcatgtgaatgcacacacactgagtccattaggaaatatttctttttttttttttttttttttttttgagacggagtctcgttctgtcgcccaggctggagtgcagtggcgggatctcggctcactgcaagctccgcctcccgggttcacgccattctcctgcctcagcctcccaagtagctgggactacaggcgcccaccactacgcccggctaattttttgtatttttagtagacacggggtttcaccattttagccgggatggtctcgatctcctgacctcgtgatccgcccgcctcggcctcccaaagtgctgggattacaggcgtgagccaccgcgcccggccaggaaatatttcttaacaataaaagcattaacaaatttcagacagaaaatttgaagtttgtatatgtaaattaaatatgatatatggagaaatcggaaacaaggtgatatgcaatataattgtactgtgcatgcaaatcaaaagggaccagaaataaatattcaaaataacattggtgtgctgagacaataaaagtataagtgattttaatcttccagtttttgaagtgttactgatatactatcttttacatttttaaagagataaaagggaaaaaataatgtattacaaagaaactagcataccttgtgtattaggctgcttgggctggcataacaaaataccatatactgggtggcttaaacaacagaatctattttctcacagttccagaggctgggaagcccaagatgaaggtgctagcagttcatttcctggtggagactctcttacaggctttcagagagctggctttcttgctatgtagggggtgggcaggagatcttcttaaaagaccaccaattctgttagattagggccccacctttatgatctttttaaaccataattacctcctaaaagccctgtttccaaatatagtcacactgggagttagggcttcaatatatgaattttgggggaaacacaattcaggccatagcattttacaatgtgacctcatgctgtaatacaaagaacataaacattttatttaaagaagcttgaaattgaactcaaattccattacaaagaagctagttattttaactcctccaagtttccattttcttaactgtaaaatggggaatgaacatttatttcataggattgttttctttttgtcccagttttttctttactcctgtttttctttattgccttctttgggaataatcaagttattttttgatttttctctattttttcagttacaagcttttgtattcttatgattttcttagagattaccatatgcatctttgatctattggaatctctataaattaatagtattactactttttggaaaataaaataatcttacaatatgcaaactgttcttatcctcctcctatattttgtgctattgctatcatgtgttggctgctatcaacaaattgacatttcagctccaattttactctttgatgtctgttctgtgaaaatgagaatgggcctaggtctgccttagttttagtgctgctataacaaaatgccacagactaggtaatttataaaacatggcaatttatttggctcatagttcttgaggctggaagtggctgcttcttgtgaggaccttctggctgcttcatcctgtggctgaaggcatcacataacaagagagtacaggagatacagcaagaggacccaactttttttcctaacaatcccactctcagaataacgaacctactcctgcagtaacatcactgatctattcatgattgcagagccgtcatgaccttgtaaaggtcccacctatcagcactgttacactggggattaagtttctaccacatgaactttaggggacacattcaaattgtagcagggcctataaactgttttctttgccagttgtggatgttaaactttgatagaagtgctgagaaaagtcattactggaggagagagtattctttctcggttctgctatggctgtctcaccaggtttttccagggtgtgcttttttctacactgcacagcccacgtggttttcttcagggctaggcacctccagggtgcacccttctgcagcatttaactgttgagtgttttctgtaagtatccacttgggtagcagtgaccttggcccaagtcatacaaagaagtgggctatattcctgaagagggagacctgtcaagctcctgaatctagcagtgcctacaacagctcccaaattccctctgtaagcccaatttcctctgtctacctgctcatcagccttagctcacctgtgtcctgcaagtttgtttcctgtgatcctcttattgcagataccatgagtttattagtcagggttctctagagggtcagagctaataggagatatatatatatatatatatatgtatcagacttggagtctgatgtttgagggcagaaagcatctagcatgggagaaacatgtaggcagagaggttaggtcagtctagccttttcacatttttctgcctgctttatatttgctggcagctgattagatggtacccacccagattaagggtgggcctgccttgcccagcccactgactcaaatgttaatctcctttggcaacacctttacagacacacccaggatcaatactttgcattcttcaatccagtcaagttgacactcagtgttaaccatcacaatgagccacagacctcatgtctacaatccccctatatctttacacctgcctacaaccatcagcttgcctgaatgaacagaagttctttccttttttgtttggctcctatgggttatctctggcctggaatacccagataatttctccagcatctactgggctacaaccaatcttcaataaagtctgatttccctccaaagtttgtccttccttgagtattctacttccccagaatacctgttagagttctcgttatatctttatggttactctgtttctgcctcctgctagggcttggggtgatacatctgataattttactgtgcactaaaacttgtaaaggcaacttctattttcagcctagatgaagtacctgggactgaatataaccacctgccggaagcaaataaaaattggacaaaatataagaaacacttattttcaaacattgtctatgacagaacacagtaattttgagagctgggaactcaccaggagaactctatgatttccctcacttactgatgtgaaagactttccagatcagtgcacaaggaaggaaaatccagctggagcctgacggtgttcctcagttatagagaaactgagagatggaagggagtttaggcagctggaatttgcagggaagagttccagaatgggggagtctggagacccatagaggatttcagttgaatcttcagttgagtatttatcagtgtacatttgagaagaaactctgagtctgagtaaaaagaaaaccacatgaaaggattagagaaagcaatcctcaaaacatgaacagaatcagcaataatgtttgttcccatcagccagaatggaaaataactcataattcgaggatttgggtggagtattgcatcaatagtgagtaaaattagctctagaataaaggctcctccaattatgtgtaacaaatttaaaagcaagactccaaaagaccaaactcttcccatgtaacttaactgcttcttagagtaaagttcaaggatattaataggattacaaaaatatctagccttcaacaaggtaatattcacaatttaaaaattgtcaggcatgcaatgaaggaggaaaatgcaactcgtatgaacagaaaaatcaatcaaaacaaactggaaagtgatgcagatgaaagcgcagacaaggactttaaaaatatataactaagccgggcgcggtggctcacgcctgtaatcccagcactttgggaggccgaggcgggcagatcgagaccatcctggctaacacagtgaaaccccgtctctactaaaaatacaaaaaattagccgggcgtggtggcgggcgcctgtagtcccagctactcgggaggctgaggcaggagaatggcgtgaacccgggaggcggagcttgcagtgagctgagatcgcgccactggactccagcctgggtgacagagcgagactccgtctcaaaaaaaaaaaaaaaaaaatctatatctacatctatatctatctatctatctaaactatgttttgtatgttcaataagatggagaaaaatttagcatgttaagggatgtgtaatatatcaaaaaacctaaaatcagcttctggagataaaatctgcaaagtctgggatgaaaagtttactggaagggattaacagaagactaggtactgtagaaagattagtaaacttgaaggcatagcaaatgatggggttcaaaacacactaccccaaaatatgacaccttggcatatggagtattgtaagctgaaggaggctgagaaaacctcagaagcaggaagttctctctgaccttctcctacctttctcccctgaagcacgtaataaaggctagaaagaatcctctgaccttctgtcccaatgcaggtcataaaacttagaaataatattctcacctttccttggaggatattataagaccctcatatgagaggtaccctccctgtacccaaaggcaaggaaggcccttctctttgaagacatagggacatagagaataatcaaaacaaataagcctcgctaaatttcccccagttcatcatcattagatcataccctctttgtctaattctgcttctcaatggctatccatttcttcatcaaacttagcataaaaatacgtttccctgtttctttgggtcttcattactgaaggctctcatgtcacataaaatttattaaatttgtatgcttttgtcttattaatatgtctttatcggttttattgttaaagctggtcagggactctaagaaggtcaaggaaaatctgcttcccctacacaattaaaatatccaaaatgacagaatgcagaagagaaatgactgacaaaaaggcgcatcaataagctttggaacaacttcaagttactcaatacatgtataatttgagtctataaactatagaagtgaaaaggacataaaaatatttaaggaaatgacttaaaaatttccaaaattcataaaaattataaacctacagatgcaagaagtgaaatgaactcaaagaacaagaaacaagaccaggaaaactacatcaggacatataataaacaaattgtttaaaacaagtaatgaattgagcacattaaaagcagtcaaaggaaaaaagatatgttacaaatggaggaacaaagacaaggatgacaacccatttctcatctgaaacaatgcaagcaagaagacaagtaagcagtatctttaagtacttaaagaacaaatcgggtcaacatataaactttctgcaacaaagaaaacctgaaacaattcaatagcagtggacctgcactaaaagaaatagtaaaaaaaaatccttcagacagaagcagagtgataacaaatgagatctgtacctagaaagaggaatgaagaatatagtcatctttcagtattcatgagggactggttctaggatccctgttggataccaaagtccacagatgctcaagtcccttgtataaaatggcatactatttgcatataacctacgaaaattttctgtatactttaaattatctctagattacttataatacctaatgtaatagaaatgctgtgtaaatagttgttatactctattttttagggaataatgacaaaaaagtctgtaagtgctcagtatagatacagccattgtaggcctaactacatagtacaggtcagcaacagtgttaacattttctgaaatttttaaaaagtatgtttggactacagttagttaaatctatagacacagaatctgcaaatacagagggctgactagaaataaaatatatgcatataaatataaattaattttaacttatattttatctctttaaaagtaaatcaagtatctcaagtaaaaatataacaacatattcaggggtttgtaatatatgtagaaatcaaatatatgacaacaatagaacaaaatctagtgagggggaagtatactgttttaaggtttgtatctgtacattaagtggtataatattactcaaatgtagattgtggtaagttaaacaagtatactatgagccttaaagcaacattaataacaaaatagaacaaaacaaataactttagctaaaattcttacaaaggagataaaatggaaccttaaaaaaataatttatacaacgagttagaaaaaagaatggaataaggaacatgggggaaattaagaactaacgagcgagatgatacatttatattcagttcaataattacatcaaatgtaaattatgtaaacattctagtttaaaggcaaatattgctgatttagataaaaaagcaagcaagaaaatatggtgcttatatgaaatacacttacatatgaagacataaataggttaaaagtaaaaggataggaaaaaataccataaaagtagtcagcagaaagctggattggctatattaatatcaaagtaggtgtcagggcagaggatgttaccagggataagaaagttgtttcataataataaaggggtgaatttatcaagtggcattaacaatcctaaatatttatgcacttaatgataggcccttaaaaatagatgaagcaaaaacagaattgaaagaactatgcaaacccacaattgtagttggaaattaacacctactttaagtaatgtattgaataaatagatacaaatagaataaaaagacactatcaatcagctttatctaattgatattgatagaacaccgcacccaacagcagaatacacattcttttcaagagcacatggacattttacaaagatatatattattgtttgctgtaaaataaaatgccaataaattaaaaagaatcaacaagtatgtccactgaacataatgaaattgaattagaaatcaataccataaaaatcactctaatatttgggaactacaaatcatacttcttaatatcccataggtcagaaaagaaagaagggaaattagaaaaatattttaaaccaaatcaaaatgaaaaagcaacatggtaaaatttcaaggatgcagcagacacagtgcgtagaagtaaacctgtagcagagaaagcctatattagaaaaagaagaaacttctgaagtcagagtttcatatttaaggaaggaagaaaagcaactcaaactcaaatgtaggcagaagaaaggaaataataaaaataattgcagaaatccatagaacacaaaacaaatataatggagaaaattaataaaatcaaaagctggttctttgagaaggacaataaaagcaatagagtcagactgatgagaaaaaaaaggaaaaaacagaaattaccactatttggaggagaagtgacaccactagagtttctatacacatttaaaaaacatagcaagagaaaatattattttggtaactatgttattaatttagatgacttaaatgaactagacaaaaaccttgaaagatgcaaccaagaaagctcattcaaggagaaacagatagcctaaatagtcttatatctattaaaaaattaaattttatttttactttcaaaagtttccttgagccccacctccttctttgtggtaacaacacttagcataagatctacattcttagcaaatttttaagtactgtagtctccctttatctgcagtttcagttatctatgggttaacattggttcaaaaatattaaatggaaaatttcagaagcaaacaaaaattaataccttttaactgtatgccattcttagcatgatgaaattcatatgcaaataaaccaataaactccagaatacagtattccactgccctaatcaccccagggccaggtactaggtaactaaggacagccctaaaccctagagcccactgaaattattcaaactagccaagcctcactcaccttgccatgcctatcccagggaaaccacacaaaaaaagcatcatccatgcttttccctcattccttctgcctccagactgacccgggtacctccccaagtgacccagcatggcatgccccttccttgggaactgtatgtaagttactatctatctttccaatggcagttctcacctgatctgttggcctcactacacctaataaaaacaaaatcacagccacattttaaaatagcaccatttactatgtgtaagttatatctcaatacatttatgaaaagaaaaatacagtaatttaaaaactgaaaggcccctttaagaatctttataatttttgtttccgttttcttcttccctcagagagaatccttgtttcttcttcaggctttagagcagagttcctgatagaactttctgcaattgtggaaaaattttatatctgtgcttttcaatatgctagcgacttgctacttgtgactgatgagcagttgaaatgtggtcatttgaggaactcaattgttagtttaattcaatttctaccagttttaattcaaatttagtcacatgtgaccagtagctactgtattggactgtgtagctctagaggttgttgatgtgatctcccccagagcaaatattctcttattttagtagataggaaatggatttgatccagtaaggaattaaattgattaattgatttgaggctgcatttctgttttgtaaggctctattttgatttgctcttactcctggagtatagatcctcacagatctcagttaaattgttagtgggaccaaactctatttttgtcttagtagcctataatactacttttgtttgtttcttgccccatgcaatttaagagtcaacaaatgctttgagggaaacagtggcacaaggtttcaagctcacttttctgtgatttttcttggctccttgatcttggcccctcaagttctggctgtcataattattctccaaaaacttcaaagagctgatgtttgtagcttatccagtttacatagttattctcagcatgaagattaattgatgcaagctccattaccatagcaagatgtggagatcctcataggattcgtctgtaaaatattacatataaagtggctatttcgctgacaatatatgtttcctcttctcttttcttaacttagaattagcagtaggtcctaatgtaatagtaaaatttgatttttgtaaacttaggaagtctaagtagtaaaatttaaatttcagtaacttctcagtgccctttttcctgctcaagttgtcttttagtcgatttattaggtgcttgtagtttatcaaatcacctctcaggatttactccttgctcgtgatgtctctagagctacccttccctcgcttcaaaactcagtagtgtctgtcccatattctcaattccagttcctttactctatgctctgaaagcttaccaagcccctccattaaagcagagttagccattaagtgtcctccagtctctacatgctagtgcctttctgcatcttcattttccatgctccgtgtgaagtgactttctgaaatccaggccttgtgctgtcactttactgctttatacctctcagtcattccccattacccataggaaaaagctcaaactccttgacatggtgcataagacctttcatgtgccagtcacaggtgacctttccggctgcatttttagcttgactttcacatgcatcaaaaagttcagtttttccagatgttttcaaggaaatggagttttaattttttttcccagaacatattatatctgtcacattcttctatttttgtcatttgctactctttctcttaaatgctctttcttcctcctttcccagaagaaattccactcacccttcacggtccgtggaagcatcatctgcgttgtgagaccttccttctgatgtttttctgcagctggtctgttagctcctgaggcttacgctgttttcttgttcattgtgtgtaattttcttatatccccttagcacagccttgacaagtagtaattgctttacaagtgtttgttttatataactgaattgcagtgaatagcggggcttagcctgagcttcagctgattctttagacagaaaactaagtatttcaagccctgcgtgtaaatcccaggtgaggctattttggtcaggtgaatgttttagcacttgtcagctcatagcgtggaggtagcggccagctttccctcacatcttgcgccaatcctggatatcataaatgatattgtcatttttaagcccaacaaagttttttttatactcccttcaaaggaactaagttttatacagttacatgtgggaaaaggctgtatgtaaatactaatgtcttataatttgagccataagctacatatgtaccttgaaatttacttctgaattgttatcacagtatgttacagagtagctccatgattccttaataaattagctgactctcagcttaggggagtaaattttcttgaataattgaggtcagaggtatttgggttacttcttagatgaaggttattttctagcttatgctctgaaggtctaaactacaatgtaactttgcaaaacaggcactgcttgtgcgtgaagcagtggaaagatgaggtcttagtacacatcatgtaaggttttttaaatatacactgtgctataaaataagaaaaaataagtgaaaacacttttagggtacaccctaggacatctaaataatgttggaatggaaaaaaataaaatacattcagttatacttgggagagttatagaaagaaaatagaccgtctcctagttgaaaatttgatgtccccttgaaaaactgcaggtatttatgttgctgtctgcagttggaacaggactagtgtttccactgtaggaatggatggatgcagcaacatggacagaggctccgttaagtcatagaaatttgaggggagtataatcccacgaggaaagccactgagaacaattcagctccaaatcaggaggtaaaccagggccaggtagggggagtgacagtggatctctgaggcataggcaaggtgttctcttcctagctcctaatactggagaaagcaacagagaattttttccaatggataccttactccataaagacaatctcaaaaaggaagctgctcagatctgttctatactagactcaagcagagaatttctggagctggtgataccaatgggctggggtaggtcccccaatgctgttggtgggaactccacccccagccagtatccaggctcttgacaccattgtgagaaggaatttaaagatgagtcagaacatagtgaaagcatggagatttattgcaaagtggaaagtacacactcaagaaaggggagcgtgggcgtacttgagagagttgagcgagagggtttgggggtgctacctttatgaatttcttcaaccaaggggtggaataattcctgaaaaaaggtagagagttcttggaactttggtgccacccatttttacacctaatatggatgttcccggaactgtcatggtgctgttgggtgtgtgatttagcgtgttgagcatatgacgaggtcctaagtgagacctaggtcaaatccagcgccatattaggtgcagttgttcttactggtcttggtcggcaccctgtttttcaggatcttatcagcccatggcctttagtcacgtgaaactgcctggaatgttttattctcctgcgaacaccctgtattatttctgtcttactgggatgctcccttcctccctaactcagtacctctgctcacccaggagcacgtacagctagtgtcttcctgtgtaagaagtgggaatttggatggataaattctgtgttcccaaaactaggtagaaggaacaaaataaaatatagggctgtatactaaatgggaaaggctttatatttactgcaaaaacagcatttgtacattgtaacatataagccactgatcagcaaatgtataatatcaaggtgaaaaggagaggctcaatgaaatcttaatttggataggaattaggtgattgggagcattcagaggatcccaaagagttttttttttttttttttttttttttttaaaacaattagcacctaaactctcacttccacaccaagaaactgcgataattcttcttgggaagtgagaatctctattacccacctcccattgagactcactagtgttgttttcgatgatttcttaatttagtggagagttaatatatatgactctctgttgagacataccacgtgataaacaatcatgtaaaatagtctcatgcacagaatcatattatattctcgtgatgtcttcacaacattgcacagatgatgctaaacgtaccagtttggactttgtactttgaatttggcactggaaggtgaaacactatctctttcagcctttttgacttcctttgagcttcttttctctgagattcactgaactcaagtatctgataaaatggcaccatcgtcccaattttcagttttagaaagaggacacatttcactatcagtgccagcctgtgccacattccatccatcaggactcagatagccagggctataggaaaatgctttaagattttccatccaggacttgcacagctttagaggaaagaaaaaagaaattagctcctgacctgtgccttgagtggtaatagatatttctccaattcatcatatattttggatttgttcccatatattatttaatttttaaaatgtatgttagatggcaaaaactgttagagccctaatatgtgtcaatattgacagttgtcagatgagaaattttctcatggaaatagacttagtcatttaacataaaccatcacagaggaaaaataaaagtcaacaagctttaaaacctccacccctaacaaatgttatcccaacaaataatttatttttcagaggactaacatgacttaaatttatttcattatttattatattaagaaatacctactaaaagatataaaaagactgtctaagcttctctaagcctttgtagagagctgactttttgaggtgccaacattccatacttgctgatcaaatgaaaagcaacatgaaatgacactctatctatagcacatttttcattcattgcacagagctgggctgaggcttgttttaaaaagtagcagattttttttttaagaagtgtatttgtctttatgtggtgacagatagtctttgaaattataaagtatggaatagcagaattggccatttgaaatcaggaaatataaatttccccaagtcaaatctgagagacagagctcactcgaaggttctttaacatcatcacagtacaggcctgccactttgaattctgtagctcagctaggagggctaatcaattcctaaaggcagagggtccatccaatcagcatttcttactttgattggggtgtcaggtgtattaacatacgcaattgatctataccacagtgtaagggctatgccacattcatgtactttgcacctcataaacaaggattatactcaggtgaatgagacaaatttttcactttatagctgggagaaaaagttcgtaaaaggaactttgtgctgtggaagtagtcagtcattgcactcctgagaggatatcattaattacagttatgataaaggtgaataaatagagccatgcagttataaaatatattttactggttgacaaggtaaagaaaaattgatagataatacaatgtgttgacaagtctatgtggaaactagcattcttatacagatacctggttactaggcacataaaatggtgacacatttttagggagtcaatgtcaaaataaagttatgaagagtagattggagtcagcaattctacttttagaaatttattatgcacgtatatttgcaaggacatgaggacatgatattccttgcaatactgttgaagcagaaaaggcaaactagatgtttaatcaatgtgggactggcaaaattaactgtgatttatccaaacaatggaataccatctaccggtaagattatatagcagtataaatgctatgttcccttttgggtaaaaataggaatatatatttatacatccccccaccccccacacacaccattcatgtaaagtcccttataagcttttctatgtattatatccaggaaatatttctggaagggtacataggaaactgctatactgctgcttctaggaagggaaactgaggcctggaatgggaaagtgatacactttttattgtatttattattttatacagtcagaaagtttctctatgtccatgaattgttttttatagttagaaatatatatatttcagaagtcaattttaaaatcctattttttttgtcttacatgttactgaagataaaatctcccaataggctaattggacaaaaattccggttgtggccacctcttactgtgtgagaggttatggcattaagaatgttcaggccctggccggacgcggtggctcacgcctgaaatctcagcactttgggaggctgaggcgggcagatcatgaggtcaagagatcgagatcatcctggccaacatggtgaaaccctgtctctactaaaaatacaaaaattaggtgggcgtggtggcacgtgcctgtagtcccagctactctggaggctgaggcaggaaaattgcttgaacctgggaggcagaggttgcagtgagccaagattgtgccactacacaccagcctggcgacagaacgagactccgtctcaacaacaataacaacaaaaaacaagaatattcaggtctcacctgtgcctttccttcctggtcttctagacaaataataataacaatgtggtttggcagaaatgcatttagttgtcatatactttctgcctagaattcttcttttcttttggaaatatcatcgtctttctttgggaacccctcttaactccctcaaccacatgtgtccagcaacagttggcagtttttacctgattaggcttccttggccaggattcccagtaaggacaatagaaaagcccacccttcactgagcttgtaattaggttgatattaagttgacacacacacacacacacacacacacacacgcacacgcacacatcaagaacattatttttcaaattagaaataagaatattttgaaaatgatttaggaatatacttttgtgtatgtttgcactgtaaatagcacaagatgccaaactctgagaatcgtatttagtgagattaaaaatttaacatttctgtttgaaattttgtttaattgtttgggtttctttgaaaagaaatttttccattaaagattccagagatgccaagatgaaaaatattgctttaaccacattggagtaataccaacaagaataaaaacaacaaaaaagctatgggaattatgttacatatttgcttttctttttcatcaaagcaaatatattttgtattatactgtgacctcatcctgggacaacctctgagaactcattgattcctattcgacagtttattatttgctttcatgttgcctgtaatataaatgcacccagcataaaaagtttttaggtacccatttaatatgatgggtataaacattttactgaccagaactactgatattttcacccataagaagtctccttttcagtctgaaaagttttcactgaagtattttgatatgttctaaattagcattttttacaatagcattgattaaaataacaacatgaaaacaccatgaatatccaacagtaggagactggtttaaaagtagaggaaaggtcaagtagagttggaatgtttcttttgagaaaagggcaaaacctagaaatgttggtaggatccgattagttgtggtagagggcgagttcaaatgcatgatgatcgaaacctagggtctgatgtcttgtccaacacggagagattggagggtaagtaaatagacataccagccaagctggaatagatattcccacctgcaaagtcctgaatgatacttttggaactgtatggtggaccaaattataagaagccataaatgacatgatgatgatagcagtgctgaagcaaaagaaatctggtggctcagtgaaaaataaactgaactggggagaaagctatttatataatgcaacctgaggggtgacagaaacaatgacagaaactcatgaccaatcagttattgcaatcgttaacaattactaatatttatttatttagtacttagtatgggaacaatccttggtgtttcagagaaaaagtatcatttcatttcattctcataataaccatgaggaaactcttattacccctgtttatgcagggaagaaaagagaggttcaaagaatttaagcagcttgtccaaagtacccaggtggtaagcagtggagtcagcattttacactagactttatagcgccaccatgctgtgctgcttaacggggtttgacgtcttgactccttccttatcctgtgtctctgacccacccttaccacttttgtccttctcaactctcctctaaccaggctgccctctttgctgttcctaaacaagccccttcccaccccagccttcattgctcttcttcttcctgagtcccaattcctgagtgagccagctggcttttccctcactttctttgagaacttgctcaagcaccttgtcagtgaggaatcctgtgcccttcctttgtaagtcagtttcccaactgtcctaatatctttatcattctctatttttcaccatagaatgtatctaacatgacgaactatgtatttactcaatacttgttgactgtcttccacgtcccccattagaatataatatcctcgagggtaggagattgcctgatattgtctgtttttttcacccctttacttatttcaacagcaggcacaaagtggacatttagaaaatattcgttgaatagatgaatgaagggaacacacaaaacattgttagaaatttggtttaaggacttgtccctaagccagcaaacctatatcctttgctagacagtcagtcagcccatgatggtgtagatcgtatctcttcagctttatattctcaatgtctagcacagtgcaaaatagaattatgtactctattaaaactcgtgtctcaagcatggtaggtatccacgctagacatggatggaaactttgcctccacccacctcagatggtggcccacttggagttttcatttttctgcctgctcactcctttctatttgatggccaaaacttggatctatgggctcctgagtcactcatttatttactgaatgcatctctacttctctcctttctcagggctgtttttgtctgcaccgtttatttgacatttcttatttactattttatctttaattttgtgtgcattcatatcttttctgtccaacttgatgttttagtgatttgtatctctctgatattactttgtatcatttatagaaggatgtgcctgaattagtaaatgaatgaatgaatttgatggtgaaaaacattttatgacagggagtgagaaagaagataaaacaaccatgcctaatgattaggtagacagagttagccacctgaagatttaattaacttaaatagaacttacttaatagactacttactgcaatcccccaaatacctctggaacagaggcagaggtgaaatttatagcatcctctgaaagcagaatgtgaacgagaaaactctcataagattttttttctaagtttgagttagttcgttccttttttaatttgactagttttcattgagaaagaaattttaaacaaaaaaaaacccctcaaatataaaaatcacacagaatattttaagtacattacttattaatgtgtgttttaggcagtgttccctttttatgtttatgaaattttatgcttgcttttctgtttcagtatacataatactaaggggtaggaacgctatttgcaatgactggttgcctgaagcaatgctaacctcatttctgtatattctatagaagggaatgactgtggatgttaagaagctcagaaaaggagggttcttggagaaatgaggtatgtggctgggtgcggtggcttatgcctgtaatcccaacactttgggaggccaaggcaggtggatcacaaggtcaggagttcaagactagcccggccaatatggtgaaaccccgtctctacaaaaaatgtacaaaaaaacaaaaaacaactagttggacatggtgacatgtgcctgtagtcccagctactaggaaggctgaggcaggagaagcgcttgaacccaggaggtagaggttgcagtgagccaagattgagccactacactccagcctgggcaatagagggatactccgtctaaaaaaaaaaaaaaaaaaaaaaaaatgaagtatgtacttttgctgaaaaaaaaaatgcagtcagagtccaatttggggatatgctaaaagcacataattggggaagcttgtgctagtgctcatgaagtataattcttttgagaaatgacacagtgcctcttaaaaactatcgagctcttaccaaaaaaatgctcaataaatcacaaacagaatgcatgtgacaaactaaatgaatacaagcagttccaaagatgtatgattcagaaggttgacccagttgctaatggtctgattagctggaacaatttctatctagagtgtgccagaaacaatctgaaagtgatcagaataggcatttaaagtcaaaaccaaagcgtttgccatacattcaaaaactactttctgacttgtataaattaatttcactgtctcctgataggttttggctcaccatgtcaaattctggcaacttagggttattatctattttatttgcctctagagagaaaagctctcacccagatacagacatctgtttgctcttagcactattgtttctttctgggcttgccaactttgtcactttaaatgtggcatttaaaatattctttcaatatgacagcctaagtatagcttgtgataaaaagcaatcctctaagcaaagttgggcaaaaacaatttttgagaacaagaaagcaggtcaatatgaaatgaatatgttatactcagaaatgggatctgtgagttcttgtagtctcatttaacaaatgtctttttgataggcttaattataaatcaataaaagtgttaaagaggaaatccctgatgcttaaaaaaattatttgttgatttaatgtaatttgtcgttaaaataattgcctctaaagatagtatatcaagcacactaatgaattaaaaatgaacttagcagttaaacaaattttcatgtaaaacattaaatctattttgaaaattcacacattgctagattcaatttaaaaattaacctcaagccagtttagagatgtatgtactgtaatttatgtattataaaagttataatgtatatttgcaacaattcatttgggactataaataaccataatggcaccaagaaaaaaggtgacatctgaaatttatttatctaaatgatacagatttctaacaatgtaagatcatttaggttgtctccaaagacagaagtaatacgcaactatattggattggatgtgctaaagacagctgagaactaaatatctgccattaagtccccagagctcatatcagaaatggcatgttgtcctcatagagatgtggactcaacggtttggtaaatatttttatgtacatgtagactcagaggggacatttggcagtcatgctggcagcttattttcaaatagtccaaagagtaaaggaatgtttattttgaaattacttttcggtttaagtactttaaagcctagtgttacccaatcagaagtatgtgtgtgtgttgaatttaaagcaatacattaaaccttcttttctttctagagtaacagaactaacaaacattaaaggtgtcttttgctgccactttaaggctgtttaattaaaattagaaagacaattaatggggaaataaaccagcattcacagagagagtgcaggcctgccaaagtgaaaaggttttatttaataaggaaatagggaaacacctaaaatcggttgtttatttccattgttcctggaaaagaattaagatttgggattccaaataccatcagaaatgactgcctttggggtattgttgcataaggaaaaggcttaaatatctaaaaattaaatcccattgtcagatgcataacaataaacaatgagaaggttaaaaatgactatgctttttcaaagagctgaatctctgccatggccaataaattagattactcatttctaaactacaattatctaatgttgcaggaactgacatttacttataaaaggaatacttagtaatgatgacaaagtaatgatgctctctggactagattattgtatgatttttatgcttcctgataatagatatatgattgttttatcattactatgtatttttggagttctttagtactttcatttaaaaaaaaactttcaagttccaacaaaataaaaaataggtcatggctttctccgtgctttcttcagtttccaagagtgtatgtctaacatgtgatttggtcggactggcctcctgtggactatctttgactgactcatatggttcattccacttccccttcttaagggtaaggttcatatctttaagcaattagaaaaaaaaagcctaccctgttgaaaataaaacttacgtttgaggtaacacattaagactacactgcagtagattatagccacttattcaatcaaaagcatacagtatggcttttaactcctactctgttttgaggcggggaggtgaagcaaccaggatatattaaataactataccagagagaagaaaatgctgcaaaaatgagagaataagacagaaggcaaactttctaaacttctcagcttcgctgtgaattggctttgcttggattgtaactgggaggaaaactgaaaaggttaatggtagtaggtttcttccttgaagctgacaagatttacactttttaagaaaaggatttatacttttaaagaaaagcaaaatctataaaaaggggcctcatttctcagatgtggtctttgagattatccctctacacttggcctgtctctatctttgtctcctaattttctaaacgcagaagtcatccctattaagccctcacatgtctgctcagccctggcctgcatgtcctgtctcagggtgacaggttactaagggctagagaaaatattgggagtatatccagtagttcagacacacagccttacaagcattctttttgtgggttcagccctggccctgttgaccctcaagtgtccagccctggatcctggttttgagtcccagctctgtcacagattcttagcactgtcctggccccaccacttacacggctctgcagcagtaccctgaaaactgctggcttttctctctgacactagtgccttctcatttagacttgcttttatctcatgttccaatcatgactggcttgataatatgaaacttacagatcctcagatcatctccttatcctggctctgctttctggacacttggctccatggttccctctacttggcttctcctttgtccatccatttttcaacttccaccagcttcaggggtctgcccagattcccgacctctatccccatcctgatatctcctggccaggacatgtgggaccacactgccatcacctgggacctttacaccttgttttatccaagtaaaatagaagtaaataggttttttgttactgttgttgttgttgattattaaagtttcatattttattgacatactaagattggctttaagtcattaaatcataaatctttaacaaagatgatagaaaattcaagttataatgatacatcaggatcaaacggaatttgccccaaatggttcatacatgtttaatatgtttttcacttagctctaagccatcagtttcagtcatgttttctggtaggagaaaaggaatcagctttattacatgacaggctcacagagtcatcaaataagtcatctgattggctcttactagatatatactgtaaggtctgattaggagcaccctgcctgccatcaagtgggtgggggagaaggaaactgagctgaccactgcatatgtctcaataatttcttgctctttagcaaaactctatgagcttcaggggggttatgaggggggtgttcttaataatttctagaagttaatccatgatactaaaggaatttgtcaattattttttgtcagaaaaaaattatggtctcaaatggctcatatatccctctaaaaaatcagattgtagaatgtagaaccatctaaatataagcatattaattcaccccaatgctgaggtgagtaaagctggagattttcacatcttcacagcaagagagcaattagtcaaaattacaatgaatcaaaacttggaaaattttcctatcaatttcctcatgaaactgaatgtctaataaaccttttctaaaaaaccaggatagcatatttctatgctttttaaaaaattgttgaacatgaatatcaacaaataggttgtagtaaaattactttagttataaaactacattatattgtgatttcatttttattcagctaagttaatactgatcaattctctaaactacatttattaacaaaggctagaatacaaaatattaagtcaaaaataacattgatttgtagtccagctgatttgtgtctgaagaacacatttcaaagtttggtcatttaaaaagcagttctctttagtactactccttcatatttaggatacaagagaatataggaaataatagaattgaatactaagaatttttatatccaaatttcttatttctttctacaataaataagtttcaccaatcttttccatcagaaatatcttaaacttttttctttggaggggagatttcttaatgggaaaataaaatctattttattgaagagttggcttttaacaaactggtgaatctgaaattggtaccaggaaaccctcactgtgaaggtaaccaatacttacgaaggactactggataaaataatttggtgattggtactccttatcttcaccaggagagaaaaaaaggcaaatataggacaagcaggatatacttttgtcctacaatgagtccatgtagaatttgaaattagatctatcctcctaactttaaatcccttgcaaacttagtgagtgtcaccgagtctgaagtgttttaaaaaaacttaccgtatatatttagggtttaatacatgatgtttagatatacatgcagataatgaaaaggttaccatagtgaagcaaattgacatagctatcatctcgcagttacccttttttgtttttgtgacatgatcacctaaaatttccttttagcaaaaatcctgagcacagtacagtatttaagtatagtcctcatgttttacattaggtctctagatgtgttcatcctacctatctggtactttataacctttgacttacattttcccactcacctcctaatgctacaacaaacatgagtatacaatttttcccttgagatcttattttcaagtcttttggaaatatacacaaatgtgggcttgtaggatcatattgtaattatatttttaattttaaaaggaatttccatattgctttttatagaggctatgctattttgtattcccaccaacagtatggagtcttaggttctccatatcctcaccaacacttatttcctcttttgacttaaaaataaaaataaaaaacaatgtaaggtaatatctcattatggtttcaattctcatttctctaatgatcataaggatgcagaatatttctcatatgtttcctggccatttgtatatctttgtagaaatatctagtcctgtgtccattttaaaattagattgtttgtttttgttgttattgagtggtaggagctcttgatatattttgggtattaaccccatatcagacacatggctcacaaatattttctcattacatatgctgtctttttactgttgattgtttcctttgctgtgtacaattttgaaagtttaatgtagtctattttgcttttttttttttttgtctgtgcttttggtgtcatattgaagaaatcattgccaacaccagtattatgaagctttccccctatgttttcctttaggagtttatggtttcaagtctaatccattttgagttaatttttgtgtattgtctaaggtaaggtgctaactttattatttcgctggtggatgttcagttttcccaacattatttgttgaagaaactaccttttccctattgtgtaaccttcacacctttgtgaccatatatgtgagggttatctctgggttctctattttgctctattgctctatatgtctgtttttatgccaataacactgtttggattaccgtagctgagtaatatgttttgaaatcaagatgtgtgaagtctccagctctgcttttctctttcaagatggttttggctgttcagagtcccatgagattccatacaaattttagaattaaaaaaaaattaatgccattggaattttgatagggaattcattgaatctgtagatcactgggtagtgtggatgttttaataagattaagactttgaatccataaacgcagggtttctttgcgtttttgtatgtcttctttaatttctgtcagcaatgttttgtagttttctgtatacaagtctttcacctccttggcgaagttccttttttttttttttgatgctattgatactattgtaagtggaattgttttctttcacttttcataatctacttttcagattgttcattgttagtatatagaaacacaactgattttttgtgtgctaattttatatactgtaactttgctaaatcgtttattagttctagcagttttttgtggagtctttagggttttctacatacaagagatttttttgtaatttttttttttttttagctcatcaactattgttagtgtattttatttgtggctcgagataattattccagtgtttcccagggaagccaaaggacctgtcaaagagacagatatgtagtaaatagtcacaaaatttttgaatgcatgcttgcatgcatgaacaaatgagtgaataatctgatgatgtttataagcataaaaatttactcttaatataagttttaagcacctctttagcttgagattctggagctctctccattttgctttatcacctagaaataggaaactacttttatgtccctaaacatggtatattgtttcatgcctgtatgagtgtgctcctgctgctccttctgcttaggatggttcttctccacttggtacaaatggcaaggttctatgtatccattagtacacagctggaaggccaactttcctgtaaagccctcactgcaactcctcttcagagaggaaaacatccccgactctgagctatatgcatgcttttgaccttgcgtatgcttctgagattcactgtaccacacacttttttgcatatatcttgattatattgtacaaatctttagggaaggatcaaaggccctctattctttgttttacataacttacactgtcgctggtattcatcagtatttcaagaagaaaaagttgaatattatagaagctaatagaggtgaggattaagaaggaggggctactagttggtaccatatgtaggaaatgattcagagatacgataattaatttggagagtagtattaatagaaaaaataataatgctagccttagacacaaggggatttagagacaagagactatatgataagcaagaggatgatatagtcatttttgttaagcatataagatatgcctataataagaattgctttattgataatacgtctaatattgaatatctaatatgaaatatatgtggagggcattttccctccttccaggttcccatccatatatatgaaaactccctttagcattgttttaaaatttgatatgcaacaattgtgaaccacgattttaattggccctcaattgatcactatgatatttaattttttttatcaaatattgtaaatttgatcctatagtgtggcttttatggaaggcagtcttcaccacagaccttgatgaaagactatgcttatcacatgaaagattggcattaggcaagcagtttgaagtgtcaggtatttgtaattcaaaagattaagcacgaagctttaggaaaatacaaatgaaattaaatgtgaactgtttaacctcaagtaccctttttcacacaaccaatttacacatgtttggcaagtatgtccaggctcaaaaccttgaaaccaagcatgctgcaaaaccatatgtatatgatttattaaaaaacagttacagatgtattggacaagttctaaagttgattctgtaagcagaactagtggaagagcaacatagtgtgtagagacatggttaagatcatgagttctgcagtcaaactcttagttcaaagctcattccaccccttaatcctataagatgagcaaaattacttaatttcagttttatcatctatagaccttgagatctcaataacaccaagctcggtgagtaattgtgaagttgaaataagataacgttttgaataatgtctaacacattttaaagactcaataaacatttgctgttattattctacacaaaggaacattaatgacaatataaccaaattagaacagagagccatttgttaagattgttaataaaacctattgtatttatttcctactccatgccaggtgctgagcaaggtgctctaggtaaataattttgcttaccttcacattatgttatgagtattattaaccctattttataaaagaggagattaacactcagagatgttacacaatttgctcaagatcatggaactagtcagtgcagatacaggttttaaacccaggtatgttagactcctaatcctgtactctttgcatacttttttaaataatggagtttagagtctgacaaatggaaaagttgaagaaatggtccttcattgagtacttgttaattgtactattgtacgctttcacatcagcctatgctacatctcaaagtttaatcaaatcaatttccgaacccaggaaaagatatatgaaaaaaaagagtacaccaaatatggtttctctaaaatagccctgggttctcaaaaggaataactgaccttggtgcaaaagttgaaacaatgcccctaattctgttaggccactttatgaaatctggggattaagagctttgtatagcaaaatgctatggggccagaaagcttctccctctattccatggggcagtgaggtgaatggtgtacaattagggaaggaaagggaggcacctaaactacaatcaaaagagacaaggcaatgtctggaagataaaacggtaagatgaaagaaatttctggatggccaggggtcaaggtagagctattagaagctaataaattgatattaccttcaaggaaacatggagctaaaccctcaaaagaagttcttcgaacatactcttttcctaaaaataaatcaatataccaaggcccaccaaagttcctgtgcccttactccccatctgtccccattcagtatcagaactttcacaactgtggtttccatggccgctcaacttgaattcaatgtctctgattttggaaacctaacatttgaccctctgctcccacttcttactagcaagactcctttgttcccactcaattcctcttctatttactgccaatcaaaattattagaatcaacaagaagaaaaccaaataacgctgttaaaaagtgggcaaaggacatgaacagacacttctccaaagaagacatacaagcagccaacaaacattttaaaaaatgctcaacatcactaatgatcagagaaatgcaaatgaaaaccacagtgagacactgtctcacattcatcagaatggctattattaaaaagccaaaaaataacagatgttgggggggttgcagagaaaagggaatactcataaattgttggcaagaatgtaaataagttcagtccctatgaaagcagtgtggagatttctcaaatacatcaaactagaactaccattcaatcccattagtgggtatatactcaaaggaaaatcaattgttctaccaaaaatacacctgtacttggtttatcacagcattattcacaatagcaaagacatggagtctactcagcccaatagtggaatggataaagaaaatgtggtacatataatcatggaacactacactgttataaaaaaatgaaataatgtcctttgtagcaacatggatatagctgcaggctgttatcctaagtgaattaacacagaaacaaaaaaaatcaaataccacatgttttttcttacaagtgagaggtaaacagggggtacacatgcacatgaagatgggaacaataggcactgggaactccaaaagaagagaggggaagcagataagggttgaaaaactacctattgggtactatattcactatttgagtgatgggttcaatagaagcccaaacttcagcatccatgtaacaaacctgcacatgtatcccttaaatctaaagtaaaaataaagttgtcttagagaaactaaatttccaatgtttctctgagatgtacccccactctgtttgtgtatctgttcactttttttttttctccacaggttgccacaaccctaactttcctggccaaattcaaaatctaaaatattgcatacacacacaaaaaataggtttcagtccttggaaagagatggtgcttgcttcgtgggttaggctagcaggtgatagaccaatccgaaataagcaggcgaataataaaataaattataagaacgctatttaagagtttattaaaataatatggtgcaaagcacgttatattggctatctcgtttaattattacattctttgaaattggtattattttcctgattttacatgtgaagaactgaggcttatgaaggtcaaatacagtgtcaaaaaatctaaggcatctgacattgggataatgtggagtcctgaccccctccctgcccagggtagttactggaggtagtggcgccaggagacctgctgggcggctgactatgtcctctttcttgatctgggtgctggttacataggagtgtttactctgtaaaatttcaaaaagttttatatgccttatatgtatgttataattcaataaatctttaaatttttaaaactctaataatgttaaaaatacttgttcaaggtcgccgtggaagagctgaaatatagtggagatctgcctgcctgcagagcccaaatatttaaactgagcacactgccttctattttacagcctcaccagataatgtaaagagtgtgacactgaatctccttaaaatctggggttattactgtctgaataatcgcctcagggaaccagactggttccttatatagtggaaaaacgggcaaacaatcattgcagaaggaaacacttattatggatttgggaaaagaggatgttgaaactgagtctcagccgctgctgcagcaggaaccaaggcttggtttccaggggcctcaaaggctgtcaaagagaaattacttgacactcaacgttgagtttaggtttttcttccatcctaaacctgggtcgagcacaataaattggactaaaattccatgaccctggactggacaacagagtggaaatgaggctaaccttcatttagactcattattaggaacttcactcaaaaagaaaggaaaaagatccccccaaaagcatctaagccaaaaatgaagtagaaaaagaaaaagaggaaaagcttcaaaccaaaagggctagtcagagaggtgaaaacctatagggcacagtagacctgaaaccacaggaagctaaacagagtgagaaggctctggttttttattgggggcaagatttggaaagatttctgaagtgctatgtttttatccccaggtaggagcaaactatgcagggcaccagctggtttgggcccctctgcggtggcatcccaaatggagctccttttctctaagcatttagtgactacatgctgcttgtcccacagggaaaaaagtgggtcataaaacttgttttctgtttcctaaaatgcctaataaaatgctttcacaaattctgcatgtccagagtcagtgacataaggcacactggttccaataaagccttttacgaagtatttgacacctgtccacagctctattttgacctgggacaaatccagaaaaatatggaaacttcaccagtgcctttccaataggtgtttcccaagcttcatagacaagtaatcgccatgctttttccactgaaatatttacttcaatgtcactttgagcatggcaggtcttagcttaaccaggccatggttttcattcccttctgcagaatttgcataaaacttagtcagagcagggcaacacactggtggatctcagcagcgcttccttctttagttgtctgaaatactttatggcaggctgcacacagctcatcttatttccattgctttagacacatatgaggtgttaacatcatttaatttttctaccataagggagaggctctgtccctcaggagataacatatttggactcagtctaggaagttaacacaaaccacattttagtacctgaaactttcaaatccatgctggcaaaaaggaaagtcaaaagtcaaaattattgttggttacaaaatgaaatcagaacagggagaaacagtaattgccaaaaaaaaaaattaaccaaatctaaaacttttttgtgtctgacactgaaaggcatgatgaatgattatgataaaatggcgataaggacctttcccttaaagggttgtcataagatgagaaagattgtatataaagctcccagtgagtgttagtatgtgctagacaaggttctaaacattttacttgtattatttacttgtattatctttattcctcacatctacctaggaggtaggttctcaactgcattttacaggtgtagaaatccaggtacagagaagtttatatttcttgattcataagtcaggattggcaccaagatattctagctccagagaccacagaattaaccactgcttttcagaactggccttagtatagagaggagttctgagcaagatcttgactgatggagtttgaccaggtaggggcagcaggagatgttccctgcttcagccagagggatctatctatctatctatctatctatctatctatctatctatctatccatccatccatattttctttctttctttctttctttctttctttctttctttctttctttttctttctttttaacctttaaattcagaggtacatgtgcaggtttgttacatatgcaaacttgtatcatggaggtttgtggtacagattatttcatcacccaggtattaagcctagtacccagtagctagtttttcttgatcctctccctcctcctaccttccactctctgaaatgctccagtgtgtgttgttgccctctatgtgtccatgtgttctcatcatttagctctcacttatacgtgagaacatgtggtatttggttttgtgttcctgtgttagtttactgagaaaaatggcctccagctccatccatgtccctgcaaaggacatgatctcgctgaaagcattccccttgaaaactggcacaagacgaggatgccctctctcacctcttctattcaacataagttctgggcagggcaatcaggcaagagaaagaaacaaagggcaccaaataggaagagaggaagtcaaactgtccatgcttgaagatgacttgattctatacctagaaaatcccataggctcagcccaaaagcttcttcagctgataaacaacttcagcaaagtctcaggatatgaaatcaatgtgcaaaaatcaccagcattcctatacatcaacagccagtcaacccaagaaccaaatcaggaacgaactctcattcacaattgttgcaaaaagagggatttttgtaactggtatccttctaacacaacttattttatgttcctgcttaaaatccattaagggtcaagtgcaaactctgcctctctctctaactcatactgggtttttggttgttttcttgctgttttattttttgtttccttaatgcattatatttgattttgccatactctattggagttgcttgaatatgtctgtctgtgaaagactagaagcttgtgcaggaatggtccatgttcgttgtctctctgttctactcccagcggtaggtagtaatatttaaaatattaaattaatagtaaggcatagacaccaatcaatcagaatagacattgaagtaaacagccagtgggattctgtcactgtatagccatcgaactgggtgccagaccaatagtgggtacttattatttatgagtgaatgaatgaatagatttaagaatcatagcacttgacattttttgacttctgtttgtctcacccttggctccagttatatcctttttcttctaaatcacatatttaaattatattttatgaatctttaaaagtgaacttaaatcccttccataaggatggaaataaataagtacataaaactgttggtgaacactaaatattatttataatgatcatctaaggattgccaaagtctaagctggaatgaagactaggctgtgagttataattcctccttcttccaactatccagccttccacctgttgtaaaattaggttccttctggtacctaaaattctatctaagagctttatttcttggaattaaaagttttacctttcatagattaactgctaaattgaaaattatcctagaatgggtaaatattaaagaatgtaattactattagaatcctagccttcattagttttattgaatttctctccaactgataccttgagaataaaaaataaaattaattaaaaaggcacacattaaataatgctgcatattctgtatattcattggagtaaagagggcgagattaatctaaagccgttttctaaatgctaaatacaatacctgactacattacaaggaatgggccatgtattttacacatgaattctgatgcccagatatttaggttttaaaaagcttccacttgatttaaatgcatagcagctaaatttgggaagcactgggagtatgggttcctgtggcaaagttacctctagatagggaatcccacggccttatctgtgcattgagttcccgagatgagaaggcagacacaaggtaaggaaaagtactaaaagggcatggcagcacacaatatagtttctagcttcagacataagaaaatgatttgtttgaatacaacatatacttttgaaggccagaaagtgccctggcctctggaagaaaatcttttcagcatgaaggattgaagcaaaaggtatttttggtcaaatacttagtcaaccagaacatttaattaaccaaaacactctaatgtcacagcattccaactgagattttgaagcacaaataaataagacattgaagcctgaatagtccctgttctttattctctccctttcaaggtactataatgacttttatgtttttaattagtgcctaagtaatacttatttctacattaaaaatttcccctataccaagtcagtgctaactcatgacaaggccttagcaagttatttagctttcttggccttcgttttatttatctgttgggggtggggacgagatgtttttgaagttctttttttgtcctaatagtctaagattctttgataaatcagctataggcacaaagtctaggaaagctgaatttgtggttatgggccagtggaaaataattctcttcagagttatagacaaacatttgtgaccttaaagacacttataccaggttggtgaattccatcataactcccctccaggactcatagctagtcgtgtcaatgttgatttgtagctataaggttggcatttgtacaactatttttccaaacaagttttccaattatgtaacgtatggtttagttgatattaatcaaggatgactgaagaagcagttcttccatttttatagtgcgtatgtgagtatttgtgggtgtggacaaggagaaggcgtaacttcctgtatgaacgtacccttagaattccagtttcattctgaatgcttttatgataggttttctaccatgtaggtgggaaattttcaaagtgtgctctcctaagataatcagagtggccgtaggggaaaaaataaccatagagtttataccttctgccacattaatttatttagtcttctaaactggcagggagttctgtcttcttgcttcaaattcccatgtgctcatttaagtattcaccagccctttatgatggtgtgttaacagattctaactgttcaacagtcatgtaacggtgagttgcttccttgacataatagttaattcaggcttttatcctttcgtctattttttagtttaccactgagaagcattatccatagttgaactttcttaaatggactggtcattttaataacagaatttttggggtacataatggttaattcccgaatattttattttgagccttatctttgaaagtcattttaaaactagtctttgtccacttttctaggttagcaagtactatgtgggtactcagcctctgatgcgttaatgtttgttaagagaacgttattcaatctttcttcaattcctgagaattttctgtaggtttagggtatcattgtaaatatcgttcctaatttttcatggctatagatataaaaggtagaagacattggagggagtctccaatcactgtgaagaacttcttcatttctgatccttccaatatggaagcaatgctgcttccaaccacagcaggtcattggagtattctagaacctgggggtcctgcttcactactgatgtcatctcacccctaaaatcatatcatgaggcacttggaacaagatgtctcctagagtctgtcttctcggatgctcggcatattgttttgtactccctcccctgggattaccttctcattgccaacatccctcccttccatgatgttttaagccttttttgcattggaaatagacctctatatgccatccacctcttagaagattgctctgtcctgctaattgccttctctgaagtgtgattctttccagaagcagtacataaccattcccttttttccataacctcattagcatctgatgttcttttgctttttagtaatagtcattctgactgttgtgagatggtatctcactgtggttttgatttgcattgctctaatgattagttatgataagcattttttcatatatttgttggccaggtatatgtcttcttttgaaaagtgtctattcatgtcctttgtccatttttaatggggttgttttttgcttgctgatttaagttccttgtagattctggatattagacctttgtcagatgcacagtttgcaaatattttatcctattctgtaggttgtctagtctgttgatagtttcttttgctgtgcagaagctctttaattaggccccagttgtcaatttttgtttttttgtaattgcttttggggacagtcattaattatttgccaaggctgatgtctagaatagtattccctaggttttcttgtaaggcttttattgtgttaggtcttagagttaagtctttaatccatttttagttaatttttatatatcgtaagaggaaggtgtccaattttaatcttctacatatggctagccagttatcccagcaccatttattaaacagggagtcctttcctcattgtttgctattgtcgactttcgtgaacatcaggtggtttagatgtgtgtctttatttctgggctctctatcctgttccattggttgatgtgcctttgtaccaatatcatgctattttggttactgtggccttttagtatagattgaagtcaggtaatgtaatgtctcgagctctgttctttttccttaggattgctttggcaatttcggatcttatttggttccatatacattttggaattttttttctaattctgtgataaatgacattggtagtttgataggaatagtaattgctttgggcagtatagtcattttaacaatattgattcttcctatccatgagcttggaatgtttttctatttgtttgtgttgtctctgatttctttcagcagtgtttcgtaattctccttgtagagatcttccttggtaagctacattcctagatatcattcttttttttggctattgtaaatgggattgtgttcttaatttggctttagtttggacattattggtggatacaagtgctactgatgtttatacattgatttgcatcctgaaactttattgaagttatttattgattctatcatctgttaagagacattaggttgcttctgtatcttaactattgtgaattgtgctacagggaacatgggagtgcagatatctattagacatactgatttcaattcctttggctttcaattcctttagatccagaagtgtgattgcaagatcatatggtaatgtttaaggaacctacatagtggttccataatgggagtgctaatttacattcctatcaacagcgtacctgtatcaaggttcccctttcttcatacccttgctgtcacttatctttcatctttttgataacagccattctaacagctatgaagtaatatcacattattgtttaaatttgtgattagttgtccttgatgattagagatgttgagcttttttttttcatatatctgttggccgtttgtatgttttcctttgagaagtgtctgttcaggtcctttgcctgttttttaatcaagttttttgttttcttgctattgagttgaattccttatatatttcggataattagtcccttattagatgtgtgttctgcaaatattttcttccgttctgtggattatctgtttactctgttaattgtttcctttgctgtgcagaagcttttttgtttgatgcaatcccatttttctatttttgttttgttgcctatgctttggggatcatatcgaacaaataattgcccagaccaatgtcatggagagtttcccctatgttttcttctgatagttttacagggtcttatgtttaagtcttttatacattttgagttaattttgttgatggtgtgagataagagtccaattttattcttctgcctggggggatgaacaactggagtcataaattcatggttttattcagcaaatatgtgtttgcttgttgggcttgttggatgttccaggtattgtgctacgtgctagggtagcatagttaagctaataatgagcaagacatagttaagaaacgttccgtttcttcactctagaaatctacacagataagaaaatgaacaattatagagaaagcaataagcaaaggtaataagggagcagagataagggatcacttaactcagagacacacatcagaggaggtaatgtctgacccaagccttgagtgttctgacgcatgaagggaagacaaagggtgataagatgatagtaggagatgaggacattccagttctcagcatgacattgggagggcctttggtgtgctgagaaaactaaacattacgttgagagcaacgacttcttctggctatttgaggtgatataagtgtataagggttactagattccttaccaagaaattcaaaagcaaaggggagttatgaaagagacatgttggccgggcacagtaggtcacacctgtaatcccagcactttgggaggcagaggtgggtggatcatgaggtcaggagtttgagaccagcctgaccaacatggtgaaactccatctctactaaaaatataaaaattagccaggcgtggtggtgtgcacctgtaatcccagctactcgggaggttgaggcaggagaatcgcttgaacccaggaggcggaggttgcagtaagctgagattgcaccactgcactccagcctaggtgacagagtaagactccatctcaaaaaaaaaaaaaaaaaaaaagaaagaaacatgttaagacttatacttccaagttcaccgaggtataccatgttcatgctggtaaagatgtggagaatgtactagagagtgaagactggaggctgggaaagagttaggaagatgccttgaatagttcagggaagaaattttaaggcttagaaacagggaatttttgtcccgggatgaagttgaacaggcggatagagaacccagtgattgatacatagcaggtaaggtgaaggggaggtttctagcttggatgaataggcaaagagtgtgctcctaaactgaccaggttaattgggattaaaaggaaatatatcaccctgaaaccaaggatggcagacaaggaggagccatggataaaactttacagaattaagtttcagaaaagatgatcgggttggtctggccaagctgcgttgccaccacgtcagagggtgcagctgcctatggggactcccatctggcaaccttgacttatacccattcttcttttaaacttccctggctcttgggaaatcagtatgcatcacagttcctgacaaattaagagtccagagaatacagcaattatatgatctaatcatactaatgtttcaagttgtcataaagttactaaatttgtatctaatatcatttaagtagtaactaatataaaagtatttcagcatcagaatttaaaatgtgaatctgtcattatgcatagagttttctattcacagcagttctacttatatccatatacacgatgggctttgccacttacacatattgaagctaggatgtcaattggatagggctcacaatctcaaactcatggaaaatttggtaaatttatctctaatgcctattcttgtaaatgacagatttttcactgaaaacagggaatcgagacaaacatcctatgtagacttcttaaagatcatgaaatgattctaagttggtgcaaaaaaaagtctcaagatgcctgtcatgaatctctgcagaactctgtctgaattccatgttacaaatgcttcccaattatggtagtaagatatggaagaaaatatgaagaagtaacaactttttatagcacactagtatatcataaacacatatagtattcattttattactatattattcttcctttaatacacataatacttaaaaaaattttttagcttagaaagattataattttttaaaaactcagtcagttccataagcctttattaatattttctatggagatatgagattcaactgatgtcattttttctttttcttactgcagagtgccttttcaggaattaattctgctgttagagaagtacctatgtcttcagagaatgtaaaggtatggaatatgttcactctgcttaaatcttccttgggaactcatattctttttctctagcaatggttggagcatgtgttttggagcacccctgggaataaaaagaaacaaaacctattctgccattggcatttggcttccccaatgttttcacttggtaggtagctagtagaatgagaagctgggaaattatagctacagtcagtcattccttggtatatgtgggggattggttctagggcacctggagtatacccaaatctgtgtacactcaagccctgcagctggccctttggaacccacatataagaaaaggcagcccttgatatatgcaagttttgcatcccaagaataccaaatttttgatccccatttagttgaaaatatgtgcgtataagtagaccctcgcagttcaaacccatatttttcaagggtcaactgtactttaatctccatgttcatcagccaaatataccatgcaattgcaaaattccaaaatcagtatttcctcctggggaatttccttaacatttactctcattcttgttgcctagataaaacaaaactatgaagaatcttagagaatcctgtctggataaaacacaattagataatttcagattgcatttgagtaatgattagacattcttttcattgcatagtattttaatgtcttttattgcttccatggaaaatgttatttatatatgattttccatataggcatattcagtgctttcttaaatcagccataaaagtgaaacagccagataattaaacacaaagaacgatagatgtttggatggttcttaaatatcatattttaaatttcatacatttgtgatcagtgtgatgatactttaaggtcaataagaaaccattttctgctgggtttggtggtgcgtgcctatagtctcaaccactcagtaggctgaagtgggaggattgctcgagactatttctgggctgcagtgatctatgccaattgggtgtctgcattaagttttgcctctatatgatgaccttctgagagctgggtactggcccagtttggagacggaactggtctaaactcctgtgctgattcattggtgccatagtggctgtgaatactgaattgccactgccccccagcctgggtaacatagcaagatgccatctctgaaaattatttttttctcagaaagagaatacatttcccagccttatctgctgcctacctcgtgctgatcagtagtgccatggtcgctgtgaagagtgaattgccactgatccgcagactgggtaacatagaaagatgccatctctgaaaattatttttttctcagaaagagaatatatttcccagccttatctgctgtctacttcctcaattcttccccctctcatgacagctgacagcaaaggcccatgatttaggatcctctaaaatcccacctgggaaatgacttcttgctgacaggaaattttcagagctaaaatcatgtacaaaaagcaatggttactttttagaataatagctaaaatataaaatacagtagaatcactttcattgattaattttttgtttgttagttattcactcaacctacagcaatgacatagccagaaactccctgttcttaatgacgtagtgggttctctgcctgacaaagggcaccactgtgcttcagggcgcggctgctgaattcctctggctttgggttcaaatttctgctctattgtttactaggtacataaccttgggcaattcacttcacttttctgtctccattttctcttttgtaaacagtgaataattcagtaactactcaggttgctgaagcattgaatgatataggcacatcaagtgttagcatggtgcctcatatatggtggttaattattacaagtaagataataacacttggttactgtacttactagtgctactctttgaccaccttggggggaaagaaaaccactaagataatcccccttatcatgagcacttcctctgttgaaaaactcagtagaattcatcacaaagaggccaggatcagataagaggccagtcatagtctagtctttggccacctctgaactcctctgaactcccttgagcatgatatttgctgtacagccctacacagcaaccctggtaaactgcgaatttgtggcaaaaaaaaaacccaaaaaacaaaaaacatagcataacattgttggcacaaatgtttacatgttgccttatcaaaatgttgccacctgtaggtctttaacgttattttgaaaaataacacttttaaatttttagagaaaatatctgaaatggcagattcagcgtcattcatgatcaattttagtattagtgcataggggagccctgagactattttcctcaatagttgagtttcctccatcataggtatgactaagggaatagaaagatgagaattactagaaatttaaaggagcgttgtcagtgaaagttatataaattgaataaaaaatagagtgatattagtgattcaccatttagatggactttttctgccaatttaggtcttccttgctatcctgcctccacattccctaatcctaatacatgtttgctcatgccttttgtgctgttgccataataagcagcccaaccccagcccttatctgcaggaaggaaactgggggtagcaatagctgaacaagaaccaagttgaacacagctatgagcaacacagataagcacagggacatgtcccatatgcaggatggactacataatatgtggggcccagtgtaacataaaaatgtgaggccccttattaaaaaatgttttagaacttcgagatggtgacagccaatcattaaatgaaggatcaggctcttttaagtatggaaccctgtgaagatgcacaggttggatgcccatgcagctggtcctagacatttttccttccctgttactgctagtcttatctgtacaggaatggcctctggtggtccagccttttaccatgtccatggaagtttaccttattgtaaaaccaagtaagtattcaggttttaatgccagatacatgatctagctaatggtttaggattaaatgattcttcttttctaaagcctcagagacacaccttttaatcaactgtcacccccgcattgtctgaaaactagacgtagtgtataacatatgaatgtatacaaaagaagaaccctcaggagttaattctcagcatgcaatggaaaatataaatggaaataccattgtaaggcaaaaaaattcaacaagggaaccatgaacttcaggtatattattttaatttgaatcagttatcttaaagaccctatgaatatttaagcattgtttttttaaaggctaccgtacagtgagttatacaagtaaaactggaaaactcttgacattcttaatatttgtgagttgcatgcccctctgacaacctgatgaaagtcataaaactcatccaggtaaatatatgttcccataaacacacacacacacacacacacacacacacacacgtgcttcccaagcaccttgagatctgttcaggaacttgaggctaaacaaatccttgctctgaaacaaagcttctgttgctgatcctgaaggactcaaagggagctattttaaaacagaaataaagatatagattttatcttatggctaaatgaagttaaataaacaagttggggtcaggtcataaaggatcatgctaatgctttcttttcttttttagacggagtctcactctgtcgcccaggctggagtgcagtggcgcgatctcggctcactgcaagctccgcctcctgggttcacgccattctcctgactcagcctcccgagtagctgggactacaggcgcccgccaccacgcccggctaattttttgtatttttagtagagacggggtttcaccgtgttagccaggatggtctcgatctcctgacctcgtgatctgcccgtctcggcctcccaaatgctgggattacaggcgtgagccaccgcgactggccaatgctttcttaaaacatgttttgtgcagaagaattttaaatacagacatctcattacacacctaactacgtcagtattcagctcttaaaaataaatgtattttcctgcatagccaaaagaatgatttttaatatctagcaaaataaataatttcttaatttcattttagacccagccaaaataaaatttctccatttttttcctgttttgtccaaaatcaagatgcaatctaggatcatgcattgcatctagctattataccccttaagctgcatttagtctagaacaatcaagattggtttcacataatttattggagagagcagatctctgaatttatctgatggcttctaagtgtgttttaaatctaactctctcttttttttaattaattggaagttcaatctaacagcttgaacaaattagctatttgtctaagtatactcatagctatttggggctagaatgcatcgcacctgatgctgtggttaactgcactacaataaggacagagtctgtcccctgtcccaccactacaactgctgacactggacaccgaaactacagagccacagtctgagccctccactatgctgttctatttttcccttatgatcaaaaagtaaactgtgtagtacaactatagcattgtatagagcttcaattctccttcaaccatttaccatgtcgttttaattctaaatgagaatctatgaatgaatcaattactgcaaaagtgtgatttttttctaattctacattccttctatgttaactagatgttctctcattacttggggatactgggataatcaatttcctactgaaaaaaacaggatagtttttaaatcattgattttataagaaaagatttggtttaatacctaacccaaatgataatatatacacttttggccttataaaaagagtttaattgtgcattgagggatttttataaaatcacttttaagccaactacaaaaaattattctttttgatgttcaatatatcaaaacactggcttgtgggagccctttcaagctgtgtctacttttaagataacagcattcaattttgaaaattatcttgagctcaaattatacaaggattggtctgtatcttttgtgtctccagtcaataatcaaccatttcttcaagaaactgatgcctttactggggaatgatatcagagaccaaaatgtctctaagtatactcattgatattgggggtaaaattacatctaagccatatcaatggacgtagcaagaaaatatatttttaaatcataaattcatttgtagattttgaattcaatactaacaataaaatacttttatataacttctttggttttgtaattgtacctcttttctcttgaatattgaaaatcttgttatctaatagttaataacatttgttggcgtctgtacttgtcctgagcctgttttccctcacatcaaataggggaagatacccttcctttagtgtatcacctttgcaggctcccatgtcagccaatagcagtcactggtgggattgggaagtaggacaaaggaagaagccagagtatttctaccttttctgtctgtcatggaagatgcttctggatatgactgcttctcatctggggtttcagtgctccaggataggctgacctgagctccagctgcaaacaggtgatctggtcctctgggctctgaaacccatctttacgtttcttgctcctctaacctaagattggagaggcttcctgtgtctctaagatctgggtggcctcgttatctcctcctggcttcttagttattccattacctatgtagcttattctctaaattacatacccttttgaaaaagagagttttattgtcctggttggaccttgatgacagagctttataatattcttcaaataaaatagttattaaataaatactcctaacagtaaaactactaaagaaagtttaaaatgcctttgtcatttttttccctatagaatgcatccctaaagatgtagtcaaagatctatgctccaaagtcactttaaatattctttctctttgtgattacattaacaatttatatacagtaatgtacatttgctttagtgtgtttctaatttgtagggattcctttttcttttttatcttttttaaaaaaattagagccatgcatttacatggtatgaaagtcaaaactaaaatgtatacattggtgcctctcctgatttttaaatgtatacatagatgcctctcctgatctttctcacttaatttcccctccctgctcttcataattaaccatttttttagctttttgttcatccttctaatactgttctttttgcaatatatacatttcctttatttcttgtataaaagatagtatgacaaatacactattttgtaaatactatttcattaaataatattatcccaaaaaatctccccagagcagtacatagagatggtcctcattcttttatgctgctgcatattactctgtcatatgaatgtggcacaattaattcaggctattctatattgttaaattcttgtgttgtttcccatttttgctacaaaataatagcaaaatgaacagctttgttcatatgccattttagatttctatgggtgtatttataagatagattcctagaaacaggattgctggttcaaagtgtaaatgcatgtggactctggttagatttggcaaattctcctccacagggcttgtaccttactggaatcctaccaacaatgcatgcaagtggctatttttctagtctcaccaacaaggcctactgctgttttttgtttgtttgtttgtttgtttgtttgccagtctgctgggtgataaatgatacctcagcgtatttcttttgttatgtttgaagttgaacatattatcacatgtataaaggccatctgttatttttctataacttatctgttcatatgctttaacattcttgaaaaaaaaataatgggaaaaaacattggcctagaagttagaagatcaggctctatcataatttttcaattcactagtcatggttttcaagcagatcagaaactttctctgagccttagtttctatcagtcaagtggttctgacaataaaataaatacagtatattaatattattttggaatttgcaatatatattcacttcttctttatcactcaaaaatttatatttcacatttgattcaatatttttttcctctcctctctcttaacctttggagtctatgtcctgtagcttataatcatcataaaatttggagagaaagctttcatgattttcagatgtcccacttctactgatgatagtgaggtagaaagggtgtctcctacataaaaattcaacaaccagaaattcattttaatttctactattatgcttttttatttatttggaataaaacagagagatttcacagactggaacatatttactatgctaaaacctgaagactggtgcaaaaatgccagaggaagatgataaataagagtcctaatcttgattagacaactaccagaagcactaaactgcctcttcctgaagtttccatgggtctgggcagtggctagagtgctttgccattgctggatgtgtcctcagtcagagtccaaagttccttttgattgttgtttcaggaatcttccttaaaaaatgagaattataagggaaatggtaaaaattcactcctcttagaatattagcttttttgacactgttaattggcaaaatttgttgaaggagaaatgacagctgtttaaataactagactgcattcattttaattattgcttttggcagggttcaaagagtttaatctttcctaaatccctcggtaatgtctgctctctaaaaggttcagttaccctggacaagatcttcatcagctacttgctatgcactggcaatgttacttgatatagataagctagttgaaagggtaattactagacaaagaaatgtaagatatatgctaatctaagttctcaaacagcttcttaacaaatatttagatcatttaccttatttatatttatatttgctgatacacatcaaatatctcatcataatttcctcatttgccctctgtagatctagattctcttaaagcaaaatgtaacaaacaaaagtaaactgactaaataagtagaccgatatctttcagtctgaatctataaatatgtagtattgtcctgtactaatgtgtttttaagttttttaacctatagaattttgcagaactgtacttttgtatactttcaacttaaaaatactacataaaaggaaagccaaagttttaaatttgacaatcatttggtaaaaataaccagagaagccttaatttctcaaacttccatccaaattattttcataacaattgtgttaaatgcttatgtgatgttttgatttctttgctcaggaacatctccacttaaattcaatgttctgaaagacatatatgatgtttcttataagattaataagatgaaggaaaaggacaggaaaaactcaagagtcaattatgtaatttgcatttttagagacttgattgcaaaccttaactaaaaaaacaagtcttagattagattaactgaatattcatttaatggcagaaaaccagaacttttttaaaaaaaggtttcatgtttgcaggtcaggcggaagcctgtgtttttatttttatactcaaattctctgactttgtcaacatgaatataatatctaaaagagagatgtgcccttatgatgagtcaagaggcacaatagtttacagttagttcctttttatttggactaatggctataggtggtttatttggctaaacatgatactgaatcattggtaaaaacattccattaggtatataattagtgggcacatgagagagtagcataggaaatatataattaactgtatacattatactaaaataagaatgtgtataaaagaagttgactccatatcttgaaagaattttagagattaaaggaactcccacaacagcaaatgttactaacatagtagtatatttgaatattgtgatttagaaatgactttgtttacctattttttttaagatggagtatcattctgtcacccaggctggactatagtggtgtgatcatagctcactgcagccttgaattccagggctcaagccatcctcctgcctcagccttccaagtggctaggactacaggcacctgccaccgtgcccagctaatgttttgtttgtttgtttttagagatggggtcttgtttcattgcccagtctggtcttgaactcctggactcaagcaatgctcctgcctctgctgatattacagacattagtaactgtgccctgccagaaatgacttttaatagagtgataatttgaattatttttcaaatattcattatttcagcattttccaaactattagctgtgatacatggatgcatgatgaaatttacaatctttatctttattaaaactcctggatttttccattagccctttggtactttcaattctactgctcaaccaaacaattgatcaagtatttactagtacctactataaatagactcagtactttgccacatgctaaggatggtacatacatatgtataacacatagttgccaaatttaaggaatttacaagtgtttaagaaacaaagaaaataaattgatatgaaaaattagagatcaaaacaaggtaggcaccatgaattctaagatgtttcaaaggagaaaacagtttgccttacatttgcctacagtttgcaaaatcatctagcaacacagtacactgttgagtttcagttgtttaccctcatgatcccatggctgactgggagctgtgggccactacggcttcccagcaccttgagagagtatcgtactgcatgtggctagccttggaagagatcaaaattcaaagtacagtttctacttaatgcatatcacttttgcaccattgcatagtcaaaaaatcttaagttgagacatcataagttggggaccatctgttatctacatacaaaagagtgaagttgaatttctacctgataccaaatatgcaaatcaactcaaaatggagcaaatacctagatgtaaaagctaaaactacgaaacacttaaaagaaaataaacgggtaaatctttgtaacctgggattaggcgatggttactgtgatataataccaaaagcatgagaaacaaaaaatagatagactggaattcatcaaaggtaaaaacttctgtttcaaaggacactgtcaagaacgtgaaggacaacccacagaagtggagaaaatttttgcaaattatattttataagagatttgtctccagaatatatcaagaacacttcctattcaataatttaataaaaagacgagccaactttaaaaaatacacaaagcgggggtggagccaagatggccgaataggaacagctccagtctacagctcccagcgtgagtgatgcagaagacaggtgatttctccatttccaactgaggtactggttcatctcactggggagtgttggaaagtgggtgcaggacagtgggtgcagcgcaccgagcgtgagccgaagcagggcaaggcatcgcctcacctgggaagtgcaaggggtcagggaattccctttcctagtcaaagaaaggggtgacagatggcacctggaaaatcggttcacacccaccctaatactgtgcttttccaacagtcttagcaaacggcacaccaggagattatatcctgtgcctggctcggagggtactacccccacggaccctcacttattgctagcacagcagtctgagatcaaactgcaaggtggcagtgaggctgggggaggggcgcccgccattgccgaggcttgagtaggtaaacaaagtggctaggaagctcgaactgggtggaacctaccacagctcaaggaggcctgcctgcctctgtagactccacctctgggggcagggcatagacaaacaaaaggcagcagaaacctctgcagacttaaatgtgcctgcctgacagctttgaagagagtagtggttcttccagcacacagcttgagatctgagaacagacagaccgcctcaagtgggtccctgacccccgagtagcctaactgggaggcacccccaagtaggggccagactgacacctcacacggccgggtactcctctgagacaaaacttccagaggaacgatcaggcagcaacatttgctgttcaccaatatccgctgttctcagcctccgttgctgatacccaggcaaacagggtctggagtggacctctggcaaactccaacagacctgcagctgagggtcctgactgttagaaggaaaactaacaaacagaaaggacatccacatctgtacgtcaccatcatcaaagaccaaaggtagataaaaccacaaagatggggaaaaaacagagcagaaaaaatgaaaattctaaaaatcagagcacctctcctcctccaaaggaacgcagctcctcaccagcaacagaataaagctggatggagaatgactttgacaagttgagagaagaaggcttcagaggatcaaactcctccgagctaaaggaggaagttcgaacccatcgcaaagaagttaaaaaccttgaaaaaaaattagacgaatggctaactagaataaccaatgcagagatgtccttaaaggacctgatggagctgaaaaccaccgcatgagaactatgtgacaaatgcacaggcctcagtagccgattcgatcaactggaagaaagggtatcagtgatggaagatcaaatgaatgaaatgaagcaagaagagaagttgagagagaaaagaatacaaagaaatgaacaaagcctccaagaactatgggactatgtgaaaagaccaaatctacgtctgattggtgtacctgaaagtgacagcgagaatggaaccaagttggaaaacactctgtaggatattatccaggagaacttccccgatctagcaaggcaggccaacattcagattcaggaaacacagagaacgccacaaagatactcctcaagaagagcaactccaagacacataattgtcagattcaccaaagttgaaatgaaggaaaaaatgttaagggcagccagagagaaaggtcaggttacccacaaagggaagcccatcagactaacagctgatctcttggcagaaactctacaagccagaagagagtgggggccaatattcaacattcttaaagaacagaattttcaacccagagtttcatatccagccaaactaagcttcataagtgaaggagaattaaaatccttcacagacaagcaaatgctgagagatttttgtcaccaccaggcctgccctaaaagagctcctgaaggaagcactaaacatggaaaggaacaactggtatcagccactgcaaaaacatgccaaattgtaaagaccattgaggctaggaagaaactgcatcaactaatgagcaaaataatcagctaacatcataaggacaggatcaaattcacacataacaatagtaaccttaaatgtaaataggctaaatgctccaattaaaatacacagactggcaaattggataaagagtcaagacccatcagtgtgctgtattcaggaaacccatctcacatgcagagacacacataggctcaaaataaagggatggaggaagatctaccaagcaaatggaaaacaaaaaaaaaggcaggggttgcaatcctagtcttggataaaacagactttaaaccaacaaagatcagaagagacaaagaaggccattacataatggtagagggatcaattcaaaaagaagagctacctatcctaaatatatatgcacccaatacaggagcacccagattcataaagcaagtccttagagacctacaaaaagacttagactcctacacaataataatgggagactttaacaccccactgtcaacattagacagatcaatgagacagaaagttaacaaggatatccaggaattgaactcagctctgcaccaagcagacctaacagacacctacagaactctctaccccaaatcaacagaatatacattcttttcagcaccacaccacacctatcccaaaattgaccacatagttggaagtaaagcactcctcagcaaatgtaaaagaacagaaattataacaaactatctctcagaccacagtgcaatcaaactagaactcaggattaagaaactcactcaaaactgctcaactgcatggaaactgaacaacctgctcctgaatgactgttgggtacataatgaaatgaaggcagaaataaagatgttctttgaaaccaacaagaacaaagacacaacataccagaatctctgggacacattcaaagcagtgtgtagagggaaatttatagcactaaatatccataaaagaaagcaggaaagatctaaaattgacaccctaacatcacaattaaaagaactagagaagcaagagcaaacacattcaaaagttagcagaaggcaagaaataactaagatcagagcagaactgaaggaaatagagacacaaaacacccttcaaaaaatcaatgaagccaggagctggttttttgaaacgatcaacaaaattgatagaccactagcaagactaataaagaagaagagagagaagaatcaaatagatgaaataagaaatgacaaaggggatatcaccaccaatcccacagaaatagaaactaccatcagagaatactataaacacctctatgcaaataaactagaaaatctagaagaaatggataaattcctcgacacatagaccctcccaagattaaaccaggaagaagttgaatctctgaatagaccaataacaggagctgaaattaaggcaataattaatagcttaccaaccaaaaaaagtccaggaccagatggattcacagccgaattctacaaggaggtacaaggaggagctggtaccattccttctgaaactattccaatcaatagaaaaagagggaatcctccctaactcattttatgaggccagcatcatcctgattaccaaagcctggcagagacacaacgaaaaaagagaattttagatcaatattcctgatgaacattgatgcaaaaatcctcaataaaatactgccaaactgaatccagcagcacatcaaaaagcttatccaccatgaccaagtgggcttcatccctgggatgcaaggctggctcaacatattcaaatcaataaacgtaatccatcatataaacagaaccaacgacaaaaaccacacaattatctcaatagatgcagaaaaggcctttgacaaaattcaacatcccttcatgctaaaaactctcaataaattaggtattgatgggacgtatctcaaaataacaagagctatctatgacaaacccacagccaatatcatactgaatggacaaaaactggaagcattccctttgaaaactggcacaagacagggatgccctctctcaccactcctattcaatgtagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatataaaatcaatgtgcaaaaatcacaagcatccttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagttaccaatgacttccttcacagaattggaaaaaactactttaaagttcatatggaatcaaaaaagagcccacatcaccaagtcaatcctaagccaaaagaacaaagctggaggcatcacgctacctgagttcaaactacactacaaggctgcagtaaccaaaacagcatggtactggtatcaaaacagagatatagaccaatggaacagaacagagccctcagaaataatgctgcatatctacaaccatctgatctttgacaaacctgagaaaaacaagaaatggggaaacaattccctgtttagtagatggtgctgggaagactggctagccatatgtagaaagctgaaactggatcccttccttacaccttatacgaaaattaattcaagatggattaaagacttaaatgttagacctaaaaccataaaaaccctagaagaaaacctaggcagtaccattcaggacataggcatgggcaaggacttcatgagtaaaactccaaaaacaatggcaacaaaagccaaaattgacaaatgggatctaattaaactaaagagcttctgcacagcagaagaaactaccatcagagtgaacaggcaacctacagaatgggagaaaatttttgcaatctactcatctgacaaagggctaatatccagaatctataatgaactccaacaaatttacaagaaaagaacaaacaaccccatcaaaaagtgggcaaaacatatgaacagacatttctcaaaagaagacatttatgcagccaacagacacatgaaaaaatgctcatcatcactggccatcagagaaatgcaaatcaaaaccacaatgagataccatctcacaccagttagaatggcaatcattaaaaagtcaggaaacgacaggtgctggagaggatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagatacatgcatatgtatgtttattgtggcactattcacaatagcaaagacttggaaccaacccaaatgtccaacaatgatagactggattaagaaaatgtggcacatacacaccatggaatactacgcagccataaaaaatgatgagttcatgtcctttgtagggacatggatggagctggaagccatcattctcagcaaactatcgcaaggacaaaaaaccaaacaccgcctgttctcactcacaggtgggaattgaacaatgagaacacatggacacaggaaggggaacatcacacactggggcgtgttgtggggtggggggtggggggagggatatcattaggagatatacctaatgttaaatgacgagttaatgggtgcagcacaccaacatggcacacgtatacatatgtaactaacctgcatgttgtgcacatgtaccctaaaacttaaagtataattaaaaaattacatttatagaagatgaaaataatattaaatccatagattaaattcagttttactcaaaaaaaagaagaaaaggaaatgaatggactgtaaacacccaagttcctgaacaagaaatataaatattcacattattcaagttaacaaataaatgtaataaaagctcataataaatattttccaatagaaaaaaatgtacaaaggatctgaataagcatttatatatctaaatgcttatttatcttctaaataagatatatgtgtggtaaatacatgaaaagttactcaacatcattagctatcaggaaatgcaaatcaaaaccacaatgagctaccagttcatacccactaagatgctataatatgaaagataattacaagtgttgataaggaagcagagaaactggatctctcataaactattggtgagaatgtaaaatggtacagacactttggaaaacagtttggcagttcctcaaaatgttaaacatagacccagcatacatatgtttcaagataactgaaaacatatgtccatacaccagtatgttcatgaatattcttagcaacattattcataataattcaaaagtataaacaactgaattatccatcacctgacaaatggatgaagaaagcatggtatatgcaaacaatgaaatattattcagccattaaaaaagagtactgatatacgctatggcatggataaaccttgaaaatattacgctaagtgaaagaaggcagtcacaagactatatattgatatgaaatgtccaaaataggcaaatccatagagataaaaagtagataataattgcttaggactgggacttggattgggggttgatgggaaatgtgtagccataccctgtatgtattagcaaatagatacaagggttcttctttgagtgataaaaacgttccaaagttgatggtgttaacagttgcacaagtctgtgaatatttaaaaaaccaaggaattctatgctttatatgagttatattttaatgctgattttaaaaattagtatgattataactgggaagtttaaatagtaccttcagcccatatggattccataaatacaaaaataataccattttattataaacaaagtaggaagtcctaagaaagagaattttagactttgagagaaatttagaaaatatctagtcttatttcctaagtgccccattttttagaaaagcaactttaacaacagggtggtggttaagtctatggattcttgggatgacagacaatgggtctccatcacttgatgagtctccatcactgatgactgagtcattctgggaaaggcatatgaactcgcagcctcaatgttcctatttacaagaagggggagaaggcagaatatcgcttatagtgtagttattataggattacatgagatacacatacacacacatgctagcacaaggcctgaaatataaagagtgctcaatgaaatttagctaatgttataaaagtgtcttcctctacctcaagttacgtatgtagtggagctgggatagaaaaaaatttggttttcttctcttctattctctttccattgtatcgttataccaaagattgaaaaatactaaattattctacccagaaagaatgtgaacagctctgatgccaaatcactttagagtaattgatgttctatgattttcagagtcaacagacagaatgaaggtggtcttaagattttaaaatggtcttgtggtacttctgtcacatctagaagtatagtttcgctaagacagtacttacaccctagccctggggatcatttttctttcctctgaattctcactcttgtttgacattctatctattacatgtgctaatctgataagatgacgtaacatgacatctgcatgtcttaggtaatcaaatctgaaaaacaactttaggaagcaactagctttcggtatttatccacagcttatcctctgagagaaacagagaataatagctgcaaatatttcttagagttttgatggcattctgcatggttataaggaattggctcctctcatacatatgtttttgaggttacatgattaatttgattatttaccttggcaaatgttatcatagtagcattttgattagcagcaaataagttatttctacagaggtgccatgtgagattatctaggtgatattacacagtaggtaggtattaggaacactttataagtgtgcacttatgcactgctgattagattaccttttgatgcaactgttctgagggggattttggcaaaagatctcaaaagccttcaacctttcactcatcatttccactgccaaggatctgtctaacaaaaatcacgaaatatattcccaaatatttgtttattaaaagttgaccaaaagattatataaaatcatgacatcttgaaaacaactcaaatgttccatcatgatgacttaggaaataaaattaaacatgtccatggtttgtatttaaaagattgtttataataccttatgtgaagattttacataatatgtaaaatactgtaatgggtttcagaataatattcataatagggttgcaataattttaaaataactctgaatacattctatgtgtgcatatatgtgaatacatatatgcattaaactttatcatttggacttgatttgcaaagcatcattagtttttttacttaacctcaataattcctttagacatgtgagctctgcaaatctatggactttgcagcagaatgcctttcttttttttttttttttattatactttaagttctagggtacatgtgcacattgtgcaggttagttacatatgtatacatgtgccatgctggtgtgctgcacccactaactcgtcatctagcattaggtatatctcccaatgctacccctccccctccccccaccccaccacagtccccagagtgtgatattccccttcctgtgaccatgtgatcagttcatgtcctttgtagggacatggatgaaattggaaaccatcattctcagtaaactatcgcaagaacaaaaaaccaaacaccgcatattctcactcataggtgggaattgaacagaatgcctttctttagaaaccactgctatcagaataggaactgtgaaaacaaatgagaatgctctcatacagttattttatggtctatcagtattaatgaattgtactcaattcaccctcagtttttagagtctgaaaatgtagataccatgaatgtttatgcaagagttttttaatgagtattttcagtgagacctattattgtgttaattgaatatagaaatcctttatattaatccttgtaaaatataatgatttttaaaacacagtagaaaaagtggaaggtcttgtctgcctgatgtgctcccaatgtgatgtggtatatttgaaagagatccagttgttatcaaggtacttttcttggtattcttctacctgtcatccactgctaggccttaaggcttggcaatcttttaacgtcttacagaattataggacatatatcagactgcatatgtactagatatgacagacagtggtcattctctaagtcttgtatatatttcctgtttctgttttgagtaaaatgtccaataccactgggaatgcctatttaacattgctaagagaacaagaaaatttatcttctttggatctaaccatctgagccaactctattttttcctaaccactttattgaggtgcagttgacatatgaaaagctgtgtatatttaaggtatacaacttggtgagtttgggaataagtatacagccataaaaccattaccatattctatgccatcaacatatccatcacttccaaaggtttcctctcattttacttattattatttttgtgataagaatgcttagtataagagttaacattttagcaaattttcagcatacaatacagtattgttaactataagtgctgtggtgtatggtagctctccagtacttactcatcttgtaaaactagagctttgtaccttttgactaacatctccttgttccctacccccaaccatcccctgacaaccaccattctattctctgcttccatgagactattttaaatttgccataaaattggtatcatataacatttgtcctgttcctggcttgtttcacttagcacaatgtccaccacattcatctgtgttgtcacaaatggcacaatttgcttccttttcaaggctgaataatattccattgtataggtacatatatatgtatataccacattttctttatctatttctgtaaatggacatttaggtcacttctgtgccttgtctattgtggacagtagaattaaaatcagaatcttgaagagattattaccactcccatgttcattgtagaactatttgtaatagccagctctattctttttccaaaagaaagctgaactcatgtgaatacataatgcaaaaactggaaagtataataattatacaaagaaatagagaagctaaaaaatcggcattcagtcattgcttttatcatctcattggtaaattccttcagtatgatggtgaggtgccttatgttaccatgttcttgcacaagcaaaacagtgacagtggtcaacaatgcccacatacactgaactgatggtatgcattccactatcaggtagctcttcctgtaagtattactctaacactacccatggcttctccccataacctctgccactctgaggtcaaagtaattcctagtaggctgcttcacagaaactattttgacaactgcttaaaaaaaaccatatatatatatatatatatatatatatatatatatatatatacacacacacatgtatctcctgatacacatatatatatctcctgatatatatgtatatctcctgatatatatatatatgtatatctcctgatatatatatatatatgtatatctcctgatatatatatatatatatatatatctcctgatacatacatatacgaatatatatatatggagagatatatatatatatatagagagagatatatatatatatggagaaatatatatggagataaatatatatccctttccatatatatatatctccatatatatgtatatctccatatatatccacatatatatatatatatatatatatatatcaggaacactatgccagcaaattagtaaactgaatgtttcttgattttttaaaaaaaaattttccttccccagaaagagagttgtatcaaacagtaaaatggctattttcttttcaaataatttacattgattttttgaaacatctttaaaattcacattaaatatcctaagagtcgatggtgtttttattttaacagaaagattaatgattcacccgaagttcgacattatgtataactcagaactcttcacagcaactttcaaataagattatcagaacttcttgcatggattggcacaggactctgggataaattatcctggtaagaattttgagacttactactctggacaagaaagataaactacagaggatgctggcttcctccccaaactgaacactatagatgctacataagagagagaggagaaagatgggtccactgaactaacatgataactggatttctgcagggaggaaaggcagacgtggtttgttgtgaaggagacaagcagcctgcaggagagacaggaatcaggtaacactgttggagcgaggctggcagaggaggttttaattctttagtttcattttttggtgagagagaatagaagcatcctacatggccacctattgtccaaggaataacctcagtacagtcccaacaagagtaacgagatgacggaaacaagtccgacaagggaatactaaattatccctacttctcctgttcttgtccccacaattgctccaggaactagtaggttatctccaccatcttctaagatgattattttagaattacccgatgaatttaatggcaattcctaagggacgtcattttcctggtagcatgtagtagcaatgtctgaggcattcacgaaaactgtagtaagcctcaaaggaagctttaataccttcccaaaagcgcaatatcacattgtctgtattttctatggtagaggaaaacttgaaattaataaaaagtagccagaaaaagaaactttttgttcttaaaactaatacgctttcctctgtctgatatgtttatttttattgagtataatttgttcatatccatccattaattttcatgactgtatgatacctggataatattgcataaggatatactaatatacgtgagaatgaagtggtttaagaaaccctcttccaaagagcctcaagtaaccagcagcctgggcgacagagcgagactccgtctcaaaaaaaaaaaaaaaaaatagaagtttttattcataacaataatgcaatcatttattaaacagctattatgcttaatttgtttcttatgtatttgtgtctaattcttaaaaacaacttctcacattcagagttaagtaacttgcccaatgtcacatggttagtagaggttgagtcaggatttgagctaagttttgcaagatcatgaagttcactctgtttatagcaataaccattcaagctgaagataaatgttgtctagaagtggatttgtaaagaattatgtatgtctggttgaaaatcatgttaagaacgttagtatacttgtatttttagaactatacaattcattcatgaaacaatttttattgaatgtttaccatatggaagacatcacagaaaatatttactgataaaaaaggaaaagctgtaatctctaagatttcaaatttaacaaacagctgtctacaaataacagaaatgaatctcctcaggagtcatcttgaaattacgctaaaatgcaattttcctttgaaactggaaaatccactaaatgagacaacatttggtaattggtattcttcagcaactagtaggctgcatagtggggaaatgaaaatagtaaaaccatgaaagaatagagggaaaaaaggcttataaactaaaccatcaacataaatggctcttctacctttttactgttggcatgtaatgtactaggcatggtgcaatttgcactctttaaaagtcatttctaaacaaaaaccttagagactttatctttcctagtaaacacttatgattataggtggggataagagacaaaattgtttatcaaagaatagtccttttatacagacagatgaataagaagtttcctctcattgaactttgaatcaaacaagtagcttaaatgtaaagagtttaattacaaacattaattccaatacagtctcggacattttagcatatacagtttcaaagaaaaaaaacttctaattcaaaactattatatataaaataaagcaaatattttctcattcatttcaaatatggatgtttgcttaagtctttggtctaagtaatatgaaacggtatactaactcatctaccgcagacactaaatattttaaactatttgatcttgaaataatataaaacaatatttatagttggagattttattttcctcataacatgagaacaagtaattcttttgatcattatatgccatgttttctttactaatttagagatttcttcatttatctttagatttatgtctctatttcacaattgtttaattgtaatacagactagtttatgcgtatatactcttgattatgttgtcaattgtatttatcatttatcaaagattatttttcattggtcatgtgtcaaaatatttctgacaagagacagagaatggaaatataagggtgtaatgaagtgaatttttatgaccagaaatacaaatccatgaaccaaaaatgattcatatgtgtctgtgatctttgagaattaggcttctcttattcgaagataaaacctataccaataaaatattcttacagaaaatgtagatttaaagcactttactttgaactctgcacaaagaatatgctttaaaatgttgagcaactgactgagatgtaattacatttgacgtattaaacctctctaggaattttcattatgatctttcctttgggcaaattgagcaagtctgacctttggcacattcaagtttgaatcttatgtcataacacattatttgaaaacaaactaaaaatacaatagaaacatctcatctcatgatgtctacatgaaatgacataaaatagttaaaactcaattatccataaataagcatttcagctttccaccaccaaaactagaatacaaaaactggttttgaataattatttgttgtgatggcctctcaactgccttcccacttttgggcctataaggcaggtcatactccttaacattgcatcataaaagtcagcttcagatagcgacaacattgaaggacattgtttgagacccctcagccaccagtccatttgatcttaagctgttttcaccctctggttctgctttcttgacttgacatccagcgcgtatccctctgttttgtctttctcttacggatttgttgctttttttccactcttttggcatttgggcattatgggctctgtcttaacccacccctttagtcttagcttctcttactgtttttagggggttatgctcctctacttctaagccctgcagaatagcatcccttctttggtttccagaaaagtcatcaccatgaccatcatcattataactaatgtgctgtctcatgtaatactcataacaacctgatgaagcaggtactattatttccccattttgccttggtcagttgtaactacatttgaatggctgaaaatgtctcatcgcaaggatctttctgggcataatgcctttgccagtgcttggagaccttgataacattcttgggtgtctggctgttactttccactgcttgctacatgacagatatgaacttaaagtgttctaataataaaatcaacttggctagtgcaggctaaaatttggggcttaggataagcccaattcaaggcagtgtttctaaactctaaaggcaatcttggtcatcagctgctactctgtttccattagtatatgtgacctcactaaaaccatctatcttcaaactaggtatagacttagagacagtaaaaccaggaacttttaacaaaagggtaccctccccaccccaatcagtattgtaggtacctgccaattttgacagcaacaagtcaggtcgggttgggtagtccctgaacagagcatgaatacatgttatttttagttcttagaatactataatcatgtccaggagctgagtgaaccactgacctttcctaaagagttaaatttactgaggaaaattaggaaaagagggaagaggggtgaaatttgaagtacagataaggaaacttaagagtcactacatatccttgtttgtcccagggggtattccaatccagaactgttcctaacatgtctaatagttatgattagttgaaaagcagccagggtcatagaagttggcctggaaatggtgctatgcaagctatcccaagtattttccatcattttatttctttgctcagattttctatatttttatttgttttaagaggatttgtaattgatttttggtgtgttttatgacagctgctttaaaatctttgtcagatattccaacatctaatttatcttgttattattggcaccagtggattgtctttcctcattcagattgtagcttgcctggttcttgatgaatgattttctgttacatcctggacattttagttcttatgttaggagacacttgatcctatttacaccttctgttttagcaggcagttgtcctgtttaggttctgcttgtcaggtctgtcctacttttattggctttagttccaatgaaagtttagttttctgagctcttgcaatgttattctggttgaatggttcttcatttttcgcatgctgttgggcttactgctcaatcaatgttctggtgtcatctgtggaagtggaaggtacttccttgggctacctactgtcattgggcaacctggagagggccactgaggaacagagaaaagcgaggatatgccatcttgttccagaattgggatccagcccaggtcatcaatcatccctctaagcgttcttgagagacttgactgccaaatgaacaaggatgttgtccagaaaacactcaggtagaagaacatctagatgacaactttcaatagagtattgtactccttttcttaaagtcagccttctatttctcagtcttaccttgtgctttctgtaaggctccagctttgtgaaaacccaggctccatggagttggccaggaggcctgctaccaggggattgggtagaaattccaagcagtaactccactgaggccttagaattcctggcacagataagctctctactttcttctctttgaagaaaatgtttatcccatagaggaaatagagggtgttttttattatttacaaaacattttattccaagattacctgtctacacaccactcaaaaactacttagtattcccgatgcttgttcaaagatccttctattccccaattatatctcagcgtgatttttcttcattttctggccctaatccagcacttgactcaattgtgctatttctgccttagctttctcagtatgtcctggcatctttttagtgagcgtgactccttctgtagctccaggtgtctcaacatactgctctaacagctttggccaggcaaggtccaagttgctgatataagtttacaggtcctcacactagttctgatttcctctgcagcaagtcaaatagtgctgatacttcagatcttacagaagtggggtagtataaatcttgcttcaaaataaaatttctcgtatacttctgtccctgttaattcatgcttatcctttattcctagtgatagggcttctcaaagacttgggtccatagctttgcgagtaccctgacaaagaaacagtaggtggaatgagcaatttatctcatacgtcttggttgataggcctgttgcagaacttcagtagtgattggctaagaagcaggctaattttttttaaaatttcaatagcttctgtgatactagcggtttttggttacatgaatgaattgtatagtggtgaagtctgggcttttagtctacccatcaacttgaatagtgtacatggtgcccaacaggtaatttttaagaaacagacattgcagcagatatttgttggttccattgagaggtattgggacaatgagagaaaaaaaaaacacatcttaatcttttcaccagctaatcctgacatcagattttgggagactttgttattgctgttctttgttgaacaaataactctttaatttacgtgcatcagacttatgtcacgatgaccttttgcttctttatccaataaggaattttgagcacactcttttctacatggcattataaggcacacatatgcaatgtttatttactatgttacattttctagtgatgcattattttagatttttatctaacaattatcataaggtgcaaaatggaagatctttaacaaaaagttataaacaactaccatatgccagggactgtgtaaaatgctggaaatacaatgatgtttttttggaaatatgaatctggatcccaggaattatgcagtataaaaaaagaaaaaatacaggcacacaggatgaaacagacaaaatatagcattataaaggcaacatcataaatatgaacaggagtagaggtcctacataagaactgcttttaagtcagtgaagactcaagacagcaggcgatatctgaattttgtgttgaggataaataggaatcaatcacataggaagagagggaagacatttcaggcttattaaagcctatgcaccaagtcacagaggtgtggaaaaataatacgaattcaaagctacaagtaactaactctatgatgctcaagtacaaagaagaacaatgagatgaggccaccaagtgctttgcatcccataagaagcttggattttaatgttctaaaaaataggagacctataataaattttaaggtagaaagagatgacaagatcagacttgcattttagaaaaatcagtgtgtattacacataatacttaatactttttaatagtaaatttaaatttatgatcttattcaaccatattgcctcttcaaagagaagaagagctataatgttatataaatctaagcataaaaaatatcaggcatcccatacctctcagacaaggctttatgtaagaacagctgagagcttccttctgccctcatgaaaccataaagagaaaatgtgttatcttaacagggaaaactttcttttacattttctaggaagactcacagccaaatgaaaacagtatattcctggaatgcctttaactgtcttgtcgtaccaggacttcttgctgagagagttcctgccccctgtaaacacagaacatgcttgtctgtgcttttaacttatatcctgtatatgtcttcctgacaactatccatacaagcggctttcattccctgtttccagatgagaattgaactcaatgcacatattgaaaggaaagaaacctaggttttatatatggaaatatccactcatgattggtgccttcttatggatacttaatagtactgatatttttatgttgcttgataaaagatgattgtcaaaagagatccacacagacagtggctataagagtgaagctgcacaggtccctttgtagcagtcagtctctctcctactccctgtctcatctccttcccctgccacaaggacccagagaagcaggcaggctggcagtgtgatgacggtatcttaccctggctctgaggttgacacagatttcacaggtcacttctatcactgcaaaagcacattggtctggagtttatgaagaacatacaatttctgttggcatgttaggtacattatataaaatgccccgcataaagaaagcagtgtagttaaaagcaaatgaaagataaaaagagtaacaacgtggtttctcagtatttcatggtaccggtagatatgaccttcacagacaaacctaaatctttcttatgtaactgacatttagtccgttagccatttttaataaaagagtagagaagttactctactgcggcttttgctggtactttttatagccgtcgtgtggtaggaagtaggccccaagttcccttggcaacaagtagagtagaagcgatacacagaaaactgagtcatcggtgaatcatctgaggatttctgtttccaatccttggaaataatttaccgattgttttttatttgtgcagtgtttgctgactctgagtggacacctcagaaactgtaacatctttggtcaatttggtcaatcgtttaagaaacattctggatgctccaagtagaccttaagattgatatccaaacaaaacaaacctctgcttgctttaagatgacactcactccccatctgaggaggaacagataagtgagtcaaggtattggcaatggggaagtcccctttctacaaagaaatctgatgtccccagaaaaatgtttcatgacattgtcacatttaaaatgttagtcacaacaaattttcagacacctaaaaagagaacaaatatggtctcatacattttctctctctcactctgtctgagacttatgttcatcagttactcaattcccccatttttttttttacaaatacatctcttatataatccctttatctccacaattgttgcttctaccttatatcaaggtttaccatttcatttatctaggctcagattgtcctttacttcattgcgtgtacaaggagaaagaaaaaacctcccctaaaaatgctttttggccaggtgcggtagctcaaacatgtaatcccagcactttgggaggctgaggtgggtggatcacctgaggtcagaagcttgagaccagcatggccaacacggcgaaaccccatctgtactaaaaatgcaaaaattagctgggtgtagtgttgcactcctgtaatcccagctactcaggaggctgagacaggagaatcgcttgaaccaggatgtggaggttgcagtgagcagagatcatgccactgcactccagccaaggcaacagagtaagactcagtcttcaaataaataattaaataaataaataaataaataaataaataaaataatgcttttcatctgccaccagggacctaatcaaaactctttaatagttcaatggcttcttgaggaccatgacttatttattattgtatctgcagcacccatcatggtgcctgacctacagaatatgttcaatatgtgtttattgaatgaattataataattgtggtatttttgcttatatgcacccccccaccacacacacacacacacacacacacacacacgttaaatctaaagcttcttgtgagcagaaggcttatcttgtaaattgttgtatccctagctcctcgaagggtgtctggtatgatacaaacattcaatcatcatttactgaaatggtgaatgaaattcaaatgctgggcttatacaagtatatggtatcctcccatacctaggtgaactcgtttctcaccactgccttccttcctgtgaggtgagcctttgtaccattcgaactccatgcaactattcctaccaattgcctcatatgaactacctcacacaaaccactgcctacttaaattctatcctcctttaaggcccaactgaagtcacattctgttcacaaatgagacttcttgactccttcagccctcacagatcttcatgtcatccagactcagagtacctatggcctttactcagatttgtccctacagactcattcttccattgtttgcctccttttaaattcctgggtgatgttatctatttccttcactttggcatctctcacatgttaatgccaccacactccttcatctcgggccctgatctcagagcatcaaaactcattgtttcgcaagtcctcaggctcaaaaatgttaagtgagttcatgtttttcgattctgaaggtatgttcattgtattgtttttgtcataatgagtctttttgcctttagcgtatatatgaaaatacttgtggatgaaacgatatgctatctcaaatttatttcaaaataacgtgggaggagataaaataaagtgggtatattattctatctcttattatatgtgcttgaactttttcataagtttttaaaaacttttgttttcctcaatcatcaccttccatcactttgaacctgctcttcttttgcttaaatgcatcactgtcccctgcatcccaactttctgggacactcaccaggggaaaacagagattgacatgtgaagctgagtcaattcagttgctcatgacataagtggttgagtagaagatactggtgccaagccaaacatttttttttatttttttgaaacaaagggaccatctatattttttaaagaaaaataagagagctgagttatcctgccaccccacaatgtttccaactttgtgactctctaaaaagaagacaagagaacatcccaaatccacggttctgttgtttccttttgtgaaccacctttcccttttctcatctacttagaaaccatctactgaagctttgagattctgctcaaccatcatcctgtctgttgtattcctgaatctctgtctcccataggcagaatcaaatactttttcattgaaattcctacaggacattatacccacttgcttttttagtactcactgtggaatataagttattagtttacatgtgttcggcattgtgctgatgtggatggagaactaacttaggtcatctccccaaaactctaacctctgagttttcctctccctcctttcctctccttcataccccaattagcatagtgtattggaaaaagtggatgttcaatgaaagtttgaaatgaatcagacagaatctaatttcttcatatttgttgctccttttttctcctaatattcatacatcaagtcttctttcctaatctccccaacccaaaagggctccttcttctgaactcacaatttttttttttttttgagataatgtcttgctctcttgcccagtggggagtgcagaggcacaatctcggctcactgcgacatccgcctcccagttcaagcgattcttgtgcctcagactcctgagtagctgggattacaggcatgtgctctcagacccggctaatttttgtaattttagttgaaacagggttttgccatgttgattaggttggtctcgaactcccgcctcaagtgatccgcccaccttggcctcccaaagttctgtgattacagcatgagccactgcgcccagcccacaatttttttttcccttcatagcacaaatgtcataatctgctttgattttggtgtgatgtatcccatctcctttcttgtccaagacttttgagaacagtgatcatgccttttcctcctgctactttctatacttcttgagtgcacttgataaatttgttgaattgaatatttgagtgtaaaagaaatgaggagaatctctctttcttatatgagatcagcagtaccaaagacttgaaatccaagatctctctaaatgatttcatgagctccattattcactgagggaataaagaggtctgtgtaggctaccacacttgacaacatgagtactcatgcagttctttaaggttttcagaattatgcaacagacttgaaccatttcattacttaattctcacaaaaacacaataattaaggacttgtatctccattttagagttgaagaaacaagttacattagtagcagtttcagagacagagttaagaattttatcccaagcctttttgtgaatccaactccattgtctcctcactcctagatgcctgtgtataaatgagaatgggcttagcccgtctaatacttctcacccattacaggtaatttaaagaagcattatagcaaagggagttaggaaaaatcttctgaaaccagattgtgttcaaattctggttctgcctagctgtacgacccaggacaagccaataatcactctaaagagggggcaaaaaattacttcaatcgccagtactctgcactatatgtaatggtttgcttttattactactttgaatatttttttaaagagtagagcatatgcaatatattttgtataatgggaaaggaagaagtatttagtagctttttgagatcaatttttgagactagttctaagatatttatggcattcacatctaaaatccctttcatattctctacaacctttccaaacatacttagtttgcaaaatcagattggaaattatacaggaatagtttttctcatagtatttcagtactttcagttccattccagctggagtctaaaatatcataggatgcagaaatgtaaaattatgtgaaaacaaaataatccaaatgtattttttatccattttcaaaaaacatgtttttagttcacatgtggaataaacataaattatgctatttatttgatattattggaatatgaattaatcatctcaataactgggcaacacactgagcactatgctgatgtctggttgtgaaataaaactagcaaagttataaacatggatatagaatttatttaatcattgagtctataaatatctatctcatatgagaggtggtgctatagaaaaagcacaccttttaaaagtactccacatggggcttatacctcctggtataaggagaaataaaataagtgagtaatcacatcctttatgatggatgctgtggaaggaatgcacagagtgatatgagctgctagactgggaagcagaagggtgactttacatagggctaatttggaaagcagcaagagggagtggaaaagacgaggcagagacagaggtcttatgatggtgacccttgaggccatttcacagaatttggtgacactgtattatgaaaaaataaagaaatatcaaccatagagagatgaattaccaacagtattgggttttcttttttcattttcatgctcactctacgtatatttttgttcctatcagtaaaattcttcgtttggttcaaatgtagttaaaatagcttagacaaaggtcaacattgtccaagattcacgtggttgtatgtccctttttttccttttggcataaaagtgctactcatattaaaaatttttgaataaataacagaaattaaaaataaaataaaggtcacccacaatcccaaaacctaaaagtgaatgttattaatatgttggtctattcctgaagcaggtttgtttccaaagtcctgtttgcggttatctcacctttgtgaaatgaggttaaataaagcaggcagcagattcagtttagaaaaaagacaagtggcagcagaggtcatactgatactcagagttcagatagtaacaggcatgctttggcttaaaagttacaattcatcagcaaaaaatgttgtggtcagaacagtattgccagagaagtgttttgatttcaaatattgctaaatcttatctctctgagtagttgtgtcaataagagataaggtcctgcctcactttggaagtaatagctttaagagaaagagaccctcaaggaatgagccttgttctgatgggcagaggctcccgtgatgggtggtgatgcttttggccctgacagggtcccagctgggccccagtccataacaaggccatggcagggaatattattcattcatatcatttgagacccagtttttcataacgatcaacatcatatttcctctaccttctctctctccaactctcagacttagaagcctataggttataacctgctttttgaggcagtactgaacttacagaccttagaaccaccctccactagacagtgtgagacttgtgcttcaggggctcagaacacacaacatgttcgtcacttcaaccctaagaacaagcaaagacattgaaaacaaagtaccagcagacgccaagtcttttaacaagaggagtctatccatagccactcaaataagaatacgctgatttgaagaatcttctgctgggaaccggggatgggaaattagaggtagagatgattagaccactcttaactgttctctcattttttcattttacacaataatgagacttttcccttttgcagctcctagtgtcaaagaactgattagactgaatgatgaacataggctaggggaaattaaagtacattgattttatctcaggaatcacttggaaattatttcttccaagtatgtatgtatgtgtgtgtatatatatatcttcaaaattatatatagtatataatatataatccaagtatatatatgcatatatatgtacatatatattctatatatttatctattagtgtgggtgtgcattcattattgtaaataacaattctgtatctttttcattaaacataagcatctctccatgtcataaattaatccccaaaaacaccttattgaatgactaataatctatcatccagatatatcatagtttgtttaataaaaagtaccctattgccgaactttcagttggctttcaatgttataaatgatactataatgaacatcctagaatatttatctttttctagtcactattggttttttagattaaaatcctaagatacagatccagtatgatcaatcatttgtagatttgttaagtttcttgacctgtattgtcaaattgctcttctcactaaacccagcagcattaacgatcttttaaaaaatatttactggcgttacttttaataaaatttaaggtatcagtcagagtcactttttattttcctatttctctttatttctatcttcttaggaggtagggagaccaaaataagacttgcaaaaaattattaaccacagctaaaacacacacacacacacacacacacacacacacacacacgcacacgcacacacacacacacatgagcacgtagttaaaaaaaggcacacaaggttggtctatgtgtttatttttcagaaacattgttttcttaggaccattccagtgaccttggttaatacggcttttgaatcccgcatggccaactttgactattttcaagtagagaaattcctagaacttatttggatactaatacacttgaaacaatatgaaccatgggttaacattatgcatttaaactacgcagaagaggtcaggcatggtggctcacacctgtaatcccagcactttgggaggctgaggcaggaggatcacctaaggttaggagtttgagaccagcctggccaacatggcaaaaccccatttctagtgaaaaaataaaaataaaaaaagcaaaaattagccgggcgtggtggcgggcacctgtaatcccagctactcggtaggctgagtcaggagaattgcctgaacctgggaggcggaggttacagtgagctgagatcatgccattgcactccagcctaggtgacagagcaagagacaccgtctcataaataaataaataataaattacaaagcagaatgtcagaatagtttgactcagggaataatgtagaaatagcatggtttaaacatttagatttacaatctacattgtgcttgtttcatttaactatttctaagtgaaaataatttatcctttgaaatattttagaaacatttcgttttactaaaatatgtaataaattaaaacttcattttgtgggattcagctgaactggtaaaacaagttcttttctatagcggtcaaatcaggcgctgttttacttctaacaacatgttatctttttcatatttgtcatttcctttgtggaaattgtaaaagagattgaccaacttttccccataatgctcattttcctcactacctacctataatttatctatttttatacatccttcttatttaaaatttaaatattacaaacaaggccaccgtacctttgacaataatcctaaattccaatcccccttcacagagccaataattgctaccaggttaatgtggatacttctacactttttgttctatgaatttgtaacaatcaatagttaacaatgaaaatatatagtgttgttttgtgttcctcttttatataaatggtataataatacacttaccgtgagaccagaaatctaattgtttttccttaacagtgccttctttcttttaactgctgcattatatcctatattgcatcatctagcaatctctctatacatagacatttaattctcttccagttcttggctgttagaaataagacggtgcaatgaacaagcttgtacatgcctctttttgcacctaagcaagtagctctaagcaaaaataatgcaaattagaaattctgggccataagttatgaatatttgtattttaataaatattctacaaaattaatttcaaaatggttgtaccattttagttcgcgtcagttgattatgagagtacccattttccaatactttagaataaactcgattttgttaagtcttttatttttttctaatttaaacagttgaaaacaagtgatgctggacatctttgaatacgtttattggtcaattatatttactcttttgtaaatggctgttttattttctttgcttttttttatctcattgtatgtgtatttttatttctctctggaaggtcacgtgtattctggctactaatcctttgtctattatatatgttgtaaaattttcttctactggtttaaaaaattttgttatgttttactatcatgagttttaaattttgatgaacttgaactgcttaatttattattctgtgtctttctatttttttaattaaaataccttcttaaacttaacatcaaaaagacattgcaatatagtataatacttttatggcattatatttatgcttagatgataactatctgaaatttgtttttatgaataagaactatgtatttctaaataagtagataattcttccaagaacttacattaagtaatatactttacccatttaaaatgccacttttatcattgagtaaataatcatatatattttagttcattcttagattcctagcccactcctttgatctagttttcaattcctgtcccagcactacattattttgattagtataattctataacatgtttgatacatattaggcatatttttagttttctcctatagatttatttttattatttttacatattctctcttctttatggattttagaataagttttacatttccataacacatcctcttagttcgtgttagtactgtactaagttcatagactattttgtagagaacagacatcttttttttaaattttattattattatactttaagttttagggtacatgtgcacaatgtgcaggttagttacatatgtatacatgtgccatgctggtgtgctgcacccattaactcgtcatttaacattaggtatatctcctaatgctatccatcccccctccccccacccgacaacagtccccagagtgtgatgttccccttcctgtgtccatgtgttctcattgttcaattcccacctatgagtgagaacaggcggtgtttggttttttgtccttgtgatagtttactgagaatgatgatttccagtttcatccatgtccctacaaaggacatgaactcatcattttttacggccgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactactttacagtcccaccaacagtgtaaaagtgttactatttctccacgtcctctccagcacctgttgtttcctgactttttaatgatcgccattctaactggtgtgagatggtatctcattgtggttttgatttgcatttctctgatggccagtgatggtgagcattttttcatgtgttttttggctgcataaatgtcttcttttgagaagtgtctgagaacagacatcttaaaagtattgaaacttcccattcacgaacaaaattgttttcctcacttatttaggttttcttttatgcccttcagtaaagtcttgtcaggattgttcctaagtatttgatatgatgattataaataaacctcttgttcttattttattttctaactgactcctattgttgtgaataaaagctatagtttattttatgttgagcatatacttagctattttgattaaactttcttactggctttaaaatttgtcactttggggttatcaggtaaattcttatctgcaaattgtgaaaatgttgtaactccctttccaatatttgaaatgttttccttattttattacattagcagggaccttgagttaaaagttaaacagttgtcttctagtcaacaatgggcctgcttctaatatctcactattaaggatagtgcttattctcggtagattcttttatgaagacaaagaagttaccttatatttctttattttacaaaagttttttaattattataaacatatttccttcagaatgcttttccgaaatcaagtgagatgattggatttccctccctaaatatattaatgtagtgaattccataaaaagatttctaatgttgagccatctttatgttcccaagataaatccatacttcattatgctattatttttaattgctgttttcaatgtgttaccattttattatacattttgtatccatagtaatcctgtttaagatagaaacttttatgcagtggcttatgcctgtaatcccagcactttgggattgagcccaggagttggagaccagcctgggcaacatggcaaaaccccatctttacaaaaaatatacaaaaattagccaggcatggtggcgcatgcctatggtcccagctacttgaaaggcggaggtgggaggattccttgagcctgggaggccgaggctgcagggagctctgattgtgccactgcactctccatcctgggtgacggagtgagacactgtctcacaccaaaacaataacaacaaaaaaatacttgctcataaaaaaatctgagtctggaaccttagtgggggctgagaggtagggaaaatcattactttatgaccacttcaatgtctattattttttctctatttagattttcctgttcttttggaagtttaatcaaattagccaaatataggctcaacatataataaactgtggcttttattcacatcaataacagccagttagaaaataaaatatatacctctgtgtctgttactactttttcattatttaggtttttcagttcttcttttgccaattttagtagttttgaaatatatagagatattcctcttatttattaatttttaagatccatactttattttgtcttaatcctaattttcaaaggttgatttattttatatgacctattaatgaattcattttttccaaattatttcaatgaatagtttcatttattcattaattgttatatttacctttcttcattcctttcttggatttatttttgttcttttttttagattgttagaatgattgcttagttcttttgtttttaacctaagttttttttttttctttttttgagacagagtctcgctctgttacccagactacagtgcagtggcgcgatctcagctcactgcagactttgcctcccgggttcaagcaattctctgcctcagcctcttgagtagctgggattacaggcgcccgccatcacgcccggctaatttttgtattttagtagagacggccaggctggtcttggactcctgatctcgtgatccacccacctcagcctcccaaagtgctgcgattacaggcgtgaaccaccgcacacagccctaagtttttaataaatgcatttaagatgacaaaatttcctaagtattcctttggctacatatcacaggttttgagaaatgtattatgatatatatatacagatagatatatagatacagatagatataagctttcatccacagttcctggcttataattcccatagcccttgttttttcctaactgattaaacaatgagcatatattttattaaagtatttggcctttgttcttggttcctgaagcagcttcagaatagtttcagagcaataacggtaaaagatagtatcttgttgtaatgttggggcactttaggcctcagaaacaggcctcagaaaacagaatatctctctctgaccctctcactccctcctttcaccttctcctttttctccccaagacaagccgcagaaactaaaatctactctaatttcccccaacctttctgtcttagagctggccataaagaaattctctgacctaccttgtctgattgtaggtcataagaccctcatttcagaagaggtcctgcccatacctggaagggatgctacacagtgagaccaagaagactgaacagagaggcctttctgggtttcccctctgagtctattagcatcagctgtatcccttttgttccatcacatttctacatggttgctcagtcttcaatcgtgcccattcagtgaaatctccataagacgcccaaagaggatggggtacagagagcttggacagctgaacacaaagagacttacaggaaagtgaacaagactcatctacagtagggtgggagcaccctaactccatgcgaatggaagctcctgcacttggtaccttttcaaacctcgcactatgaatttctttatctggctttttatttatatcctttaaaatatcttttataataaatggataaatgtgtttccctgagttttgtgagctgctctagcaaattgactacgcttaaagagggggttgtgggaaccccaaccggaagctggtagatcagaagttcagaggcctggacttgcgactggtgtctgacgcggggcagtcttgtgggaactgacactatctcctggaagatgacataagaattgaattggattagaagacgcccagctggtgtccactacagaactgattgcttgcttgttggttgggagaaatctccacacattgggtaaaagaagtttgctgtgttgattgctgtggtgtaagagcagaagaaaaagttattttctacacagtatgtaatggtcttattttgaatctattctaaacatactttttgcaatctttgctaacataaaaatttacattttctttacttatttaatttgctatatagccttattatcctttgtattccttggatactcagtggagatgaaatgtttattctctgaaaatagaaaagccatgtagactacagagatcatactgggtgactagagattgaatagtgcacaatatttcaatcctataaacatggatccttaacgtgtgacctggagaaaatattatccatgtaatgtcctctagtcttccaaaaagacttaacactcccttgagaaggagaacaacaataatcagttgagactggaactcaacaagcaggctcacattattaatatttttatttctaggctctagaaaaaaggctgcttctaattatactcaaggtccaatccattgtaatttttttaaaaaatattaacagttcccccttgtagccttggtcaaacattaagccctaaattggtaaggatgtctattggactgaaaaagatatttctcagtgtctgggaaaggaagaattggtcagatggtgtgaagttcaactgtggaactcataatctctggcaaattatgctgcttctaacaaaaacattcatgcacactcatatcctttcttacaccaacttaatacagaattctgctaatttaactaaggtaaatgtttcacacaaaacccaattttgcagacattttatttttcttttatgttttgattgtcacctttcagctcaaagggttttagggagctagaaactctatttttgcagtgtacagactttccgtttctccttttcattcacatttctaaagatgattggttatgaatttaatcttgttaacaccatgaccttttcaccaccaagttttaagaattacctgttagaccactgtatgataccactagcaagtaaagtactggggatatatgaagttatcaggcagagcagtatttgttccctatcaatgtgtatctaacaaaacattacacagaatactttctgcctgctttaaaacatttcgattaattttcttttttgttctaagatgaataatatttacatttcaattaaaatttaactaaatttggcaagccatggggagttcaaaagtttgtgaaggtccagaaaccttaatattttatttgaattgaatactcactttttaaccttagccataaagctatattggtctgtttcccacttagaactcatcaattcttgtacattattcagtaattggtcaagtacctgtgacccaggagttgctgatgtgacattgtccttaaagaaataatattttgcaaataattcatgatacctgtaaagaacttttggggtcctaagtggtggagacagattgtgactgtatttactgatttttactagaaagttgctcaactcactacttaacccttgcctaaatggttgtgtgttagcatatacaaattaagtgtacatatcagatctaatttgtaagttttattggttattataaaaaaaaaaaaaacctttcattttggccgggtgtggtggctcatgcctgtaatcccagcactttgggaggccgaggtgggcagatcacgagggcaagagatcgagaccatcctggccaacatggtgaaaccttgtctctactaaaaatacaaaaaacattagctgggcatggtggcaagggcctgtagtcccagctactggagaggctgaggcaggagaatcgcttgaacctgggagtcggaggttgcagtgagccgagatcactccactgcactctagcctgggcaacagagcgagactccatctcaaaaaaaaaaaaaagaaaaaaaaaacctttcgttttaagagtaaatcttagaactaatagcaatcaactgccaaataataaaaccttgttaataaaatattaacaaatcgaaggaaaaactctgaggtttttattaaaaattgtatacttgtatctacctttattcttttaaagagaaacagaaagccttgtctttgatttttaattagtaaatatgatgaatttgtattaagtgaaagaggtttttaatttctacttgtgtaaaacatttacctcccttaaattatagtcatgaaaatgaagacaaaaatcaaaatacagtctctgccatcaaagtcaaagaacatgatctttttttatctccaggttaatttttagtgtgaaagcaaactatcgtaagcacaatcacatcctcttataatggtgaaattcaccttgttttgaggagaaaggttgctgtggaacttcttttgagaattgtctattcatgtcgttagcccacttctttatgggattgtttttttcttgttaattggtttgagttccttgtagattctgaatattaatcctttgtctaatgcatagtttgtgaaaattctctcccactctgtgggttgtctgtttactttgctgattatttcttttgccatgcagaagctttttagtttaattaagtcccatccatttatctttgtttttgttgtgtttgcttttgggttcttggtcatgaactctttgcctaagccaattgtctagaagagtttttcgatgttatcttctagaatctttatggtttcaggtcttagatttaagtctttgatccaccttgagttgatttttgtataaagtgagagataaggatccagtttctttcttctacatatggcttgccaattaatccacaccatttgaacatttgaatcgggtgtcctttccccactttactttttttttttttttttttgctttgtcgaagatcagttggctgtaagtatttggctttatttctgggttctctattctcttccattggtctatgtgcctagttttatacctttccatgttctttacacagtagattgtattttgattcttatggttattaaacacagagcctatagctacttggctgttgtttgtttgtctagacacagggtcttgctgtattgtccagactggagtgcagtggcacagtcatagctcactacagccttaacctcccaggctcaagtgatcctcccacctcagtttcccaagtgagtagctgggactacaggtgcacgccaccacacccagctaattaaaataattttttagtagacatgggggtcttcccttattgcccagactggtctcaaactcctggcttaaagtggccttcctgccttggcctcccaaagtgctgggactacaggtgtgagccaccatgcctgaccaagcctgcagctacttgtaacccagtcctgtaaatgctcaatggtcctggtctttgctctttggctatggctgcttgccagctagtttataagctgcattggcttctcggctcaatacatttatcttacaaactcattctagagcataaaaaaggtatatattttttctacctacatacttatggctatcagctcactaatccagctcaattatctagatatcttgttggtatgcatttattacccatggccacctgatccaaagtgctgatgtatttagtatctcttcaatgataaattaattttatgtatagcaaagactagtttatcccctaatttgattaagcgatagaaaatcaattaatgacaagccattcacttactctggtaaccttaaaagtcagtcaacatgcatgttctatgttcttattgaatttaaggtattatctccgggaaattatctgaattgccaaattcacctagaattgctagaattaggcaaacttatgttattacatgtttccttcctgtgtatttttccttcctgccccctctcttttattctttttctcatttcatcttttgaatacaaagtaaataatgattacattccatttacatggtcacaagaaaaatatctaaatttcatctatatacttggaaacacatcactaccagtcataaaatgggagctaatattcattgtatgtgctaattgctctacatgtgctatttcatggccattctaggaggaatgaatactatcattatgagtcctgttttgcaaattggcatagagaggttaattagagtacccaaggtcatacagatagtaatagtgacatcaggattcactcaaattatctaactccagagcctagagcctaggagtgctcattcatgtacacacaaacacactctctctctcacacacacacacacacacacacacacacatatatactatgtatattaacatttaaacttcataataacctttaaagtaagcacaaaagtgtattctatacaaatagaaaaaccgaggcacagagagattaaataatttgctcaagttaacacaattgataggtagacaaactgggagcccaagcattttagcttcagaatctgtgcttttaactgttatagtctttctctgtgaaaaatgatcatagcaaaaacatgccatttctagcaataaatatgtgtctatatggagacacatttgcagaaatagaatgtaccacaaatacacttatttttgttctgaagcatctttattttccatctctattgccaatgttttttttatttttgtagtaccttttttatatatatacttaaaggtctagggtacatgtgcacaacgtgcaggtttgatacctaggtatatgtatgctatgttggtttgctgcacccatcaactcatcatttacattaggtatttctcctaatgctatccctcccccagtcccccaccccccaacaggccccagtgtgtgatgttccctgccctgtgtccaagtgatctcattgttcaattcccacctatcagtgagaacatgcagtgtttggttttctgcacttgtgatagtttgctgagaatgatggtttccagcttcatccatgtccctgcaaagtacacgaacttatccttttttatggctgcatagtattccatggtgtatatgtgccacattttcttaatccagtctatcaggcagtttcccagtgctggcaaaacctgtacacatttgtattacacaaattccacatatgtttctgattcatcccagttattagtaattaatatttttgctggtctttacatttacatttggcttatttattctaaatgagaatcaaatacaaagggaagatatatttggggtctgagaatggaattaaggtggatggcaacttcaatttgtgaaatgatatttaaagaaatctgagttagaaagatatattaaaacacagtctattcacactcagatcacattcacagtatgaggtgctaattgataaaaacatgacattgatgacaacagattaattccagatacagtctccataatattatgactagaggagcagtaatgaacttttcattgttattatgcagtagagagaaccataattgtttcacccagtgtgactatttgattaatgtttgtcatagtctccattccctacgttccatattcactcagatactaggcctgttttaaatcactagtgtatgctcaatgttgggcccagagaaggccctcaataaataatgaatgaatgaatgaatgaatggatggatgaatgaatggaggtataatagtgactgaaatttaagtgcatagaagcctaaattcaatcccccatataccacatatgaagccaatggcaccaagtttaagtttatttcaccagatggagggccaaactggtacagtagctcctaccttgatggaatggctgagttatgactaggaagacaactgtgaccagagctggcagcacctggagacattcgtctctatttattccctgattcaaaataaaagaattactcctcaactgaagctatgaccctgtggattactccttcctccttgacactatttctttagctggctcccaagacgccacattctccttggtttctcctatcacactcttcgctcatttgggttcttttgctggtttcccttcttcttccccacttcttgtcttttcattcttttaatagtgtctttagaagtgtagactttttaagttttaggaagtcctatttattatatttttattttatggagtatgtttttggtgctacaactaataaacctctgcctaacccaagatcacaaagattttctcccgtgttgtcttcaagaagttttacaattttcaatttaacatttaggtctatgatctatttagagttaattttcatgtatggtggaagatatgaattgaagttcatatgaattagccattgaggaaatataaattaaaaccaagataacttatcaccacatattaaaatggctaaaataaaaattgctgattatgtcaaataaaaaaataaaaattgctgactatatcaagtgctggtgaggatgtggagcagcccatacattgctggtgtgagtgcaaagtgatgctgccactttggaaaataatttgtaagtttcttgccaagttaaacgtgcattgccatacgactcagcaatctcactcatagtatttaccctcaagaactgaaaacttatagtcacatgaaaacatgtatatgaatatttataggaactgtttttataattgccaaaactggaatcagccaatatgtccttcactgggtgaatggacaaacagttgttcacacatacaatggaatactattcaccaataaaaaggaatggacattcaacaacatggttaactctcaaggcattatactgagtggaaaaagccagttcaaaagtttacataatatatgattatattatatgacattctcaattataaaatagggtgatggagaacagatcaatggttttcagggaaggaagaagggagaaacatgactctaaggggatagcatgagaaggatttttggggtggcagaacttttctgtatcctattttatatgaacctatacatttgccaaaattcatataatgatactgaaaaaataatgaaaaactgcaaatctaatagaattcttatgctcataaatatgttcagttgtgccttgctaccttcttttctctggcaatctactcatatctgaaagtaaatggaaaactaggaattgactgatcaaaattgacgttactaatgaagtatcagagatatatattaacttgataagattaattttagtagaaaccggttcttctacagataattttagcttcattctcattcttgtatttattcatctcagaaatatatattgagcgcctactatgggccaggaagtattttaggtactgcgatagaagagtaaaaagcaaagtccctgtactcacatatcttactttctactggagagaaatggaccaaaaccaaaacaaataaaaaacacacaaataagtatagggaacatcaggggtaagaattcctgtgaaggaaaaagcagaatggagggatggagaatgaagacggttgggagaaagagagagttgctattttagatgcactggtcctggaaggggcaccaagaaagtgatatttatcttggcaaaaacgtgacagaagatatggctatctagatgttccagaagagggtagaataaggactaagaccctgaggggattctggatctgaggggttcacagaacagcaaggaaatgagagcagctaaagcagcattaggagggtagctgtggcagtgtggtggccacgggtcaggtctcacagtgtagtccatttaaagagtgagtgagtgagatgcaaaaccactcgcagttttaaagaacagattcatgatctgaaatgtgttttaaaaataattgctctggtctgggtaaagatcagatcttagggtggcagacagatcaattatggtgctattgaaattgccagagtaagagataatgatgacttgaactaggtggggatagagatgatcaataggttatcaaattacaaagcacattagcataaagacttacattacataaatatctcagtgtaataaaaatattaaaatgctaatttttgttcctcgatagcctagttagcattctgtaacaaggcattgatttttctcagtttgattttattatgaaattattatatatttttcttatttgcagtattaggttaaaggataatctattttaagtggaaagatacagcatatatcaagatctctataaaaatccaaggccatattttggaagttatattaaacataataatgacataaggagatatttggaaaaaatgagattgatgattttctccttgtatcttactggaattatttgaggataaatagttttttagaacaagcaagacaaacaagatcctcctcactgccaaatcagtgaacttctcaatttcaaaagaactctttggctactgcctagagccatttcctcatttttgatgacagcaaatgagtggttcattttctgttttacagtgttatgcccttcagcaaattctgaataaaactgctgcacttgtttggtgagaactttttcaacatttcatgctgaacatatccactgttcataaccagagcagataagttcaaagactaaaggcaactttcgaaacacaaatgcaaaataaaatgaaaatataataatatgaaatcttaacattgatttgccaatgatctgtcttgagttgtttataaatctgaccatacctttgcagtgccaacccaggctggcaataagacatttaggaccaagattccgaacaattcatgcatgtttcacaggccaaagttcaactcatcatttaaaacttttactcaagaccttatagaatcaagtcatgctttctacaagtcaaaacatctgctggtgcgctgttcacctccttgtaaacattgcctaatgtatggagaaaaaaagtcatataaaacaaggtagtcatgataaatgttcaacactgtcagcatagtcaagagtcaccatttctcctgaatatatttggtgctgcttctattaagcaaaataccttccaaacataaaactctgctatttaaaattcaggcataaaaacattttcctggggctaatttatatttaaaatctctaccaatgtctatgtgtcagcactcaaccatgccctcagtttactgtcaacacacagatagacaaagatcatgcatagaccatattgatcaaattatttcttatcagagtctcattgaaatgcaaaatggttagtacttagaaaaccatataaatcaattatcctaatctggaacttgcagacagaatgtcaaatgaaattttaaggtcttattttatctgcatgtgaaattgagagctgagaaatatgagtttgctaagaatatttttggtttgttaatgacaataacaatgcatgctcataaaaaattattttgtcaggtatgagtaacttctatggactttctcatttttagctcatttataataacttctaattcctgacttaaactataaggtagaaaagatgacgtgggaaaagagaagagtagttcagattcagtgtttgaatgtgaggtgtttgtgggactttcaaggagagatgtccaggaagcactgaacttgtgcatgtcatggtttaggagagaaatctgggctaaagatgcaggtttgtgtcaaaggatattggtgctagatgcagctatgtatgtggaaaaataaggacatatgaggaagaaaagccctgggcacaccaatgtttatgggatagtagaagggaagtccctgaagagaagggaaaatagaggacaaaaacagggcatggtattaaggctagggaggaaagcattcaaggaagggagaatggccaacagcattatcagaggatgctgagacatctgtctcatgaatttgactagtctaggtacttcatataagtggaatcagacaatatttttccttttgtggctgtcttatttcacttagcatatcatcctcaagtttcatccatgttgtagccatatgtcagaatttcctttctttttgaggctgaataatattccattgtaccagtatgccatggataagaattttaatgtgcatctggtaacctaaactttatggaaatactgtctaaaaaagttattaaaaactgaaaattgaattttgattgaattggttgaaacaattggaaggtatagagtcctgaaactacaaactaatttagacagtttctgataaataacatttgtacgttctctagcatagaacaattaatactgggagaaacaaaacaataataagagtttaaattgtatgagtatatgattattcagataattttggtctgtcttcttaaatgctgtaacagttttttttttccttttatacctttattcacatacttatctggttcttttttttagaagaaattcctagacatagtattcccaggtccaaagttgggtgtgtgtgtgtgtgtgtagtttttcttcgcttgtttctaattttatggagttttcttttttttttgagaaagacgggtagtggttgcacaacattgtgaatatactgatgccattgaattgtatactttaaaatgattaattgtatgtgaatttcacctcaatgaagaaaaatgctgtaatagtgggaattttctttaagcttggaattgaggttgtatttttactacaaatgtcatatcacatgtgttggtatacaatgctgatacatttataattaaatggattgatttaatattatagttcattattcataaaaacagaaggaaatgagccttttagagatacatttgcacacatggttctctctgctcagtatcttttccaaagtttgttcatcctgcaaggcgcaacttattgccattttcttataagagtcttcctcatcacataaaaataagtgtttccttctttttatactctattatagcacttagcctctgcctggttgggtctgttccctctgctgaactgaaggtttcttgagaacaggatcatgctctcttcccctttgtatttatcaatcatatagtatatatacagtcaatactagttatgttaaaacttactgtatataaagcattgagcaatgtcctttggttgacagtcactgttcttgaaacacttagatatagtcagtatagatcgaccattcacacatgaactcacttaaggacaaaggcaaaacacttatccaatgcaaaattataagcaatagaataagttggttataagacaattatctgtaaaataccatgggtgtgtatcaaattatttctcatgtaacaaaacaccaaacagaaagaattaatgtgtgcgaccaaatattgagccttagatgtggctagttttaaagatctgaggataaaaacatgcaaaacaagacattctggagagatagaaaaacgacaaagggaagtgtgtcatgggatcctggaaaagagattcttattagggaagtgggcaaagataatctgggtctctagaaaaagattagaaatctctgaagatgtgaataatgacaaaatgcctgtaatagagttacaaatttactcacatctccactcagatttggaaagaaaatgttgtctcttcatttctctgtaccagtcagattgtctccatgatgtgcacctacagggtaaggagaacaaaaaaggaaaaatctaaaatatagtcccatttgaaaaactaaatccattagagtattagtccctggtaaaatgagcagtatcttagaggccctcttcttcagccattatctaaatggtatttgcagtttgggagcatacagcttatttgacatcacaggggctgtaggaaggggttacctcctagggcctcactggtttgtgctgtggggcagcacaagccagtgaggccctgatctgctgtatgggccaagtggcggtggagcatctgtgcagtgttctcgcatctgctgagaaagtgtaagctgggggaactcagggtgtggacattctggacttggtcagggcacagttttcttcctgttgacttagcccctccttaagcctcacaaccatttggctacacagcccctgagccctgacttgagagttctctagaccaacctgactctcaatttacttccacctgtctccctcagggcacacaggtacttgtgagtcctatctctgacacacaggaggcagattaaaggaggaagccacactcaggccttcttttggtctactctccaccaccaagtgatctgctctattgggccagccaaatatgagagcctttgggggcatctcattccatgtcacacatcttctcccatgaggacttcagcctggaaagaggagatctagacacaagggtctctctggcttcctcaatctgccattccctttctcttccattcaactcttcggaccaaccagacaagattttccttcttcctttttgactagaacctctttttcacaaaactctgtgattaatcttgctaggccagcttctagaagttttaaatgggaaaaaagggaatttagaaaatcctctcagatatgtagttttcaaggctactgtctgtcagcacactgccttttagaatatctttccttctctgcgtttttgttgaaattcgcctaatttccactaaattcccaagtccgactatgggaaaaaaacattcacaaggaaatataaaaaacataagcacatcacatttctgaaaatactatgtccatatattatacctatccccctagaactctattctttctctaactggaaaaatatatagattatactcctgtgctctctgagattttccttaagagaaaactgaagtttgatttctgaacttctaatgcactttcttttcattaatttttccatgtttatagattctttctgggtaattaatgttacattccttagttttctaatgttataaaaatgtttacttttaattattaagcaattcatattaatttctgaatcttaaagataaaagctaactgagtttgtaaaagcatttaaataccctctttgaactccattgggtttatttattttctttatgaccagttcagttcacaatgctgattttaatccaaatatttgccttccaagatgctggttgtaccatttataatccatactgtacctctttgtagattactgcttggcattgctgcaaagtgaaagagaatttaattttcctgatgctgtttgattatatttacctactgaagttttcattgtgaaacaagccctatgaacatttacagaatgcatgtttcctttttttctaaactctttctagttgaattggttctacaccagttgtttttaaacagtggaaatataaatatatttttgtcaaaaggaaaaatttgagagtgtacatggatagcttctgagaaggtggatcaaaaattcaattacgtgatttcatcaaataaaaaagtagtagacacagttttttctctaagtaccagtcatatcaatgggaaaggatatttaaactagaagttatagacataaattcattttaattattgtgcattttcccttactgttctatcagattaccatgtatagcaacttgccattcagcagttactcatttctaaggttgtaaatgtcgagaaataccagactatcaccctggactctgtagtgtgattgtttaatgtgtatgtggtttcatacccaaatgagtcattctgccaagaaccttgagaatatcggtctagtctagaaatttcaatcttaatgattgatactcagctttggcataagattatgcatcattagaaagaggatgtaggtgtaaaatggttctgtgcaaatacaaacattatttacttaagcccacaaaatcttgactagtcatttcctctgctaaacctttccattcccactattttttaaaatcatcacttgtatcaccaactgctcatcagtaaacctcatatctctagaataatctctgctgtcgtatttgtatttctagcatatactatgatgtctgacttagtagcttcataaaaatctattgaatgggccaggtgtggtggctcatgcctgtaatcccagcactttgggaggccgaggtgggcagatcacctgaggtcaggagtttgacagcagcctggccaacatagtgaaaccccatctctactaaaaataaaaaattagccaggcatggtggtgggctcctgtaatcccagctactcaggaggctgaggcaggagaatcgcttgaacccgggagaagaggttgcagtgagatgagaccatgccattgcactccagtctgggtgacagaatgagactctgtctcagaaaaaaaaacaaaaacaacaacaaaacaaaacaacccgaaaaccaaaaccaaaccaaaacaaaaatgtattgaatgaatactgacttcaaggtactcaggagaaagccatcttgtatgtacctctgatattttcatccaacacttcttttcctcaatctttttcctaggtatttctacagcttctagggttttgtcactgttcctcacaatgttctcctattttgtcaaccagtagatataatagctctgaatggtcatatatatgttactgttatcagcgcttttgttttacaggaaaattgaagagaattggagattttaaatttgggagagtgtctttgggaatatcagtcaattgaggatgaataaatctgctagtgatcatcataccaattcatatgaaagttttaaaaaactggatatcaatttcactgcatgctactctttgggggctccaatctttagaagagtttggactcaacttggtaaacacattttgaacccagtacacctctcaagaaacatcttgatgagcatgatatagagggcataccttgccaaagagtaaagatatatattttatctttaatgagaaaaatgctgatttttcatgggataagaacaggaaatccttttagaatcatcaagggcagcatcaaaatgggagatataagatggaaagtttgatttgcctaggaagaggagagtaaaaatgctctttgagtttcgggatttggaaagaaaaaatgcccactgctttgcttgagccaaaatcaaggctgtaagacagctgatatgttcagttgttaaattataagcaattctatactggttggtataatagctgctatatttaccctattccttttgctggaaatagaagaacttccagttaagtaactaactggtgaatgctcaggaacttccaggacccttttccagcactacagcttgctttagtcctgtttcatctatacccagattgtgttagcccagctggaacattctgagtttaggcctgccaaacatgaggtggtagagttcctttcatggcaaaccagcacccaagataacaagcagggcttcagaggacccagccccagccactctgccaatgtccaagcctgaggtcagcttcaccccttacaagtctagtgctccaccagagggattctacagccccccacttcctcaggcataactgccatcatattttgaaaccatctgcctgcagaaaacagcaatccatgtccatagaattggtccaccacagccaagtcctcatagcctgtgctctacacttcacacccgtgaagcaacaaggagtaggaagatcttcaacctaaacagctgaggtgactttggggaacagcctaccatgcataaccctgggagaggcctgtatccacccaagcctaagtattactggtaacttggcccacaactttccaaggctaaactttattctctttgacaggcagggcattgagacaggaacaacgcagtctggactgagacatcaaacatgcaaaagcacctgtgaactgtggagagttaagatatattacttcttcctgaagtgtacttagacaaaatattgaaaaataaataatcatgctctcatttggaagaaaattctttgctgtctctttttttttttttaacattgatcaactttcctcttgatctcaataatctattgccgtttttgtctagcttttcactataacacctatttcttcatggttattgacctcccaaagatgtccatgacctaatcccaggaacttgtcactatatgactatattatgttacatggcaagaggttattaaggttgcaagtagaattaaagttgttaatcatctgacttgaaaacacggagattatcttggattatttgcataagcccaatctttaaaagcagagaaacttccctgactttctggccagatagagagacttgacaacagaagaatggccagaaagatgcaacttgagaaggattcaacccacctgttatgggttatatgtttgtgtcccttcaaaattcatttcgaaacttaatccctattgtgatggtcttaagatgtagggcctttggggaagtgattacaacatcagggctccgtctccgagataaatgggattagtgcccttataaaagaggcttcagagagccgcacagttcttcaatctcttctgtcaggtgagaatacaggaagaaggtgccatcttggaagcagaagatgcaagtcctcaccagatgctaaatctgctggcaccttaatttaggactttccaacctccagaaatgtgagaaaaaaattcaattatttataaattacccagtgtatggtattttgctataatagcaacaatggactaggacacgactattgctgactttaatgatggatgaaggggaccatgaaccaaagaatgtgagcagctttaaaagcttgaaaaggcaagaaaatgcatcttcccctagagcctccaaaaaggaatgcagctctgctgacactttaattttagcccagtgaaacttgtgttggacttctaacctatggaattataagataataaatatgttttgtttaagccattacatttttggaatttgatactacagcaatagaaaactagtataccaactatccctgccccaaccccaccaataccaaacgaaataagtttataatactaatgacactactctcttaggcctcattctctgaagcaaagaaagatgaaagctgtccctctgaattatctttcatttgggagacatttgttttgttgttggtctctggtcacaatagccaagatttggaaaaagccaaactgaataatgctgtggtgaatgggcttgcagatatttcttaaatatagtgattttatttcccttggatatatacccacagtgggattgctggattacccagcaattctttcctaattttttgaggaacctccatactgtttcctataatggctgtaccaatttacattcctattaacagtataccagggttcccttttcccatatccttatcaacacttatcagggatgaggtgatatctcattgtggttttgatttgtatttgtattttatgattttgatttgtatttgtattttatgattttcttgatgattagtgatgttgagaacacttgcatatatagtatctattggccatttatatgtcttctttggaaaaaaaatgtctgttgaggtcctttgctcatttttatgtctcttatggtcctttggccatttgtatgtcttctttggaaaaaatgtctattgaggtcatttgcccattttgggtcatttgggcttttgctactgagttctattagttgccaatatattttggatattaacccctaattgcatatatggatagcaaatatttccaatgattctgttggttgtctttttatttggttgattgtttgcttggctatgcagaaactttttattttgatgtagtcccagttggttatttttgcttttgttgcctgtgtttttgttgtcaaatccgaaaaataattgccaagaccaatgtcaaggagctgttcccttcaattttcttctaggagttttatggtttcaagtattatatttaagtctttagtccaatttgaggttatttttgtgcatggtataagataagggtccaatttattttttttgcacgtggaaatccagtttccctgtttccccaacatttattgaaaattaattgaccatatatgtaagggtttatttctgagctcactattccattccattggtttgtgtctttttatatcagtatcatactattttggttactataggtttgtcatgtaatgtggaatcaggaaatgtgatgcttccaaccttcttcttactcaagattactttacctcctcagagatatttgtggttccatgtgacttccagaattgttttttctatttctgtgaaaaatgccattgggttttaatacatattacagtggatctgtagatacttttgcgtagtatggacattttaacaatattaattcttccaacccaggaatgcagaatatattcccattttgtgtcttcttcaatatctgtcatcaatattttataattttcagcacacagaactttcacatcctaggttaaatatattcctaagtattttattttttgatgctattgtaaatgttctgttattttcacatagttcatttttagcatatagaaacgtaactaattttgtatgttgattttgtatcctgcaacttcactgaattaatttattagttttaaatttggggggtagagtcttaaaggttttctctatataaggtcatgtaattttcaaacagagataattttgttttttcattttctctttgaatatcttttatttgtttttcttgctcgattgctgtagtaggacttccagtactatattgaacagaaagtagtgagagtaggcacccttgtctcaggttcctgatcttaggagaaatgctttcagctttttacctttaagtatgatgttagctgtggacttgtcatgtatggccttgttatattccttttatacctcatttgttgagcatttttaccatgaaaaaatgaattctgtaaaatgctttttctgcatctataaatgtaattacatgatttttatccttcattttgttaatgtcatgtgttgcacttattaatctgcatatattgaaccatccttgcatcccaggggtaaattccactggtcatgctgtatgatcctttcaatgtgctgttaaattcagttcactagtatttttctaaggatttgtgcttcaaagttcataaagaatattgaactaatcatttctgatagtgtcttgttattagggtaaggctggcctcataaaatgagtttgaaagtgttcattcctctgcaattttttgtaatagcttcataagaattggtatgaattcttctttaaatatttggtagatgtaaaaaacctgcacatgtactgcctgaatctaatacagaagttgaaattattttttaaatttttttttcttatatgtttggtagaattctacagtgaaaccatctgtttctagactttcctttttgggtcatagtgcttactgattcagtgtccttacttgtttttggtatgttcagattttctattttgtcatgattcaatcttcataggtagtacatttctaaatatccatttcatctaggttatagaattggttgacataactgttcatagtagtcacttacaatcctttgtatttctgtggtatcagttgtctgtcttctttttcattttcgatttcatttctttgattcttttctcttttttaatccatctagctaaaggtttttgaattttgtttttcttttcaaaaaaccaactgttttcttgatctctgtattgtttttctagtctctatttcatttacttctgttctgatcttcattatatccttccttctgctaactttgggtatagtttgttcttctttttctagttccatggggtgtaaaattagaatatttgagatatttatttgtcttcatgtaggtatttattgccacaaatatcatcttagaaatgctttcgatgcataccatagctttggtatgttgtatctccattttcgttcattcagaaattttttgatattttccattttgatcttctttgacaaattgattgttcagtagtgtgttatttaaattccacataattttaccttttccattttttctcctattattgatttctactttcaaaccactgcggtcaggaaagatacttgatataattccattttcttaaatttgttgaggcttgttttgtagcccaacatataatttatcctggagaatgttctgtgggcacttgagaagaatgtgtatttgctactgttagatagaatgttctgtttatgtctattaggtccattttgtctaaagtacagttcaaagcccaatgtttccttattgattttctatctagttgatgcatccattgttgaaaatgaggtactgaagtcctctactattattatattgctgtttatttctcccttcagatctgctaatatatgtgatatatttgcatatatcacatattgcatatatcatgggtgggctacgtccccacccaaatctcatcttgaattcccatgtattgtgggatggacctggtgggaggtaattgaatcatggaggcaattctttcctgggctgtactcgtgatagtgaataagtctcacaagatctgatggttttataaagaggagttcccctgtacaagcgctctctctttgcctgctgccatccatataagacatgacttgctcctccttgccttctgccatgattgtgaggcctctccggccatatggaactgtaagtcaattaaacctctttattttgtaaattgcccagtctcaggtatatctttatcagcagcatgagaacaaatacaatgtgctttatatatttagatgctccaatgttagatgcatatatatttacaattgttatattctcttaaagaattgacttatcattacataaagatactcattgtctcttataacagtttttgacttaaattctattttgcctgaataaatatagcttccctcttctcctttggtttccatttgcaaggaatctttttccgtctcttcactttcagcctatttgtgtctttaaaggtgaggtaagtctccttaatcagtacataaatgggtcttatttgttaaaattcattagaccactctgctattgattaacttaatctgtttatatttaaagtaatttttgataggtaagagctatttaaatctattggcattttgttgtttttggattgttttgcagattttgttctattcctcttctctgtgttcctttgtgattttataatgttgtctaatggtatgctttgattcttttttctttatcctttgtgtatctaccatagatatttttctttgtgattatcatgagacttatataacactttttattgtagtatagtatcagtctattgtaaggtgacaataactttgattgcatgaaacaaccctaccctttattccccaccctacctacattttatgttttttgatgtcacagtttacatctttttatattgtgtatccattaacaaattattgtgtcattattacttttaatgcttttgtcttttaacctttatacttaaaagtgatttactcaccatctttacagtataagaattttctgaatgtgactatatatgtatctttgccagtaatttttatgccttcatatgacttcatgttactaattagcagcattttatttcagtatgaagaactccctatagcaatttttttgtaaggcagttctagtggtgataaactccctcacttttgtttgtctgggagagtctttatctttcattcatttccatgggacagctttgctggataaagtattctaggttggcagtgtttctttttgttttcgtttttgtttctgtttccttttagtactttgaatatatcatcccacactcttatggcctgctaggtttctgctgagaaatttgctgataccgttagattcctagattccttggtatgtcacaaggttgttttttctctttctgctttcgaattctcttttatttttttacagattatgtgtcattgaagacctctttggtttgaagctgcttataaactttatataacttgagctttatattcctggatatccatatttcttagcaaatatgggatgttttgagccattatttctttaaagaaggtttctgcccctttcacattctctcttctccttctgttactctcataatgtgcatatcatgccacttgctggtgtcctacaaatcactgaggcttttgtcacattttactttttattccttcaattggataatttcaagtgactgtctttgagctcacagattctttcctctgcttgatcaagtttgctgttgacactttctattgcatttttcatttcattcattgtattcttcatttccagaatttctgtttggttctttttcatgatttccatgtctttattgaccatttagttttgttcatgtattgtttttctgatttgttcagttttctatgtgttctcttgtagcccaccaaactttcttaaaataattattttgaattatttggcaattcatagacatccatttctttggaatcagttattagaaaattatttatacctttgttgatattgtgcttccttgattgtttcatgtttcttgttccttgcattgatgtctgcccatttgatggagcagtcacctcttctagactttacagactggttttggtgaaaaagaccttcacatggaggtgggtgcaagaatgccatgtaggtggggtgtgacaattccaggtttgctgaaggcacagtctctgtgcaggtctgtcagctacggtcagcatcagcaaaggttgcagtggtcctcaacagccaaagctctgggtgtctgcagtggtggcaaggaccattgggatccttgatgataaaggcttttggggtccacttgatctctttttctcccacagaggaagttgtggccaaggggatcactctgggtgccaaggctggctcatggacgctcatggggcagtggtatcagtatctgatgcatggcatctatggagtgtcacagagttggggtctagaatgtaggcatgcatggaggaactacagctccagagtctgtgatagttggtggcatgggtttccagggctactgcagcagcattggtaatactgcatgaggcttgggtgcttatggagcagctagggagctagaacaagaaaacaggcatgtgcagaactacagcagctctggagttcagaatgtggatgctcctgctgtggcagtgacttgctgtcctgggcacatgtgctcacaaagctgtcacagagctgggatccaaagagtgggcatgcatagagcaaccacagctcaaggatcttgggtgcaaataaacctattgtggcagtggctctggtgtcctaggaataggtgctcagtgtggccatggagctgggatctggagcatgggcatatgcaagcagactgcagactgttgttgcaaggtatggaacaatatgcctatgcacatacctgctctagcaatggctctggtgtctatgatgcaggaactcagagagaagccattgagccagggttagagcaacagtagctctaaggtctggggtgtcagctggcccatagcagcagtggctttggtgtatgaagcatgtacatgtgtgatgcagccatagagtcagggtctggaatgaaggtatgcacacaatggccacagctctagggttccgggtatgcatagggttggtggggcagtgatagccccaatcctagagtagcaggaaagtggctccttcttggctagagggttggggaagcagcttcctctcccaggaggtgcacagtgtcagttgttgctggttaccttagtggcaaaagctgaggcatcctctgtgtagcaggccactgtgatccatgcagatgaacactaagggaacctccattgccaaagctatggggaatccatggctgtggcaggggctactgaggtctttaatggcaaaagcttccaggtcctctgaagagcaggccactggggaatgtagtggcacctgatgcatggctgacattggtagtccctgcttttctttgttactagccatcttcagatgtctcaagtatactgctctctccagcaatcctttctgtgctgttattatctgttttttacttcactatgttcccataggtttttatttgtactattaagcccttccagggctattttcatttgtgaatagctgtctgttgtttctgtgggggagcaaaggctggtatctcctactctaccatcttcctgatatcactcttattacttctgttttgaaggaagcagcaaagtatgatgcgacagaaattaaagaaatcaaactaacgggctgatttcatatcctgacctggtgcagagagagagcttaaaaatattgtcagaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaatattgtcagaaagaaaaatcaggaatgtggtatcactaaagtttgctgaacaagttaattacttggaattaccgagtagatttataaccagaagtgatttttttgaaagattagatattttctttacagactgagaagtaggcactatgacatgtggcctgaatctaggcctcataacaacccaataaatccaaaactgggcatgcctcctgttaaagaaaccacatctaacattatccccttcctttccaagccttctgcctctgtgctgctcatgcttgtcaccctcttagatcagacagttaagagctataccctggctcccagtctcttactcttctcaccagcccacttctagccatcagtactcttttcagaaaacacaaatgtgatctgatctttcccctgctcaacatccttcaattagcaactcgtccataaataacagcatgtaaactcttgtggttgggatttaacttctctagtgtgtggttcctactttgctttccagccttacctcctgtttgtaatgtgccctccactaccactaacaacttcacctccaatatactctaactgcaagtgtccaaacatttcttgcatcctgctgcctctgtacagaatagaacaaacttgatatttttaatgggaaattcagggtttagtccatcattcaccaactttgacttggtacaagtcactttccctctctcttccttgatttcatcgtctataaataggaaactaggaagcatatatactttacagcgtagtagtcagagtcaaaggagaacgatggtgaaagcgcattttaagttgtaaattcacttctggatgatagttattataaatatgccattccccttcccaattagatacttagctcctgtaggtaactgccttgtcttcattttgatatcccaaatctcgcaataatatctcctcaaaacatgtgtgctgaattgaatgaaaacattctgtattttaggtcctaacaattacaacatgcatcattaaaggtttacaagatacaggactatggaggacagaattctcacaccctgacaaataaattttaaagaagcctacagatgaaagaatccatctcaataatatgcattctgttttcaaaaagtaattaggtcaaaggaattagcactattatgataggtcttattattactacttttttatgctatttctaataataatactatttacaaggatcctgggagctacataataggtaaagtacagaaaaagtcaatgactattttgtagaaattttcacacctttagcattcataagatccatgaagtattagcttcataattcataagatccatgaaaaagttttcaagatcaattatttttaaactaaagggtaaaaaaatgaaggaaaattgagaggaaaagaagacaaaaagaagaaagaagctgcctttgttcattcttaattgtataattgcattttatattacaattaccctttctttctttacaaatggtactgtctgagaaggaaagaatcggagaacatagattttgaaagctaaaagtttccttgtgggttatcaattctgctgtagtttggatatggtttgtctccccaaaaatctcttgttgaaatttgatctccagtgtggtggtgttgggagatggggcctggtgggaggtgtttgagtcttggaggtgaatccctcatgaatagattaatgccctccctcaggggtgaatacattctcactttcttagtttgtacagagttcttagttcttagttctcacttcttagttcttagagagttggttgttaaaaaagagcatggtacctcccttcttctcttgttgtctctctcaccatgtgatttcttgcactcaggctccccttcaccttccacaatgagtggacggaatctgaggtctgtaccagatgcagatgccagtgccatgcttctaatacagtttgtagaactataaggaaaataatcttctttcctttataaattagcctcaggtagtccattatagcaacacagaatagactaagataaactccttatttttcaaatgaagaaactgaggcataacgacgatacaggaatggcccagtggcttaaaatctaacagcagattaactttctgcaaattgatttgacagttatctttaaatatatattccttctagaaaagcagacactgctgcttctgtctcatataatggtctctttatttcctatcgagtctctccaatgtgacaggaagtggttttcctaaagctatgattaatagcctctatggtttgtgaggcaccgcaactacactgcagggaacaatactctagtgccctcacagagtttctgagcctcccacagctactaatttactatgagggagtagtttctaactcaagaagattagattcttctttattatatcagtatccttttattttgttaacctaatgcccttaacatttcccaccattatacttctttcctttcttttatacccaaagtccttaaaataagtagtgtatgcttaccacctcctttaactttctcactgtttaatctgctttttggctgctttccatatgccaatattctgcacgtcagggactttccttttagacgaattcaaatgtctttccttaatcttctccctcttgattccttggtcatattacacaagtttaactcttgcccttcttgaaactcttccataatttggcttccatcatcctgaacaacaaactttccgaccaacactgaccactcctctaattataacttatcctcttgtctcttttctgtgggtatttctaaagcttactggtcttgttgctctcttctcttggcaaatttatctatgctgatggcttcagtgaccatgtcaatgttaatgatccccaaatcttggtctttattcctgatcactcatgaaccttctaatcttataactccacctgttctcttagatctttgctatatgctaacttatgtctaaagccaaagtcattgtcatactgactaaattgtgctcctctccaatataccattttaaaaaacactagaaatttctttttttatatgtcaaacatatagtcatctttactcctactttaaaatgtatttgaagaaaggattattcaattgtattatttattctttgttttcttggtaaatgccttcctttctattatctgttgtcattacctgcatccattcacccacccatccatccatccactcaccatcatgccctggttaatcttcctccagataaacctacttataagtgatctgtacaaaaaacccgcagtgccaattttcacttgattaagtatattaagtgttcctgaatatattaagcagttccatctgatataactgttagttctcatctgcttctaacttgaattctctctaaattaagcatcatgtgccctaggctgtgctctgttacaaaagggtgggatcggtacagttgatagcagctgtactacgtcctttgtttgttcttatttgggttgggagcagttccatggggaataaagaaggtggagagaaacatcccactacaatgatagtttatttaataatgtcctcatgccaaggtcatcctcactcttatgaagtattaattcaaaatctctagttgtcatttctagattttgccaaagagttacttcccttcatgaggcacagcttccaacaatgtagagcccttggctgctttacttggagagtctggcttctgtgccaaatatatgtatcattctgtgtactttctagctgcagtctctttaaaagccaactgtgggtaatcatctcagggaataggcatctatgttgtaacccttgaagaatgttagcaatcttttatttttctccataattttaaagtcttgtttcataagcttatttattctctgacttcatttggcaaatattgtttgacaaatattcttgagctactaccattggataccaggtattttgtttggttctgagaataaaatgtgaaatctaataggcccacactgtgccttcatagagtggggaggacagataccggacaaacaattacaaagaagtttgaggagtataatgagggaagtacagagttctgtggaagcacttggtattagcatagctatctcagttccactacttgctggcagagagatcataataaagttgcttaaccactcaaaggttcatttcctcgtatgtaaaactgtggccaataatagcacctgcttcatagattatttttattaggattaaatttttaaaaacacatttagcgcagtatttggcacatagtaagtacccaataaatgttaactgcaataataaaataacattaattttacattccaaatcattttattgcattaatttatacttctaaaactttaaagtcgttttttttaattctcggcagctatattttttcacttctgactcaaggcttttaaaacttctttatgtttgtctattaattcagttcctcaggcattattttattcaacaaatatttattgggtgcccactatataccagactctgtgtcaggcactgataataaaatgctgagcacaacaaataggatcctttccctgaggagcttacagtctactgaaacggatgggcattaaataaaccatcacaggaagaagtacaggatcacaaatggtctcaacataggtgtaagtacatttaaagaaaaaaagataatgatctttaacagggcaaaggcaaatgagattcaagctataaaattagaactagtcctaatgtcatgaaaatattatactttcttctaaagccccaatcctaaaataatacggattaatcttaaaggctagaatatgtgtttccaataagctacttctttgctctataaggtagctgaaaaaaacatactatttattacaattttgcaatgggctacattattcaaataaggacagtttaaacatggtcacatcatttaaaatgatagctacacgaaaactctgttaacattagaaatatactattctatttcaatccaacaatgccagctgcaacatacatgtttgttttgccagtgaaaacaagcagacacattaatgaatacactgatgttttatttaatttgtttccaggccccagctcaaagtgctttaaaatgtggattctggaatctaccctaactgtgaaaactgtggccagttacttagaatctcagtgctcagtttctttatttagtaaagtggggttaacaatagtatctacctgaagtgttagaagagaatgtgacatgtgccaggtgtggtggctcatgcctgtaatcttagctcttatggagggaggggtaggaagatagctggagcccaggagtttgagacttgcctggacaatatagcaagatcctgttctccaaaataaggaaaaaaaagagacaaagaagagaatgtgacatgtattgagaacccagtaatactatgaatgaaatggtagctattgacgctaagcttaattttttttctttttctttttctgtttttttgttttgtttctttttgttgttgttattttgttttgtgtgtgtgtgtgtgtgtgacagagtttcgctcttgttgcccaagctggagtgcaatgccgcgatctgggctcaccgcaacctccgcttgctgggttcaagtgagtcttctgagtcagcctcccaagcagctgaaattacaggcatatgccaccacacctggctaatgttgtatttttagtagagatagggtttctccatgttggtcaggctggtctcgaactcccgacctcaggtgatcacccccactttgacctcccaaagtgctgggattacaggcgtgagcccccacacccagcctctaaggttaaatttttaaaaatgaaggatatgacttagggtgaccagactccctaagttgctggggactgtagggtttcacctgaggaagaacttccagtgagtctcgtgaaccaatgatgaaatgtatgatgaatcaagaatcatgataaatctaatttggaatacttgagggtcatgaattttagtccttgaattttgattggttaacaatattttagtgtttgccatatcccagaagcagaaagccagggaataataaatgccgcctcaagcacacctagaccagtctactccttcctaaaataggcagaatttaccacctatgctttaacaaaggcttgaataagcagagcatttagagaggagagttcaaggtaacagagagaccactggtctttagatatgtcctaagagcatcccaataggtatagaatggagaataatgctaaattaaattctggcattcttgcttttttcttattcttctcatggaaggtatatatattatctgatgtattgcttcctttataaaccttgaaccttaatatggtgtctagcaaatgtttggtttttagcaacaaattgtagagttgaatatttcttaaggctgaagagataaactttttatattcatttttttcactttacagatcagtgcctattgcaaatttatagatcaatttaaagagaattagaaagttccaaagtttgttgtcacacaattgactttgcaggttggtatttattttatcaaacatcacttacatgccctttacaaatctagctttgggaaattaccgtggttagttttcttagctcatgcttcacaatgtatgcagttttgccaattgttgtaatgtcaatatgggaaatataatatgctaaatacagctactgtatttagcaactgttccagtaaagcattctccagctgtctgggagtcacaatccgtagtcttaaatagatgtatctgtcatcagtttcattagcttcggattatatgtatcatctgttggttttgggtgtaaactggcgtgtgcaaatgtttttctcataatatatttttttaaaaggcacacaattccatagatattcattttattccacaaattcagaatccacaaataattttgtattttaattatatgttatattctcatttatttgatatattattaattattatcatctatttcatttattatatccattatattttcatttctgatgccagaatccacctgtgactattaaagatgtagagaggtctgtttgccttacatcattccctagttcttgctgagcatgtacttaatgggaagctgcagcagaggactgggacagccttaaattgttggggaaatggtaacggagagtctattttcatcaaattgagaggctgagtgattaatgtacatgcaataaacttaatagatttgaggcagtttgcacggtaagtacagatgggctaatgacatacaaaagtaaaaggagaaaatctttattaaaagatcctacaacacagaaatgtataagtaaagacatagactttaaccctgagcttcctcgttcacaagggtaaaagagaaaaacaggacagttacttcactttaattgtttagaacaatgactcccaaattagtactccctaaggaaagttaaagacaagtaattaggacctgggtatctctcatccctgagtcaaacaaagcagctccatgttcacctgttttccatattagaccagtttccgtattaacagcactggggaatgagagaagggaaggtttagtttgtagtacctgagatttctggggtgtaaatgtacatactatgtccaatttcaagctatcaacatgacataaccaatcacaatgttgggaagagatgcgcacagttgactctcatgaggtaaattcttgtctggatgactgattggcctctttagtgcatctgctgtgcaaatgacaattaattaccagtgatatgttgatcactccaagtatatctctggcttctctttctctccttagcctttagaatcattttctaattacctattggatatctttattttcaggttcagcagacaatttgtactcagtatgtccaaaaccaaattcactcccccatatacacacatatactcctgaattccctctctcttaatggcatcattatctgcccaatcattgacaaggaaacatgggaggtatcctagaaaactttaccttccacatcagttgagcatcaaagactattttttttcccaaaaaatacttgtcaaatcaatcctattctctccttctttatctgtactcctttagttcagaccttcattttttgtattataataacctctctactggtttgaccttttcccattcatttccaaatttttatgagttattttaccaaatatggtttgtataacaaaacactcattgaaaactactcaatgaaaatccgtggacctcacagacactaaaatgttttgctacagtttgcttccagcctattttttcattttcatctgctaatgaatcttctataataaagatgttaaaaaataatttctgctccttctcaaccacaagcttaagacagatatcacaaattaatcacagccaagctttcacatggaataaggatatagcttcagaaatctcatcattcaaccgtggctttcaagcagctacctacacactcacaggaatttgttcgtgaaaggcagcatacttggcacccatttatcctctcttccagtttttataccatagcaatacttgtcattcaaaggacacaccatgtggaattatgccatcatgcctttgaacatgctattccctttacctgaattatcttccccattcatgtttttcatatatttacctttcatctttcaaattttctctcaggtgtcactttttctttgacatttccatgacaccgtccaatcccctggctcaaagagatgaggagaatccaataagtcaataagaaaaaccttacttcatcaatagaaactagatagaaatataactctaaagctctatatcctttctttctatgtcttttaaaaagaagcaaaaacattgaggctataaaatatagaaaacatttttaaatcagaaagaaagaaatatatacatttcaggaagatttttctaccactatatataacgctatgtctaaataggattttcttacaaacttctgagaattagaaaaaaatcatttcttgagtattctttggaattgtcatttcaatggtgatgagaaacatgcatttgaaagacaatatgaataacaatatgctttgtctaatgtctgctctcagtatttgactggtatacttggaggaaatccatgaaatatttgaccataaaattgtcaacactgcaagaggattttccttgcctgatgtaaggttgccagatatttagtttgaactcaactatatggataaataagaatctccatctaagttatgaacaattattgtccttgatttcctattccacatcaccagcaatgatcctaggttcttaaatattcaccacagaaacaacctaagtttatatattttgcagtatagactttttttcccttctccttccaaggctcattttttaaattcattattttctcatttcttaaatcagagattcttaggatgagtttatggtgtccataaacccttaacactacatataaaacatgcaaaatatatgtatatttttcttgggaatagtatagttttaatattttttacaaaggtatgtgccacaaaaaacccatgaaagactgatccattaaaagttgctttctgttcaatattccctcttgaacaatattttccttttattatttgctatgtgctcaatcttctacaactgtgagagcttcatttcccatttatatttagatgatatcctgattatggacaacagctactacactcagactcgctcttaagctccagatctgtatttctaaatgctactggactgaccccttaacctcattatgtcattccaaaataatgactgaaggccaattcattggatttggcactggaaagacaaggcggcctgccttcaaagacatttttatacaactatcctttactgagcacataatgtgttctaggaattgtgctacatattttaccttaaaaattgcatcccatttaattctcacaacaaatctgtgaggtttacagataaggaaattgaggtttcagagaaattacataacctacttaaaattatgtaataacttagttgggaagaccaaatttgaattgattttgtctgtctctagggtccaagtttttatcactatgtacttcttttaatagttcatggttggaaggaggtcattgcgatagcatttacactatggcaagcacaggatcacctactacttaaaaatcctctgcaattaccagtggcctcaataaccaagtccatactctttagctcagtttataatttggcctcaacctacatctcagtcctcaattgccagcatattctccatctacagtctagcacccagttacaccagactattgatcctttcttcaatacatcatgttctcctctcatgcttctctgccttgtatatgtcatccagtaggctggaaattcacttgtccctcttgtcttcttaggagaattattttattttcataacctattcaaatgagtgtcaccttctaagtaattcactgaggcaaaattagtgaatttgcctccctgttctcttataacacttatgcccttaccatagggcttggatgtaatcatttgtttactgatctttctccattcctagataaatcccttggggagaggagctatgttaggtttctcttgcgccagtgatggtagtgcattacctagaacatatggcaggttattcagtaagtgtttgtataatgaatagtattcaatctttatctgcctttgatgttgagcatctttatagagacagaaaacctcaatataatgttatctttgatatggccattttctgtatacataaatatcatttaagtaatattacataaatgctccacaaaatatggatagcttttacatttttatgtatacttttgacattgttttctagaagtttgactttaactcttcaactgtttgaccagctgacacatatatggaggggaaactattatatggggctatgaataaggtgatattttctaacttgcttgcttggtaaaagaattttttgtgtaagaaatgagatttcagaaaagtcacaattaaaaaaagaaaaaaaaataagaaaagacttggaagaggtatgagaaaacccatgacagtctgttcaagaagaagatggcaatgattaatgttggagaggggtgccaacgtaatacaatgggagaaacaatagtcttttcagcagaagtgctgggacaactggatatccagatgcaaaagaatgaagttgtacccttaactcacaaaatttacaaaaattaacacaaagtggatcaaatatctaaatgtaataaccagaactacaaaactcttaaaagacaatatagagacaaatttttatgatttcagttttgacaatggtttcttaaatacgacataaaattgatgaaataagcaatgattttaaaaaattagacaaattggacaatgataaaagtacaagcagtgataagcataagcaattatagaaattacataaattggactttatcaaaattaaaaacttttgtgcatcaaagaacactgtcgagatataaagaattacactgtcgagtataaagaaaacccacagaatgggagaaaatatttgcaaatcacatatctaagagtctagtatccagaacgtataagtaactcctacaactcaataataaaataaccgaatttaaaaatgagccaagagtttgaataaacatacctccaaagacaataaaaaatggccaataaacacaggaaaacatgctcatattatggaaatcaaaaccacaatgaaatatcactttatccctactacaataaaaaggacaacaataacaaatgctgggaaagatgtagaaaaatttggactttcatatgttgctgatgggaatgtaaaaaggtatagccacttggaaaacagtttggcagttcctcaaaaagttaaacatatagttatcatataacacagtaattttattcctagatatatacttaagagaaatgaaaatacatgttctcaccaaaacttgtatataaatatacatagcagcattactcaaaatagccaaaaatagaaacaacccaattgcccatcaactgatgaagggaatagacaaatgcggtatatctacacaatgaaataatattcaggcataaaaaatgaagtattaatacatgctacaacatagacgaaccttgaaaacattatggtaagtgaatgaagctaataaaaaaagaccatatattgtataagccacccccaccccggccttttttctgagatggagtctccctctgtcactcaggctggagtgcagtggtgcgatcttggctcactgcaacctctgcctcccaggttcaagcgattctcctgcttcagcttcctgagtagctgggattacaggcgcccgccaccatgcctggccaatttttgtgttttcagtagagacagggtttcaccatactggccagcctggtcttgaatttctgacctcaagtgatctgctcaccgtggcctcccaaagtgctgggattacaggcatgagccaccccatccagccttttatgagcctatttatatgaaatttccacaatatgccaatccacagaagcagaaaatagatcagcgttttctaatagctggcagaaggaggaatgggtagtgactgctagtgagtatggagctgctttttgggatgatgaaaatgttctggaattagtaccgatagcttcgtaatcttgtgaatatactaaaaaccactgaactgaacactaaagtgataaatgttatggtacataaattttatttcattttttcaaaaagtactttttacatagcattgttgtaagactaaattaaagaaagtatgtaaagtgcacaggacctgtaatcgataaatactaattcttattttttttttaaagaatcgaatggtaaagatggctttcattcatttgggggaattaaaaataattacagtttatatgagatatggaaagaggatacaaatctgttaaaatatttttttcaaaatacttcgtatagggctaatgaatcaaagggaccactttatccacattttcctgactagtgaaatttgcgctaatgtaggtacaccaagctgtacttcttataagtatcactacaataacaaacacctagggatggacacagcactccatccaataactgtgtgaactcattacctaattattattataactaatatgttggttgctatatcacataacagatatgaaaaaatacaatgtaatcacaacaacgtcagagtttcatatcatcgttaatagagctactggctgtagcaaaaatattttaaattatcaaagctaacctataatcttttcacaggtacaatatgtagtggtgaacatttaactttaaatagcacagcacattgtaaaagtcaccctatgtcataagaagtgtataaaaataattgtttatgattctacatccctgaaaaatgtgcatgctgcacgaaatgtttaatgtgtccttgaccaaaagggaatacaacattaattttgttttgaggacaagtggactccagacaaaagacaaaaataggtaacttaggtagatacaacagttttagaaaattctgttcctgaggtggtgggatttttagggaacttacctttctcaagaacataatttcaaaagacactctgtaaattcatcaaagtttaatgatgaagagacacaataaatgttatgaagtttagtggtggatactttggaagtgaatgccaaagattacaatttagagaagaccacaaccaagaaacagttaacaaagttttagttgaatgaaaaattttaaaaaagtacatccaatttcttcaaaaaatttgtttcttctgcgattccaggtttaattttggttatcccatgacaagtggttcacaacactgggaaaagaaaggaaaaaaaagaaaaaatatattttatttgcatagttcatatttttaatattaatgtacatatctaagaatgttttcttcatagagctttcattctacttttgttttatatgtaattaaaattgaagaggatttgacatcccaaatcctttttaaatgtttttctgtatatggtcagcagaaaacacaaaatatagtgatccttccacctcagtctcctaagtagctgggactataggaacgtgccaccacacccagctatttgtttatttttcatagagatagggtctcactatgttgcacatgctccagctatcatttattgactaattctaaccttaatgaaatagttcctgatttttagatttacttccaatttccccatcccatcttaaatactaccacaaactgttctgaaaactctttcctaaatacacataagtttccttctcaagaacccataatttctccttgttcatcaaatcaattttaagtatcaatcctaagataccccatcaactaatctaactttgctttcttatctaacggcattttccccattccctaacgcataccttccacttcaatcacactaattttcttcatttcctcaatatgtcagattcatacttctcactttatcatgtttaattagaaaacctacttgccacttacttaaattgtacccattctacaagatccatctcatgcagtacttgcttgtgccatatgttcttcacaataacttaaattttatcttgtattgtttaagacgtttaatcaataagccacatttctcatgtaattgaagaataggctggtgaaatcttaagtgcttaatcaatgtgcattgaattgagctaaatttatatacttaacttgaatttatatgcttcaatattgtactgttgaggttaaacatctttaaaattactttcatattattttatattatttggtcactcccaagttttctcagctacagagctcatgaggttgagaccacagtgagctgtagttgtgccactgcactcagcccaggtgacagagcaagatcttgtcttaaaaataaataaaaataaatgacagatgaaaactttattccatcatatgatgtaattttatacacgtggaagtaaatgaataagctttcatgcacagagcactggaaattttgatgtagtttattctgtccaatatataaaattactatataaaattacctaggaaagtaatgagcacttagtgtaattctcctgttttctgagttcacctattgaggaaaactgaagagtgttttcatagtcaagtttcaactgaatttaagtcctgagggatgaaaactaaagtatatacacacatgtatattttaggaaactttcttaggagatacacacacacacacacacacacacacacacacacctcctaagaaagtctcaagggaaaaaatgtcagtgggatgagcccttttaggagaagcagaataaaagactgactacaaatcaaaaagccaaagaagaagccacagacagaaatggagacaagatccagaagccaggctgaaacaggagggcaacaaatcaagtcaggaaataactgatatgaagcacatcggtgccttaatagtggctgaatatgtgggctagtttaaaggtgaaaaagtctcttgacgccataaatataacacatatttctaaaaagaaattcattgaaaagggggaggagaattattttattcctttagaaagtataagatcaaagcacagagcaatatttttccaaatctgctcaaaatcttgccagacatggtgttatgtcagtccacttccacttacagaattagccatagtgcttctaattatgaccactgcaaaaaaagtaaaaatactagtaaaatgtaaattgaagtgaaagctattcatttataggaaaggtatcatacaaactcacagacattcttagaactggagatttataaaatttaggtaccaattgaatatgcaattgtttcttctgcattatttgcccagaagaaccaatacttcacaaactgtgtttagactttattagctgagcaaaattaatgacaagagaatgccacgagacaattttgatagttgcttttcatatcatgaatacttatctttcaaaagaggaagcaatgttaaatatgcttaatatggtttaatcctctcaaagactttgtaaggtatcaatgaaacttgcacatgtgtgtcagttaggttttagtacaggaaacagataagtttcaggtatttcaagtaaatagggatttaaaacagggaataaaatgcttactaaatctttgggaaggctagagagagaggctctaggctgggaattcagaaatgtttccataacactgtagaactgacttattagagaaagatgacctttgcttcaatcagaaaagtggggacttcagaagtcactataaaatttattgacttcaaaaacacaccattgtagccacaattaagagatcagggagccactactgctcacacccctacagcctctcaaaccctagaacttggatgctggaacccatcacagaaaactcatatttccacaatctcacttattagcagaaaacaatggaagcagcaggaagatgacctccacttgacttttgcttccaaatctcaacaagtgcacctaattggatgaaacttatttacatttggaagtttaatggcacaggaatctgggaaaatttagtttttagctttccagctgctgtagtatagaaatacacagaatggaaaagtgcaaatggttgccagttggccatatccaccatactgagattcaaaggttttagaaatttcttatccaaggtcacagaacttgtgagtgctagagcaacaaacttgaattcaaagattttggccacttgcccagtgctctttccactacatcagtctacagcactgattactctctgaagacatttgccaaaggagacatattttcaaatcttgtgctaattatatttttcactgaagcattaattcaggcatctgtgaacattgttaccttttagtcttatgtcaaacctagttcttcttccaaactcagacttaatcttattttacagtaattacagttaaaccaacactgctagggtttaatacctttgagtatttttctcagcaggcttgctgcttaatccatttaatgtcagaacaacacaaaccttcttattaaaatgggggaaaggacgttattagagactgcattagtggtcttttcttctttggggtaaaacctaccaatatggcaatatttgcaccttatctttattttgttttctgctgaccacatacagaaaaacattaaaaaaggaaagatttcagatgttaaatccccttgaattctaattacacataaaagtagaatgaaagctctctgaagcaaatattcctagatttgtactttaatattaaaataaaaaatatgaactatgcaaatatttggacaaaatgaaaaaatataatgcctcagtaatattcatattcaattaaatcatcactttcatttcaaatgcactttaaagtaatttggggaacatattttaaaatgtacatacaatgacctaagtacaaagattcctaacatataccttaagagaaaaatagaaattactacctaacacttctgattagacttaagcaacaatactatgttaaaattaaagaggtgattaaattcatataaataaaaggtacatatcatgattgtagttagaagagatttgattgcactctttaaacaaggagataattattgttcaaaagttgttagatcaagtggatctagtagttttgtgctaagagcatatagaaaagaatataataaagaaacaatgtatgtggttgttaaggatcaaataaagacgttatgtgagtcttgtgtaggttagattacatcagtatcacagattatttatctccacatattcattagatacagaatgttaactttataagagttggcaaatttttaaatcaaaaggaactattgtattcagcacacaaagcagtgaaggctgtgattaacctcaagagaagtttggggtgcttactagagaaaacaattgatcctgagatttttctgaacatttctatttgtcattggaatccgtcttttgtaaaagactgttttcactcctgaaagtcattatgtactctctctgtgtacacacacacacacacacacacacacacatacacacacccctctatatataatatacacacatataaatgttgaggggtatattagagagatcacacaataaggctttttcctttgctttttacataggaaactaaaataataagttcaatttaacttctaaattcattcagattagaaagaaaaataattaaaaattgtgatagtattttttttgttgaaggatcttttacattaaagtcagcagtattatttggtaagtgggctacagagtagaacttaaaaaatatatccctatctcagttatcccacatttttagtatcttataagaaatgaccaggccgggcatggtggctcatgcctgtaatccctgtgctttgcggggccaaggcaggtggatcacctgaggtcaggagttcgagaccagcctgaccaatatggtgaaactccaattctactaaaattacaaaaattacctgggtgtggtggcatgcacctgtagtcccagctacgtggaaggctgaggctggagaatcgcgtgaacccgggaggtggaggttgcagtgagccgagatcgcgccactgcactccagccttagtgacagactgagactccatctcaaaaaacaaaacaaaacagaaaaacaaacaaacaaaaagaaatgaccaaagaccataagttgtaaactacagaagttgaagttacctttataatgattttatatatatgtaattatatatattatttaatatatgtatgtttgtgtgtgtgtacttgctttttaaacagacttatgttggacatatatttcaatgtcaaagacagtgcttttcattattctttaggtaaaataatgaggtgtacatgactctagtaagagctaattggaaaattataatgtttgacactcctttactgttttgttttcttattttttgactattaattaaaaggatgtgtagaaaacatgaaaaattaagtattaatttcatggtgacagatatttaccatctattttttctgagcataacatatagtaatatagaactcagaaattactggcttaaatcaatgctattgtttattaccaaattaaccattattattctagtcatctactgaggagtatagtttccaaataaaacttaaattgccacttagagacttgaccctaaagatgtaatgacataaagtgctcagttttgagaagtatatttcactttgtgtactgatggattttcctcatcttgttgagcagatactaaaaggtaagaaaagggctattaagttacagctattaagtactatttattattattgaaaaaaatatcatctttaggttgactgataatgacatttcttttagaaggattgagtgtttgtgtgcctaaaaaccacgacctacttcataactggctaataccttcagtatgaacaaactttttaagaataaactgctgtatgtgaggctacttcttttattaatatttcatgtagggcatgtttataaatatttgagaaaattctatcagaatgtcaaccttttttatatcctaaaataggcaaatactaattaaaacaaaatggtctgggggattgaattaccctctactgacctccatttttctcatcttgttaatgcagttcttactgaaattaacatttgtctgaactgttcaagagtaactaaaaaaaaccaaagtttgcattttatatcattcatttactttacatatacaatcaaagcactctaacaggttacagattggtgtttttactcatataggtgtatgtcaactttcttttataggggagatttgcttcaaagaattatacaaaaaactggcataaatatgaccactcacaaaatgtgtttaaataagtaaataatatggaaaaatacaacacaaatatgtaatgaatatttgaaaaccctggtttctgaagagtttagatagggattgtttacattataatctacttggtatttctttaaataccaatgtatcccaaaataattattcgattcacatgcttttctctgaaacatatttgctttatgtaatttatttaaaggctcagataaccagaatgaattcaacctaacgcaaggattaaaagaatgtaagagatctgtccaagatctgggaatacatcgaatccttcctactcattttcatcagaagccctcgcctctgtgaagacagatgggagctccatctacattcaggcaggaaggccactcaactaaagtttaaagttttacaaggaaaattcctacagcttgctttaggagggaagggtggagaacattctgttttacaggacactccaccctcagctatatccccttgattaattatgtaaccagatctccttcatcaacttaccgattaggtaatggcaggtatttctgatgcttggtatggggtctgagtgaggagggtcctaaaaatattacttatgcagctgttttgcatagcattaaagtgaaaagctttaacttgcagtacaagttaacatttgttccagacttttttttttaaactattattttagcatgtaagccttatagacataaatcctgtctactgatacattataaagtctcagaaaagtcagtgattatatacaggaaagtagataaaggagaaatttcaaatgcataagaacaagcaaaaaggtattcgtaaggtattagaaactattagcattttagtataaataactggtgaatacagcaaaatgaataatttgtggttagtataaatcagctaaattcttgtaatgcacaactaactacacatattcttcagcccacggaggccatacaatggagatttgggattctaactttgttttcaaaatggagaagtgcagaaactttgaatcttttaaaatttatcttccatctgtttcctgtaatatcaagatttagagcaaggtctaaagctttatcttacgtaaaagctgggtgcctaatatgtatctgtcctgacctcccatggaaacaattatcaggcttcagatattttgtctctcaattttttaacttgaaagtacatggctatttatttttgcacttattttttgtttttattgtgcaatttttcaacatatggcaaagttgaaagaataccacaaatgtttgtatacctttcataattgtgtatatgtgtatgtgtgtgtatatatatatgtatatatgtatatatatatatgtatatatgtgtatatatatatatgtgtgtatatatatatatatatatatacatatatatatatgaatgttgcagcatgcatttcctgagaataaggatcttctctttattctagaggtatatacctctacaggtgatagaggtatataaccacaatacctctatcacctgtaaaatcccgattccaggacacaacatagataaattaaataaaaatttttgtagtggagccaaggatccgtaatttttacagttctcaagtgactacaatatgcaacaaatgttgagaaccactgtccacacattaattaaatttgttaaatattttcagtaaagaatacattttgtttcttaatatgaataagaatgatagccttttaaagtttagcaaatctaaattatatattttaggtcagcattttacaataatttacatttccttaagctgttcttatcaagttaataattttctttgttaaataaatgtattttatcttaatttcagtttcttctatatcatgatttaaaatgcagaaagtatgtattatgtagttttcaaatatatttatctccaaagttaaatggattttagtaaaaatgatatttatacatatatattttaataaaatgtttaataaattagacatgaatcttagcatgtgaaacataaaacttttttataactttccccataatcaaacttcaaattcgtaagaattaaaagtccggaaagaaagaaatcgaaatccaaacttactgcatgttaacattttaataatgtactttcatgtgttaaaaacctaaatgtttcttgcaacaaagcattatccataagtgaataaaaataattttgactaataacaaattattcctatcttgtagtttctttgtcagaattaagattagcattatctattaattacttctctgtggcttctatgacattgttgtatccaagcaagtaaagaagacattaagcatttagaaacagcccttagatgtctatgtctgttcttcagtgttaggagtaaaagcaagcaatgtgtaaactgattatttttaataaatgaatcagaacagttcaaagtcagataagttatacattttagactggggcagaagtcacaagacccagattctaggctatgattagcagggcacttgatctctctgggcctgaagtttctcacctgttaaatgaaggatttagttatgccaaaggtcccaaactttctcagttcacagcattcctagtgtctcagtaattttttcatggtgttgcaagctaaaagaaacacctaacagttccatttattaaacagttaaacccaaacttatgtttgtctatcctaacaacttagtagctatttaaaaaataatatacattaacattttttattcttaatgggatgtgcacatctgttgggcacttcataacttctcaaacttaggaataaacttggaaaccgctaccctcattcctgttctacagtaattttcccatagtccttgtgttttattacagcaatttacaaaaacacagcctcacaaagatacgatgtcaaaaggaatgaagtacaatttaatgtgtagaagttctgaactacctcaagatagtggtttgcacggtgtccaactgatgtcactgtgttggccttgaaaatttaaaatatcccatgatagtgcccctgtgagtttgttgtggtgctcctggggtgcctcagtacatagtttaggaagcatggactaccctctgtaaaatacttcatatagctacaatgtgtgttgtaaactgtaaaagacaattctgagggcctgaagtaaggagctgcagaattgaagaggagattaaaaagtgatacatgttcagtctgcatgaaattccccttcctccccaggtcacctataaaatgcctacctatgcctacctataaaatgcctacctatgcctcaaaactcagctcaagctccctcagggaggttaccaagttacccttaccaagttaaatccacctattatacattctcacagtattcatttcacagtacttgtcccagttgtaattatacattcatttgtgtaactatctggttaattcttgtctctctcattagaatgtaagctctaagaggaaagaacatgtctgatatcactactgtaacccacagtgtctggtatattataggggctaaaatcttgcttagtgaaatgaactgtgatagaataggtttagcattcattttgattattttcctttattcaagaacagctgatatttataatagcattcctaaaacatttttctcatactatttcgcaggagaaagaaacccatacacatacagctgcatctgaaacctcagaaactaagctcaacccaattgattaaaaggatgttctttggataaggtaatcaaatgttcaccgactcttatagccaaattaattattatgagataaaaatcacgtaactacaaaaaaaaaaactgctcacaaaaaagtttttaaatcttagcagatggacacaaaccatactttgagaaccatgttccacagtgccaatacaggaagtttctagataatggcagctcattttttaaaaatggcactacactatactgtattcacatgccagcaaaactgttaaggtaagttcatgtcactattaaaataaaatgaattctgggaattttgttgatattcaattttaatcttaattatgcaaagatctgttacttaactaagactatgtaacataatatagcatatgacttctggataatgaaaataatcctaaacttaaccataaaaaaataagggtatgaaagtcaaaataaggtagaaaatgactgcaccaaatagccaacaaccttaaaaagggtaggatttttttaaatcactaaattaagattggttcattgcatttagtacatctcttttatgaagaggagttataagctacagaatcaataaattatgttttgatataaatttttcacccttaaagttcctagctaggaggaaattattcttttacacttacacgttttagatagaatggctataagtaagcacagataaatgaagaaatgaaagagaagggaaaaatagagatggttgattctgcctctgcaattgctaattcataaacatcaaactttcccagtgtacactgtcttctttgggaatttgctccatctttttccttaaactgaaaggtggcttactgaggctatcactttcctaaaggtctccccaatactgcctaattattttctcttatcacaggatacagggtggatgtccatctacttccttgttgtcacttcccagatcactttcactttatgctcttctaaaattaaaacaaagatcatcgaccacaaaacacaattgttcttttgtagctcatgctagaataccctctttgttacatctccttcatttttctgatccaaaatttagtagcctactatatctcacccactgtccttctttcctccagctatggtagagaactgctcctccaactttatgtacatttgaatcacctgggagttcctgtgaacttcgggttctgatttaataaggacacccaaagagtctgcatttcctgtaactctcaaaagaagctgtggagtactctgaatagcaaagcactgtaagtgctgtttctgttagtatctaatctattagtcctaatctcccatttatgctttggcactcattccctcctgctttcggtatcttaatatctatcattccttcactcttccctcaggttccctacatagtttatctctaccccctctaagccgctcagtatcgcccattaaagaactaaaccaaaactagaaaaccctcatttaacccttcactccccctacatacaatctgatgtgtctctcatccacagctaaacttggaagaaaaattgcctgcttgaggatgccattttgttatcttcagctcaatcctgtacccacttcaatgttatttgcaggcccattaccccaacactgcattcacgaaagtcatcagtgactacacattgagaaaacaagaatgacattttcagttctcaactaatttgaatttctcaacagtattcaatattgttaattactcccaatatttttccacatggtcctccatgacacaatacataatagtccccttattatctatattcctgtctattgtaaagacttcccccgcacaccaaaaaaggtcaaggaaactcctagccttcaagtctcaactcaaatctggccttctgaagccttcccaactaggaaaatatacagtcccattggttgtctaccagttgtctaccagttaattgtaattcttagccacaagttagctgacccaccgtctctcaaacaggtgaagttaagctcaatatttggcatatcttgatatactttgtacagtctagctacaataagtttgcctatgcacgaagatggctaccggcgggggggggcgtccttacgtcctacgtcatcacgtgccgggatgagggtggggccctcaaggaagacggaatggaatccagatgggcgggggcaagcaggacggggcggggctacgcgggatctgggcggggcggggccggtgaggggtcgggggtgctcctgctattcagccggtgcgcgcggcggcgggaggcagtggctggggagtcccgtcgacgctctgttccgagagcgtgccccggaccgccagctcagaacaggggcagccgtgtagccgaacggaagctgggagcagccgggactggtggcccgcgcccgagctccgcaggcgggaagcaccctggatttaggaagtcccgggagcagcgcggcggcacctccctcacccaaggggccgcggcgacggtcacggggcgcggcgccaccgtgagcgacccaggccaggattctaaatagacggcccaggctcctcctccgcccgggccgcctcacctgcgggcattgccgcgccgcctccgccggtgtagacggcacctgcgccgccttgctcgcgggtctccgcccctcgcccaccctcactgcgccaggcccaggcagctcacctgtactggcgcgggctgcggaagcctgcgtgagccgaggcgttgaggcgcggcgcccacgccactgtcccgagaggacgcaggtggagcgggcgcggcttcgcggaacccggcgccggccgccgcagtggtcccagcctacaccgggttccggggacccggccgccagtgcccggggagtagccgccgccgtcggctgggcaccatgaacagcagcagcgccaacatcacctacgccagtcgcaagcggcggaagccggtgcagaaaacgtgagtgtcccgagcgcgtcctcatcgcgggggctgggcgctcaggcacgcgggtgcgggaggcagccccaccccgcccccaaatccctgcgatcctgggattaggtccattcccggcactgcccgtggaatcgaggtttggaggccggctgggagacagaggacttggattctcccgttttcaatgattgcattttaaaaattgtcctcccacccatcctcttcccccgcaccagtgcatacacaccctctcacatttgcaactttgttctttctgatttggtcctgatttgttgacagctctgatctgccttgggctaatggattagttagtataaacctgtcttgaaatctccttccacttttcatatccgcatgggttaggttagaggacggtcttaattctcattcttcgtagagtttggtaaggcgagatgttttaaagagctaaacacatgctgacttttacgaaggggctgagtgcctctaaaggtactttttggtccccaccaactggctttgtgttgcgctcatatttacttatttggcagcaattttgtagcgctcatcgtgaccatatcggtaaagtggatagaagtggtagcaggtgggagtggatgcaacggacaggatacggtggaggatttgtattcttcagacatctttttcggaagcttgcttatcacttttggggtggctttagggtctgtaaaataaaagatttagaactgcatttgagagaggttttcattcttaacatctacctctaattcttttccccttcaaagttttcttctagttgagtgagtacaaacttgcttttgtcgttgtcggttgattttggtggaatatttgtgtgagatggccaattttttgtgtgtgtcagaaaaaactatccgtgctcaaaacatttcctgttgtgaggtggttgtattcatgtgtttattccaatttttttatttctagatctctgagttactttacctacatgtgtttcaagttttcgtaaacaattttaagaactcttaaacgtcttctcagaccaaatcagaagtgtgcattttgcttagactccaactatcactaatgggaaccagaaaaataacactttaagatttacatttaaaaccagttattggtttaaagtttcattctaaaattttagtttcctttcagaatttcagttatcatagttcttcagaagtatacttatgaattggcattaacagaggataataatctataaatagactgatgaaaatttggaagttttatggtacagtgtgtcttaagggaatattgtcaaaccagcagttttctaccttggcagtttgagacatcggttattaatacttttaattttgtagaatggtttcttatattaaagtatgtttgtcttatttgacattgtcattgatggttaaagttgggaggcatcccaaatgtctgttctatgtgtttattaatataataatacacttagcatcatatataataggggtgtcatgggttttatgtgtatggtgagaaaacatgaagatctccctgatgtgtttttaagatactgggtttcagttagggtgttatcaaaggacctggatggctttgtaaacaaaaacaaatgccataattttgtattcattacacagtttaacatttatggattttggttattttgcgtaaaatgtactttttattagattatcctaatattatacttacttagtttttaatatacttgtattaatttcttataatataacaaaagtattttttccattcacccacattttgttagcatagatgtttatcagatctctgctgagcaccgtatattgcttctaatcatacagatgccttaaatattaccagcttgctctgtaagaataggctagtgctggcattttcattatcaagtgaaagtgtttatataaattatttttacctgaatgaaaaattgttaactttataatgcagttaatcaaagtttattttagaaatgaagtcattaaacctagtattaaatttgagttttaaaattaaactaccagtttgtggcctaatgagccccaaaacatgccaacattggggaaaatagatcttgttttgagctgaaaatgctatccagacctacttaactttgacctcttaaatgagagccattttattttatttacagataaaatatgctgtagcattattataggactgtttaaaaagacagccaattaaatataaattttatggaatataagtattccataaaattttggagtaaagtaggtgacaattgtaacctgaagctctttcaatcttgagttgaatttattaagaaaaatcaaccccccctagtggcggctctcacattgaaaattatctttattagtaggaaatacattttaaatgtgttcaatttaatcccactgaagtatctccaacatagtagactctcaataaatatttcctttctttttggagtaatgaaggttgggaaattaaaggctctgaagcaactttacgtccaattcatgttcctaccttcaagaagaaaatatcaaagataactttcattatagaatctactataactttgcttagactgttgccccatacttagtgaccctactcagaaaaagagaacaaatcctgtgtttattttattctctttggaaatgaaagtgtttatttattttgtctcatgaagatagtcaaaaaggccattatataattaaatagaatgtttttccctagtgataattttgtatatatttttgtatttttaaggttttaatcataaagaaaaagttgtaatggatttcagcttacctgtacatagaaagttagcactgaatgttggcaaataataggtgttgagaaaaggggatctacactttaaaatgataccagctgtagtggtgattaagccattatgaagtgtcagaactggaagtcacttctgagccttagctgatctttctttaaaatgcatactgataaaaacttttacttttattaacatattaataatataaaagcattgtcttgctattctttttaaatgtcatgaatttcatatatgtaatactgaattgtattacttacataatactcattaaatgttttctataaatttatggtgccatttttaaaatagcatctaaaataaaagaatgggtcttttcatttacacaattatttctccatcatttttctttccaatagctttagatagcatatacatagtagttatggacacttgcttattagaactatgaaatgaagtaagtgaaagtgtttagttataggtaacattaaatggcaaaaagaggaaacaggtataaattgaaagcactggatctaaactaaaaaatgaggtctagtttcttcactgttacagatctgggcaagtttcttgaccaataaagcacgacagtcagcacctgtactgctactctcacaactaaaacagaacaaaaaaaaaatatatatatatatataaactgtgaagactgctaaagatacaaatgaaacagaaacgtaaattctattcttttagcttacattatcacagaacaatcaattcgcccgtgaaacagtaagaggcagtatacgattatgttctcaattacggctacggctgaaatgtgctacttcactggtgaataaatttacatagtacgtgcttactcatgtatttaattaagacagttacttagaaataaataccatacaaatcttttacaacagtacctttctacttttatgcttcttttaaaattgatattttgctagtggcttaatatgacaaaagatgactgtttattagcacttattctgatacaagcttgcccagttctttacatcattttcttcatttttataatagtactaaagaaaggtagtattatttaagtttatagatagggaactgagattcaaattcagagttgctcagataatgagaaagagtttggatattggatcccaggtctttttgcttcaaagcttgtgttcttactgacttgtgttcgtactgtccaggtgaacagattcagtgatgcatacagtacagccatatcctagggattttcactgtttcttctcagatagtgttatggctgaaataaattatttgtcatttcccatacataatttgtacttgctcatccccatacttgtgtttttacgtcctttcctcttagagtcttttctcctgtcttattgatttgctacccacctcccttcctctttaaaacattgtttttaaaggctgcataatactctgttgtactaatattctataatttttttaactgtttttcttttgggaggaaattttattcccaaccatttaatactttaatatttcagagaatacccttgggacgtgtaaattttaatgcaaatttatttttttaggaaaaaattcctgtaagggaattttgggatagaaaagtatgtgttgttttaaggttgaaccaaatcgtacactccaagagatagtatcaaattaagaaaaatttactaattacattccatcatcaatctggggatgtgactatatctttgcatttttgcttaaaaaatattattgtcaatttcataggcaaaagtgtggttggtaattaaagttatatgttgggatcatggttatgtataggagaagcacttgtatttgcagattttctacttagggtgtcctttacgtattcatttgttttgtcttacatttttcagtcatcttttagtttgttctttttacttctttctattgaaatattgttttaaaatgtattcctattaaataatactggcagattttaaaagtcaattatatatgtggcacatcttaagtatagcatgtgaggccttatcttttgatgtcttactgtggtagttagggattttagtgctgtcttgtctcactttaacctttttcaccttcctgcatcctcccaatatattttatcacaattttggattatatacacattagtgttgtattatttttgactgtatattgtttactgtttagctaagtaatatactgtgattatatttgccttcctgttctatgctattattgatttcttttctaccatcttcctgtttattagcatctgggtttagctgtcacttaggttcatcggagacagagtttgtgtttctggctcctgcttttcttgttttggtgtggttttctggaagagaagggtagttgcagaaagctagatattctgccgtcacagaaacagaagtgtcttgcctgtatttaagacccgatttagatgccacatctccatgaactcttttgcagcacctgtgttactgagcaatatattatgcttgattttgccatgttataaaatatatttcctcctagtaggaaaaagaatgtctttaaagataggactattatttgtctttgaaactaccagagcttcccagtacagtaccatgcacttagtacatatttgagatgtactaatttaacaattaactaccacttaaaatttttttggtaatgttttagtgattctggtaaggcagatacattttatgcgggttcgagggggaataaaaatgtgtgtttgcgtagaagaagggggaggggaaacaatgagttttccaggattatggaactagtagtggtttctaggccatatttcattttcctgatcttccctgctaatgtcttgtgctagaaactatgctgtttatatctcatcatctctcctcaggtatagcaaacaaaagggaaaggaaagaactcatcacaattatagggcagcagcaggagggtggcagaagacttctgactcattaaaagtggcttccagccagaattctcagaagtttttgtagatgtttttgactcatatagggaaataaaatatccagctgtgttcagcctgacaatgaagttggggtctatttgtgctatgtgtcacctccattacattaagcacatagtttatgattgtaaatatttgaaatttatattcagagataaatacggatgcactgaagctgggggaaggaaatgaagaatgaatggggttaagagttgggctttattgggtgtaggtagtatggtagggggattttattgaggaatacttcagatttcctagctgttagatggagagtagcaccatagtgctgagaagcgggtgcccaactccaggggaatgttgaatggaagggcacagggtcaggtacagggactggaaataaagataaacaagttatgggtaagtagaccaacgcagtaagagtagattaaatcaccccgaggaaaaatccgatagagcaaactcagtactgtgagaggcaatctcttgttaaaaaacgtcactttgatctcataggattactgaaaccatatctttgcatgtcattttgaggttttataatgaatattatataaaacagttatatttatgagtaaacttggttaattttttcagctttgcttcaaacactggctacaaatgatgaacctcatagacttttttgatggagatgttaaaaaggctttcaagatagcattcagactggcattgggcatactgttgggcctgttaccaccagcagttaaagcttgcagggcttctaaacagaagcatggcatgcagtcagctggagtcttgatttcataacaattttacagattgggacaagatttttgaggtaaaggtttcaaaaaataataagttactcctttgcctgaccaacatcatacggtctatttcaggagatgtttgaactccagagctcccaaatccaatcttacagggatgtttatttatatttcaaacaggcttttccttaaataatggttagcagtgtcctttcttaaagattcgaagacaatacaaaagtaaaaatattagcgtaatccaagtcaagtgcagttaatgtaagattactctatttttaattgttctgtatatcttcaagatgtatggatagatattaaatattttaacaaaatctgtacatttctcacaaaatcagtgaaaaagtgggtcaaatgcattacctttgttagctttaacaatctgacattttaaaagcttcaaatccagtacatctgaattgttaagttctgagggtacttcttagccctgaccttaattcctctgtgtatttgactttcttcctctgtgtatttgactttcttctatgacctccaaaatattctaccctggtttttttccgtctatcatttcttctctgtgtctatgcctcttccatagccctatacctaaatgttggtattactgaggtctatcctcaagccacttttttccttttctggtacagctctcattaggaaatgtagttgttcttctgagctacaaatcgcagaaccatttgcaacctctcctcactcaatggtttcctcttccttacttcctatagtgagttagtttagttcagtgaacatttgagtctggcttaaatctctcttcaagccagtcctttcttaacctcactgtcactgcctttggtcaggttgtgatcattccttttcttggcacttttggtcagcaaacattaattgagaatccactctattatgctgggcattaaggatacaaaaatgatttaagcttacatagaaataagggtgttaggcaaacaagtataagcaattatgttacttgacaatggaaatttgctctcatgttaaatattttgtaagacacatagtaatgcattagaaatgtagacaattttgcattatgaaaagcaagcctcagaatctagtgtgaggctgaatattgcaaagagccagcacaagacaggcagcagtaccacatggagggatacctttatgttactattagttctccctgtgtcatagcatgttgccttgtttcagcgtttgtgtcactctcttctctccagtgtttcataatcattactggaaagccaccaagagtgcaggactggattgtgtacacactttctatttctgtgaagttgtttgtatggaatattccttaatggaatcattatattagacatttgtataagaagtcaaatggggcagagttgctaatccattgtgaggtaggtcagggaggacttcatgaaagtgatctacttgagcggggacttgaaaccaatgggacataacaaggaggttgtatgaaagcactaaaccacatgttgtaactgtaagtaatttcttagctctggggtagaatagacaaaagcggcttcaatagaagaaatgaagccagaggggtaaatgaagctagaaagatcatgaaggattttgtgtgctaagctaaggaacatggacagttcagagctactgaaggagtttaatcagaggagtgacacagtcagatttatgttttagaaagaagttcctggcatcccggaatcctaacttcagcgaaccctgccctgctttctgtatactctatcaccagagtcagcttggtgaaacacaggctgatcttgtaaatctcagctcaacacttaagaacagatgcctaagtccgatttctatcgttactttgctgtctcctctatcttgaacatttttgcatcagacacccacatagctcacttcattttactcatgtctgtcctgaaacatcacatcagagagaccttcctaggctgtccaaaccagcatcacgtctgtcaccccttagtttcttaccttgctttatttttcttcttagcactcaccgccctaaaagttatatgtttatttgtttatttctccatcctccacctaggatgtaagctccatgacaacaggagcttttgtatattttgtttacctgtaagtgttctgtgctgggcacttgataggtgttcagcatttgttgaaagaatgtggccccaaccatccttcttcttttctctctttcaccctgtgcctctcccttcatgtgggggaattcttacagttcactaatccttagttatgcctcttcatgaaatcctgtccctcactcaagatccatctcagataccaccttttctgtaaaatcttttttcaagcagttgctgcttctgcttagctcccataacactttttgaatagttaggagaaaagtgtttacctgggctgtacaggatgtgatggatataaataaatacttgtcagcaagttattaattaaccagtagagaattacacaatgaggtagacaagcattataggtaaagtttgaaattcagttggttaagtggagaagtgaagtaattaggtgtgacttgaaatttgtttataaatgcaatatgattaggggaaaatagctaggggaaccatcaccaatttctattatatacacagttgtacagacaacctggagaaggtatctgttgatacatacataaacacacacacacacacacacacacacacacatcattttaccgatgtattaccttttttgtagaagtatttacttttcatcttctttctgcctaaagtattacttctccacatacatcactgaaaagaaattatctagaaatgttttgattgggtcatattaatagcactatgcccaggccaatttctactttacaaaagctgatataattccatttgaattgtcaaaaatgtctttgttgtaagaaaacgctagataattactcttctggctaacaggaaggtatagaggtataaggtataaattactttagtttcccagttcagcgtgggtatctgatgatttttaaattcactttaagtgattaatgtctgctgtgaaatcctggctggggtctttgtgtgaagttattcaacttttcttttctgaactcatgttcctctttgacccataagtgtctttattctcaggtgaaaatcatgctaaattgtttagggttccgttgaactttctaattgagacacaagctacgaaagctaataattaagtataattattgtctacatgtaaaagcaaaagttgctggtaatcaccattaacctctaatatttgccaacaagaaatgtaaatagcaaaagtcaaatttattcttcttttaatatttgaggaccacattagatggctggaggaccatctgcaggtgtcagaggggctttgggacattatctctaatgagttgaaagtaaataaatacagaaagctggtgatatgaagataaatactttatttagggttgtccttgtttattgacaacgtcaatgatgctgagatgcttcctgtggaagatagcaaaggaagtatgattttcatataatttatcacaaatttctctttttaattttccaccaaacaatggctaatgcatttgagaggggaaaaaaatcccagtagatctgttaattgggaatcactgtgctacaaatgcttgaagtataagcaaacattttcctatgatgagttcataagctttttaatgaaatattcggaagaatttaacccattccctgtttttcttaagatgtgaaaggaagattttagaaagacttacgtaaactttaagtagactttaaaagtttgttgtgttagagaaatatttgaggagatgttataatgcaatagaaatttttgctttatattttttaaaggattttttatggtattttgtttgtttttcagagtaaagccaatcccagctgaaggaatcaagtcaaatccttccaagcggcatagagaccgacttaatacagagttggaccgtttggctagcctgctgcctttcccacaagatgttattaataagttggacaaactttcagttcttaggctcagcgtcagttacctgagagccaagagcttctttgatggtaagacagaagggtttaatttgtctacaataacgtataaaaaatacttgtactagatatagctgtttctgtgttaataactacaaaaattagccgtatttggaaaatttattgctgtatagtaaaatttcagtggcaaagccagatttataagtcttaaaatcaattttccagttttattcacccaacagatgcagccactgaaatgatgcatggtatcattctttgaaaatcatatatttagaagttacactcaaattgattatgtcaaattccagtttcccttctacttcaatatttaaaagtcttttttaaaaaaaaagaaaagataaaacaccatcttgctggattttctgtgttttcatagacatgtcattttatttatccctccaaacttacgtatatttctaatctttttttttttttttgaggcagacttttgctcttgttgcccaggctcgagtgcaatgacacgatcttggctcactgcaacctctgactcccgggttcaagcgattctcctgcttcagcctcccaagtagctgggattataggcgcccaccaccacgcccagctaattttttgtatttttattagagatggggtttcactatattggccaggctgctctcaaactcctgacctcaggtgatctgcccgtctcagcctcccaaagtgctgggattacaggcatgagccactgcgcctggcctatttctaatattttacattaattgtataccgactgcaagaaatataattaaaacatgtttttcactagaaagaacatttgattgtaagagtcaatagaatttgatttcattctctattgtgtcactgaaaactgtttgtcattaaccaaaccaggtagcatccccgtatctcagttttctcagcagtaaaggttggggttttgagctaggcagctggatgatatttgttacctttaaattgcaatggaagtttttgtttgcaaatgatgtttcagtgtattttctcatgtaaaattaatttttgatttatcttttatctgtctataaggcagaaatagattttttaaggaaatggtctttttaaaatatcatataattttactaaccatagcaagttaatgataaaatctcagtgggctatgtcagtcaatgcttctcatacattaatgtgcttacaaatcacatagggatcttgttaagatgcagattcttgttcagtagctttaggtgtgtccctagattttgcatgtctaacaagctccgagatgatgctgatcctgctggtctaggtcactaggaagtgcctagacaacacgtttatggatatttgactggtaatttgtgtttagaatattgcaacagttaatttccctttagatttatgtttacataatctgatgtgtttcgtctgagcatctttttattgatttgcttgcttgctctcccgtctttcttttggacaaaagctatttagtttaacagttgtggtctgggcaatatacagatttgaggatagtgatttcaggaaagattatatatttcaaagtttcatagtacacaaattttctctgacctatataaaaagtgtttgaattttcagttgcctctataccaaacccttcatcttgggagaagagttacgcagtattcagtgatggtctgtaagtatgtgtgtattagctatagtcatttagctgacatagttggaactagaactcaggtttctagattccttatattgtttttcctgaccaaataatacctacttttttctgggaaccttcgcataggaaagcactgaggattttttcctagacctgtggttcttaaaagtgtagtatccagacaggcagcatcagcatcacctgggaacttgctagaaatgcaaattattgggtccaaccctagacctgtggaatctaaggtggtgggacctttggtgatagggctagatgcatattgaagtttaggagccactgctgtagattgtaacttcaggcctcctcccagcgtcacggaatgctgtcctgatccctagcatttactcacatgctgtgcttagtgcttgaccatgtggtggcagattctgtgatgtgtaagacgtggttgccacccttagagattctggagtctagaagccaaggaggcattattctctgactctgataaagctttattgacttgagtcattttacctttccatttcttgttcctttgtaatggggaatcaaattatatatgttaaaaagaaaaaaaaagtataggtttttcctctgtttagaagtagtacatatgtgtgtatctagacagatacatataaatgtgtgtgaaacacacatatataaacagatatatttctatatttaatgtctacattatgtgtgtatgtgtgttcatgtatgtatacacacagacacatacatgattagataagtgtcctattattcagtgcttcaagtaaaggagatctcacagtctatcttataaagcatgtcatagtttaacacagggttcatcacggaattgttaaaaacttttttctcagctcttcattaatgagtttgtctgttttttattctggttcagtgtatttgacagtaggatcttattacctatttgcatgattccttcatcaactacattatcattatctttaacgttagattcttttcaaactgcattgtgcataagaattacctagaaagctttttaaaatgcaaatttggaggcatgcccctgctgataacaaggaagttctgtgtaaaacccaagaatcagtattttaacaagcatgttacggagtctgaggcagtgatttagcctagccttgattatgccctgaacaagttaatttttgtttctttgccttcagaatgacaaatgcaaacatacaaaatttaaagaagtctatgaatatttttgcttgtgttatagtggtgtacattcagcctaagcagtttcttagattgtttgatacagaaacatacagttagatggaaaatgaaaataataaggttttttttttaatccccaaatttcctccagactaccagtggtctggaaaggcaatgcaacatttcagagcacacagagaatgaaattataagggtgacccttatgaactgaaaaaatggtagatgcaaacgaagagatttgaaacatgctaacaatgattaggatttttgtgtgcagttggacccactcttccactattagggaaacagtatagcgaagcgaagggaagctcaaagtgaataacaggatgcaaacagggggtgtgtaaattcctgcggaaagaacaatataaacgagtaatcatacaatcttgttagaaaggaaactcaagttttactgtaacaatagatatttttccaagaaaatacatctatttattgcaagtttaaataatccaacttggatggatcttcttaaagtttggaaccatgactatactgctgctgctgtctgaaaagcaacactataaagttttaagtactacattaatatttatccatttctaattaattaaaacatattgaaatataactttaaaatacttgaacaaggcttagcaatttttcagttataaagtcgaaaatagtttctttgacatgatttaagcattacatttaaatatattatctctgagatggagggtattttaaaaatttaaataacaatggttacaatcaataatagtttattaatagagactaggatttgggtggttacaatctaatctttgaaactggttgatgtgaagagaaaggattgtttcctcctatatcatgtctctcaaaattgttaaacagtgtacactgggcttgttgatcaatctaatcagcattgtaatgtttcattcctaatttcagcatatctttaatacaatttttaatgagatttccttactattttttgaaatgcccattattatgtaaatattttgttcaaattattctgtttttatacagctgccccaaaattgagaattcgggaatgactacttttgttttctgtttacatacaaacacctaatgagcctgacaaaatggagcttagggatccgagtttctgatttcaaagtcttgcatttgcagctgtcatagggaatagtagtattctagttatttttaaaacaaggtaatgttagggaaaatctaagtcttgaatcattatacatgcttaaaataatcaccattttataaaatgtagaattatttacatgttaaaatattttcattcattaagcctaaaaatgctgtgggaagagaggataatagttatattatgtgatgatctaacatttatttgaccccattgtttatcatggatctttcttgactttattttaaattaaaaattacaagtgctctgttcttggtcttccttttgcagatgctttaacagttcattcccagttcattaggttttccaaagagagctattgtgtttattcatcttcagcttgtgcatttctctgaatttcagttgttttggtatctctctagatcagaacattattcttgaaaaacaagtatacgtacatgtgtatatgcaaagaacaagcttgaacaagcagtaaaaatgaagtaatgcacttctaagtgttgatgttttataaaatctaatagatttgtatgtctgctttttcattcatgagaattctataatttcatctgctttgttgtaattttaaaatttctgtgtgtcaagtaatttaccaaagtttcagtatgatagtatcatagcaaatgttatttcttaattctaggactatccaaagtaggtttgtttgcataacagtttagcacatttgaaatcaccaaataaagtatttgttgaatttgatttacccatggcattatccatcttaaatggtgatttaactgttatcttttttcctaattcacattttaaaacatgaaactctaattacaatattcatgataactttcatagctaaaactatataaacctaggttcttttaaaattttaatttatggaacccctgcagatttaaacatgaataaatacaaagaatagtagcgcattcttattgaatgaatatacaaatcctggctctcatatttaatattgtgacctctttggttcaggaatttaatctctcttttcctcagatatcccaatttacagtataagatttattagattatatgaataaattaatatgatagaactttatataggatacttttatctctgcttttgtttgctttgacaactattttgaagaacacagtgacaaatatctgagattcaaacaatctaaactcattgtatcatatattatgtattttgctgctttcctgtctcttttaaatttactgatttaatggatttctctttgatcattacctagtcttgcatggttctagaatccttgcttatttggccatgaacaggtcattagtcatcattttttttctttttagggagactaccgtgggctaacattaaaatcaccaactttcagcaattttccttttttagaaaattttcaaatacagacatttaaaaatctgtagttaagtcttaagatatttcgtgagggtttgtgatctggttaatggaaatgtacaccttcatgttatagtgttttataaaacatattcatatataatattaattatattaaaatctgaagaaatttttatttggtaatatttgtatattatttttaaatcttgctcttacagccttttgacttttcaatcaatgaattttaatgagtaactcaaattcgtttatttgcttatggctggagatttagattttagagtcattttatcgtcagaataacattttaagccattaaagtgaataaaatattccagggggagaacatgtagaataagaggaaaagtaccaaagataagatgttttaaggatgagcaggggtagtaaaaagtgaaatctgtggagtatgaaagtatgctaaggtgatagagttgacttaagatactttcatttgatgtgttcttaaattggagagccagagagaaaactgtacatgaaagtgaaaactgaaatgaaatgaaagtgtaaactgaaatgaaatgaaagtgtaaactgaaatgcaatgaaagtgtgtacagaaaaataataacactagagaaggtgatttctgttccttgtttgtccatagaggccaaaaagccattcagttgttagcagtgggagattaagagggagacaaatgtctgggctctgtggctcatgcctgtaatcccagcattttgagaagccaaagcaggaggactgcttgaaagcaggagttcgagaccagccaggacaacgtagtgagacctcgtctccatacaaaataaaaaattagctgggcttggtggtgtacttctgtatcccagttattcgtgacactgaggtgggaagatatcttgagcccaggatgtcaaggctgcattgagccatgatcgtgccactgaacttcaggagtgagactgtttcacacacacacaaaagacggagacaagtagtctgatgggattggttgacataaagaaccttaatgaattgtacctactgaattcttcatgtattttctagcctgaaattttctcatacaattgtcatatttacagagcattctgttgtcagctggatttttttttatcgtgtctaatttctgtgttatggagacatttcatctctttatctcagcatggtagagggaggttgtgttttgtgattaaagcactgacagcaggagctgtggatgctagttcagttaacgaatcttgtgttttttgatagactttaacctcactgttccacagggtcttcatcttctcagcatgtttgataaagatgcttgcttgccctgatatattaggtttgtagtaaattctaaaaatgagagatctgtgaaaaatttttataattaaaattgttactgttatggaaatcatagttatttcctgcagaatcctgatatttcacttgttttagtggagaattttgtttttttttttttttttgaatatgcataagggcctttacggacctggtattaatatcaattgagaatccctttgtttaattaatttcatattttttatttagagatggaaatttgttaataaactgtttttccccttttgatataatacataataatttacttacatatactgttttcttttatcgaaagtggcacatattccaaatctggacacttggaaaagtgtgatagcttgctttggtgaggatagaaattttgggcattgtatgctacttgctttattgggatacatgtcaaattttctgttattgcgctatgtcttaagataggtgcttcagcttttgtgtttgtaaaattgttattatttcccgaagaagttcacaataataactgtgctgaacagcatggaatgataattttaagaagtatgagggaattcaatccagaacatacgtgagttatttcctaaatcctgaggttctaagtctctgtttctcaaagaatggcacctcattctcagcatcactggggaacttgttacctatgcaaactgtaaagccctatcctagacctactgaatcagaaattctagaggtgtggctaagcattgtattttaagccttccaggtgattctaatgtctgtgaaagcttaaggatcactgccctcattgagtatttacattatgttacttaaaatgcaatttaaatactactcttgtatatatgaaaagctaagtgcaactcattccccactgaaaaggtcaattaactgctcttgttccattaatgcagagatttgtcatatagttatagaggaattgtataaaactgagtgcgtaccaatgagtaactggaagaatgttaaacatctttggaagtcagtttttatgtaagagtttggatagaacaaacttttaaggactaccctgccaaagtagtaaaggggatggtaaatattatgaaattaattgaatttatagcagcagttagggactaaaaggggatatgctttccctggcaagatcatctttctgtttaaatgcaaactatagtaacaaaatacaaaatatagtttaccactattcggtattcctcatgaatttttttttccttgaccaattcaaagcatgtgatatgaagagatgtggcatttagggagtaggggaaatctgagcttagatgtctaaggaaggaaagtaccgtattaggaaacatggatatggttaaatgcatgtgggaataaaacttgagtcatctgtggtatgaccatttgataatgctgtgatgtatttgcactctaaattccatcatttgttagattaaattcttatttgtattgtacgactccttcatagatctttcaatgaggaaatagtggaaatattttggtggtttactatcttaacattctactgaatgttcagagtctgattctcacactttggaaagtggtacatatcctcactgatggggaagattttaacaaatgcccattacggtacagcagatacttcccagctggtgacctattttcagatactacattttgtttctgtggactgtcataaatttaattccagtggtgtaatatttaaagtgtcgttatgcatataatttatgtaacaatttacagttttgaagtatagttgacccttgaacaatgcattaataacatgaacagccgattaatgtgtcttttgtatatgtattatatactgtattcttaaagtaggccagagaaaagaaaatgttattaagaaaatcataaggaagagaaaatatatttactgttcattaagtggagtggatcatcatacaggtcttcatcctcattgtcttcatgttgagtaggctgaggaagggttggtcttgctggcttgggagtggcagaggcatgtaagtggacttgcatagttcaaacccatgttgttcaagggtcagctgtactttcaaatgtgtcatatagttaccatagtaatcctattagatactaattactgctttccacttaaagatgataaaaatactcagttacctccttaggggcactttaattgtaagtttctcatcatggtttgagggtgtataaagtcagcatagacttcgttacctctgtccttgattgtcagtgattgattccaggcattaccctggtattgtacatgttattttaatcctcacaagaatttgtctcaagaggtagcattgtcctcatttaaagatgaggaaactaaaggtcaaaggtagttagcaaagtgggcggtggctaataatagctcacacactgaggtctggctacctgagtttttgtctaagctctgccacttaaatctctatgactctgaacattttctcaatctccttaagtctcacctttctaatatattgaaataacagtgtcagtctcatagaactattatgaagattaaataggatataatacgtggaaagtgctaggtgtacagtgtgtgcccaatatcacatatgagtactaagtaaggtcactccaatggtaggaagcagctcttgtgacagtgtctcatgtcactttcttactcattgttttctttctaatcagcacaagcaatatatacatgaaaatgagtagtattgatagagcctctagtaatttactaagttagaggtagtaggcatgagagcaagaaatagaagaaaaacttcatgcaggggtagacattacatagtttaggctgaaaggccatgacataaaatgtttcctgaaaaagcacagcagtgtttttttaaatgattttaaaagtccacccttctcagactcatctttgcacaatatttacttcaattatttaccagtgattaaccttaaacacaagagcaacagaaatatttgcatatttgtttttggtagaaacctccagtgatcattccgccaaatgaacttgtcacttttcctacttatgtagtagttacacatattatctatcatccttccaacatttggaattataagcattgttgtttagaaagaatttgttctttttattttttctctacttcaagttcctgtaatactttaattaaaccctattctggtacttagtatttttgacattgttttctagttatttccatagcttatatcccctacttaaagacagggtctgactcaagtgtctaattacattggctaatactcccagtacaagcccaagaacaaattataaattactctaagatgaatggtctctttcattgcttagtcatcttctcagtgatcaagtagttatctcttaatatttatgtttttctactgccagtgactctaggtggaactaatatcaattgtgttgattaaatattaattttaagagattccaaacaataatttagatatataaagtctgacactgttattgtccgtttttaggcttatttcataatgtaagggtttggctttgttgttttctttttaaaagcaagtgttactgatgcttcataccagagcttttagaaaagtaacagaatatagttgactctgacgttgtatggttttagtgcattcaagcaaatgtggccattagtaagcaagcaacaacataacttaccgaatagaaagggagaaaaggccattctctcttctgccattctctctgtgtacagattaaacatttcctttggtcttgatgaactgttaggtcagtttacctcaaactgttttttggcctaaggaaatctgttctctggccttttgaagttacattcagagaccgtgcttttggctgtttcttgcaaagagatatgttttaacttctgcaaaggccagaatggcatgagattctggtgtgacacattcactgatgatttaccagaaaatacactgcaaatatgaaagactgcagacaggttttatatgtggaactctgctcagactgagagaaagtctagttattagtaaatctctagttttttcagagctggattattttgtcacataaaaatatagtgagataaatgttaagaggactgccagagtcagttttatttaatggtttctcttattcaaatatcacaggttaaaagaaggtcagaaagtggcaagtatctaaaagattatgctttataaccaagcaatccataagctctgagaaatatttctactaattacagctactgtttgttgaacagtattgatccactatgtgtcagaaactttacatatattctcattactcttcacaacagccctgcaagatgtgctttaaaatttttttttttaattaccacctcacatattaggagacaggctcaaataactcccacttttagtaaatgtcagaggtaaggtttgagcccaattctgtcagttaccaatatccacatgcttttaagtgagataatatttgaaagtgcttggcaaaatgtttaagtggtagctgttattatttctattcagctgcgcttcctcccagactataaatacatacataccacacacatacacacacacacacacacacacacagtgaggaaaaaaaagaagagatagcattataacatgacacctccaatagtaagcatcctatcatgccatcagactttccttcacatatataatccacaagcagttaaaagctataccggaaaagccactttacaagatgtaatacctaggagtaaatataaagatacctgtgcacatcttttttgtagacaactttaaaacattctagcaggacaaaatatagacttgaacaaatggaaagaaatgtatgttcttggatagaatgattcaagattataaagacattaattctccatgagttaatttataaatttaacatgaacctattaaatagtcacagtaattaacagtttttacccaaatgctggacaagaagattccaaacatcagaaatccatctctcaataaggtgtatagttgctttttttctcctcaccaccaccagttccctaatatttcaataaatacataaaaatgttggattcatttttataggttacattatggagaactttagtctcctaagaaaggaggtaggagtggagaggagtgtttgtaacagtgttgtgcagttctttgaaactcctaagttttgtgacaaaattatatcgtgaactcatcaaaaattatttttaacaatctgtcagctgacaacttgactaaacccttcagttttgttactagcatagaataaggagctacccactggcaacaggattacttacctagtatttattatttaccttgttttagccaaatactaaaaataccagtggatgccagtatttcaaattgtctttgtttggtgttcagaagttttctattatagctctttactcttgcttacttttaaaatcattgtttttcctttttttccatagttgcattaaaatcctcccctactgaaagaaacggaggccaggataactgtagagcagcaaatttcagagaaggcctgaacttacaagaaggagaattcttattacaggtaaattttagtaaatatagtttcttacactaaggacagttgtaaatggaaaatgaattaataagtcttttagtaattccctgtttacttaggatttgctcaatgttttttgccactttcatctgaactgcgatagtgaatgatgcttaatacatgaaaaactggaattatagtcatgcaccatataatgatgtttcagttaacaacagaccacatatgcgacagtggtcccgtaagattataccatattttttactgtaatttttctagtttagatacaaaaatgcttaccatgtgttaaaattgcctacagtattcagtatagtaacatgctgtacaggtctgtagccttggagcaataagttatactgtatagcgtaagtgtatggtagactataccatctaggtttgtgtaagtacactctatgatgtttgcatgatgatgaaaatcacctaaccacatatttctttgaatgtgtccctgttaagtaatgcatgactgtatatgaagtagattagttagaagaccggtcaaccccttctgttgtattaatatttcttcaaacagcaagaactcctagagtattttagaggttctaatttaagatgttgaatttatatatatttttatggaatgtatctctattaaaattgttaaatgcatttcttaaatagtttaaaatagttcttaacccaaatttcattttgccaatatgttataacttacattttattttagcaactgtttgtgacttattaacatactaaagattttctcaacaactccaatccctatttttatgcttcagaatttagtttctaatttgtctatgaaagcattttgcatctttttttactcttttttttagaattgatgccatgattgattctcacttaaaattctcagatacttattttgttgaaaaaagatagaataaagatgtgtgccatgtgtgctgtcaccgctatgtgatcattatcagtttcacccactgaactgactagaaaaacttcaccattgttacaaaaagtaaccctaagtttcggtaactccactagttcattcagtggatggtgatgtgcctaataatataacatttttattacaattgtgtaatcacattcaaagtcctgttagcaaaaattaacttatgttaaacaaagtaaatctattaaagcatgagtcctcccctagccccaactgaggatcttcatgtatatgtaaacccaaacataaagactccttattcaggtcataggaaagcattttaataattgctatttaagatgattaaacacacctcttgggttttctactaagggcctaatgaaatcccgtatttcaggtgaaatagacagatatgtactgattgacgtaacacttggcaagttggtttaaattatgggccatttttatttttttcccaaaacatttaggcaaattgtgtacataccctatgtcagggaaacagaataacaataatatgaatgcaaagctgtaaagctataattatatggaatatatatattttaaattatctgcaaattggtaacccttaagaagttaaaataaacttacctgtttatattgaataccatttgtagattgctcttttaataggaagactcacattctctatgattttcttaggattgtgcttatatgttatctttttatgaagaagatgactaaaaacattatagatatgtggaaatggctgtttgattataacaattgcataatgacatctgactttatattgcaaccgacggttatcagccaattaccactacagtgtgaaaggtgttaccagaggttctgtataccatatggcctaaaacttttgaggagaaatattttcctttgcttaacaaaggcatatgaagaaaatgttacaaaaatttttattaaaggccaggtgcggtggctcacgcctgtgatcccagcactttgggaggccaaggcgggcagatcacgaggtcaggagttcaagaccagcctggccaacatagggaaaccccatctctactaaaaatacaaaaaattagctgggtgtggtggcgggtgcctgtaatcctagatacccaggaggctgaggcccgagaatcgcttgaagccaggaggcagtagttgcagtgagcagagatcacaccactgcactccagcccgggtgacaatgcgagactccatctgaaaaaaaaaaaaaatttattaaaagtttaagacatctttctaggttagcttcaatttattactattttacaaggaataaaaatgaaacaatgtgaataactgtgtctttatttacttcacatgtttatttcataagtttaaaatatatctcttgctatttaatactgtattgttaaaatcttgcagctttgtttttcagtgacaggagttgaaattttatataacagtattgcagtttctctgaaataataagtgagcttaacaaaattttcagataggttgagtgaatctttgtgactaaaagaatgatgatctcttttatttaattagcatattaattccttctgttaatttattgagagaaatcaatacaagtaataaccttgggtctcctggtacttgagatcatttgagatatataaaaattgatgtgcatctatcgtttctagatttttatttctgataataacatttgtctaaagagatttgataactgtacttaaattatccttctgtcttctggcatgtacaccaatgagtttattggaatgtgactaaatttgtttcactgtttgaaaaagtatgatgttctacaaaataatatgaatgtgatcaatggataatcttccctagaagcagatattttcaggatgaatcagtgcaatgacggatatatagtgttactgccaagagaatttaagaatatccaattttgaatgtgttagtcattaactattcaagttcttatgggtagaatcaccattgtttatcctaagagaattgccaggtattacatatcatatttgcagtcaaaaacctgagagcctgcttgtggttaaagggacatggatggagccggaggccattatccttagcaagctaccacaggaacagaaaaaccaaataccacatgttctcccttataagtgagagctaaatgatgagaacacatggacacacagaggggaacaacacacactggggccgtttagaggctgcagggtgggaggagggagagaggatcaggaaaaataactgataagtactaggcttaatacctgggtgatgaaataatctgtacaacaaaccctcatgacacaagtttacctatgtaacaaacctgcacttgtaccactgaacttaaaagtaaaaaaatagaacaaaacagtcagaaccatgcaccaatttgggatcgataacacataaaggcagcatatcatgttatttaagtgagtacgctttggagccagactgaatttatctcctggatcagccattttctggctatgtgaccttgggcaagttacttttaaaggtatagtccttgacctcagtttcttctattgtaaaactggaacatggcacttacctcattgggtttttgggagaagaaaccactcaaatacataaaaacatttagaaaaaggaatactaaataatagttgttatctttgtagtcaagttcttagaagtataatatagatcaagaatcttgaaggtggaaagtaattggagtggaaagagagacagtcactgtatttcatttatttcatctgataatgaagatatcgactggactatatgtgagcagcataagcactagggcaaagacttgttaactcttaaatcccagtacttagcatacatatctcctcttgggtatgtaatagtttattacgtgttgaataaatgaatcactattatttatatagctctttatagttctcaaagcatggtgatataaatctttatttgctcatttctacaaccatataacattgtaccttattacactgagtgctggctctgtgccaagcattgagttaggtgggatatcgtcattatatctacctgatgaagtgccagtttttgaaataacactgaagcctaaaaagcagtaaatagcttaaccaaagccacacagctagtaatagacagagacaggagtccagaccaaatctgtctgactacacagtacaattcttaaactaaaccatactgtgtttctccttacatgaaaaacagggtgttagaagacattagctgtgatcacatagtaaagaatagatcaagtaccaaattgaactcaaggagaaaatagtgagggcttgtagaattaaaatatatgataataataaagtgatctatgatactattgttatccaagaggagaataaaggtattagttgatattggacttgaattatccagtaataggaaaagaaactataacatccaaactaaagagtatgggctaataaaaaataatggacccaaagtaggcaaaacagagagaaaaagaaacattatacatgtgaatgtgctgtgaacaaatagaaataacacatataaaatgataaatttaggtatgtgttcataatgacattaaattttagtggactaaattcactgtatgcttgctttacatgtgtattatagtttaattacatgtatattttatatatatagtgttttcctgtaaaagtcttaaaatgttctgtgacttaaaatgttagcatcagtgcttgaaatgtctttgtacaagaagagttttctattaatgttcccagtttaagaatctaatcaacatctttgcctcctgtttccctctaaaaaaaagcagtgtgatagactatagtgaatgatgtctagtttgttttttaaaaaatatatacaatatatttaaaagagaaaatctgaaacatgaagaagatgaattccatattctaccaaagttattctgattgagcattaaatttagccatttttccatagacaaatcaaaaggtatgaatagatatttcttagtccaggagtgtatgttttggctgtgtttgtgaaatgtgacaattttaactattttgaagagaagaattttcagagataaaagtaataacctttatctgatggtcaatattaagtcatattactaattttagaacttcctttccttgtaggctctgaatggctttgtattagttgtcactacagatgctttggtcttttatgcttcttctactatacaagattatctagggtttcagcaggtaagtatatattatttatatcatttatattattatatcatttactttttatatatatttaggacacagttggccatttgtatgtataaagtatcaatatatgctgtagaatacagtatgtatttgtagctaataattttttctaatattaataatttactgcactataattcctttaaacctttatgtgattcatggttactgtgtttcttctttcgcttatcaagaatcttatatataagaaactttcaggcacgtagggtctaggggagaagatacaaaattatttgctatcaaataacttatggatagcagaggatatatgacaactatgaaatgaatgagatgctgttaaaaagtacaagtaaaatcctatgatttatacctttaattctgatttatttggattatggaagttaccctaaatcaaatggtatgtaagctgacctaaataatgtgtaacaggtgggtggtcaagaaaacataggaatattgaagtactgtaagcattagactggaagtcattgaaggaaacagacgtgtctgacttgtttgatgttattgaatgaacagtgaatagatggaattataaatatttgatatattggaagggcaagaacatcttttatggtttgagaacagattgtaacatttgaatgcttgctattctcatatatctggttctcaaattgtactgtgcacaagaatcacctgaagaccttgataaaacttggtcatccctgtgagccccattgtcagatattctgaatcagtagttcacagtggggcccatgaatttgcatttctattaagctcacaaggctgctggtcttaataacagttatatagactagagcttcaactatattatatacccagtggaaaccactgaagggttttgttacagggggtgtgtatatttcaacttgtgtttcagatgcaacttttggaaattgtgtaatggttggcatcaagatgatttaatactagaagattaggttcctaggaagatttaagtgtagatgactaaagtagtggtatctagctactactgctaccacaaagtctaaactcctgatttcttgcattctaaagaaaatacattaatgtccatagaaaagcctgtttgaagcctaatgtattatataactgtcttaatcaggatttgatattgtgatttatattagtaagaaaatcagagagattagccattttccaatccatttttttctcgcatatacacatggatttttttcctaaaagaatattcatatctgacgcaagtggtagattaagacaccatttttaaaactgcaagttatgactcgctcatgggtatgcagtcgagacagtggatcactatcaaactgttttttagttgtttaggatagaataaaataatatagaatacacagtgttatctcatgtaataatggtaagtgttttgtgaaacttttccatgtgtttatgtctgtgcacacacctgtgacagatggaaatgtattttttatcataacttgcagttaaaaaaaaaggaaaactctggtttaagcactaaggactcagcaccgtagtaaatggtgagaggcaagagaaggaaagtgggtttaatatggtaaaggcacaatcccttgctcttgtggagtctacttggagtgaaaattttatatgaagaaaattttagagaacagtgaaggaaatacataaagaataccattaagcttagagaagtcaaagaggcctggggtggttaggaaaagctgcatggaagagataagaatctaaaaactaacaaatgaatatggaacataaacagattttaatatgttgcatttaaggaatggggatgtgacttatttgagcaagagcattcatgttgggaactgatgacaagtaacttttggcttatctgttgtagtgccagtctctttagctttttctaccttaggttctatcttaggtgactagggaattttaggaatcattcaattcgtattcatcaccactagcaagcacccactaatctaaataggctttaaaattaatttagccatattttttaatcagtccttttgttgtattccttgtatcttttttctttagtctgatgtcatacatcagagtgtatatgaacttatccataccgaagaccgagctgaatttcagcgtcagctacactgggcattaaatccttctcagtgtacagagtctggacaaggaattgaaggtaagaattgatggtacaaaaaatagtgttggtagtttttaaatatgagtctgtgaaaggaggctgggaacctgtagggtcatagaactccatgatagggaagtagtggaaagatgtaaagtctgcaatcataggccacagctaggtcacaaagagcctgatgagctaaggaatattttggcaaatgagagccatttaatgagtttcaggcaacagagtattgccatagtcagtaatgtattttataaaaataagtagtaccttcatgaaagatggaaggaaggtacaaggttgatacctgagtgcatgtaaattattgtgtttaaaatgcaccaaagaaaaaagtaagctagcatatgcaagtataaaaatgcttttctcaatgcaaaaaatgtttttggaaatttgttaaagtgttaagaaaacaaaaatgcattagaaaatatgaaaattgttgacagtgatagctcaataaaaatttaaaaaattatgcaagttctatctgataaaagtgatatttaataaacttttagtttcttgtcattagctcttttgaaaatgatttttttgtattcagaacacagactccagtttagaaactaatacaaattttacctattcaagtgcttaattttacagcaaaatggaaagtaaattttgttttgcctttatttctacagaagccactggtctcccccagacagtagtctgttataacccagaccagattcctccagaaaactctcctttaatggagaggtgcttcatatgtcgtctaaggtgtctgctggataattcatctggttttctggtaaggtacaaaattttatgatactggcttttactattgttacaataaaagcttgaggcaaatttaatttagcaaaatataattcagcagagaactattcccaaatcaggcaaccctcagaaccagagagcttcagagagctcacttaaaaacatgggctggagcatttatgaacagaaaatgcaagtgaggtacagaaatggcttgattgattacagcttgggatttgccttatttgaagatgatctgattagttggccacctgtgactgactgagactcagctatttggttacaaaagtttaattctactgttaggctttccgttagcttatatagtaaatgaagttgcaattccttggtaaggacttaaggagcagaggcatcttcagcccaaatttagtttaacattaagttatagaaaaaacaagccaattttctttggttatctttgatttcagctttaaaaatctgctaccaaataatttgataaaggaaagtaacattttaaagtaattatttctgattttgactatcttctataactcagaaaactgttctttaggatatagtaacaaaaattgagtgaaataacacgaagccttgtattttgactattttaggatttttaaggtatgagagaattatgtagcccttttttaataggaggatgcttaccatcttgggattgaatgcctgctagacagagaaattatggcctttccatatgtctcaaataactgccacatagaaaaacgattgtatattcatgattgtggaatcatcatttgataggagatgctgttttcttgttacaaagtctgaacacctgcataggagttgactgtagggaacagcttaggattcctcagagtggacttgtctgttatctcattgtatccttagctcatgttaccaagtacaggagaagaaaatacaaagtatattgtatattctttttgtgaataacaaggaatttgaaacagataatcaaatcttaaattaacattaccaagcaatgatttttgtttatgtgtttatttctgaagaggattttgctgacccagaattagaattatgctttgagacagttttcccagtgttattgctcatgaacaattagtatgtagagtcatgtcctgcataatgatgctttggtcaataacagaccatgtatatgatggtagtcccatgagatcataatggagccgaaaaatccctatcacttaatgatgtcatagcattgctcacatgttgatggtgatgctgatggaagcaaacctgtgttgccagtcatataaaaagtatagcacatacaattatatatgatacataatacttgaaaataaaacaataataaatcactatgtatttactattaatcattattttactttatttttaaatgtattatacttttaattattttattttaatcattattttagaataaggttaactgtaaaacaggctcaggcaggtccttcaggaaatattccaaaagaaggcattgttatcacaggagatgacagctccatgcatgttattgcccccgcagaccttccagtgggacaagatgtagaggtggaagataggatcattaatgatcctcaccctgtacagacctaagctaatgtgtgggtttgtgtcttagtttttaacaaaaaaagtttaaaaagtaaaaaaattaaaaattaaaaaatagaagaaagcttatagaataaggatataaagaaagaaaatgtttttgtatggctgtacactgtgtttaagtgttattacagaagagtcaaaagttaaaaatgcaaaagtttatgaagtaaaaatgttacagtaaactgtgctgggattacaggcataagccactgcacctggccaaaaggaaaatattttttataaattcagcgtagcctaagtgtatagtgtttataaactctatagtagtgtacggtaatgtctcaggccttcacattcactcaccactcactcactgactaaaccaaagcaactttcagtcctgcctaccttgtttacaataagtgctcttatacaggtataccattttttgtcttttatactgtatttttactgtatattttctatgtttagatacacaaatacttaccatcatgttacaattgctttaagtattcagtacgatagcatgctgtacaggtttgtagcctaggaacaaaaggctatactgtatagcttagatgcgtagtaagctataccatctaggtttgtgaacctaccctctgatgttcacaggataatgaaattgcctaaggacacatttcacagaacatgccccttttgttaaatgacatgtgagtgtatgtctgaggtggaatatctgtgtgcaggagggccttttcctccttgtgctgctattattttgatgtcagaaccatcccttggactggttgatattgttttaagcaattaaatatatcatgttcatgtttaagtgcctttgttttccctgtcttctaaatttcttccatatctttactcagtagggctctgcattctttatatgttttcatgatgattcattttagtgtcttaataaaattatattttgcctctatagaaaagattatgaactatgcagtatgctatgagctgtgatatagttcatgtatgcttgaaaatgaatgtttactttaggactttatcaccattcaggatatattgattgcctggtgtgcaaggagctgtgtgaggtgaaaatgatagggtaatggcaagcttggaaaatgatataggttttcatgttatgaccattaggaacaaggagtggttcacttatccctttagaatatttttcatattactctttgagatagatttaatgggcgtcccatggagagaggagtgaaggaaactaacagttctcagcttcaggaatatttatggaattatcaagaaccctagaggcagccataatggagccttttaaaaaggcactattttatattgttaattttaatgaacttttttgttgttgttgcttttttaaggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttcacacctattggttgtgatgccaagtaagtgagactttttcacttttattttattggatgtacattatgtttcagtaagtctctcttagcatgtaaaacatacagtgtatgtaatattgtttattattagattggctattatcgtacattcttccagtgtagccttttacagtaaaataatttaatcaggctcacaaatcatctttttaatttttgcaatacttgtctcaaatgatgatgttcttatatattagtaaggtttattcttctgatgacatttatgttggtttgttttacatttttaaatggcacaaatgttatttgatttctagccccagaagttttagtaactttcagaaaattgtgagcaggagtctgatattaaacatttatatcatatcaaacatatcagtgcttttctcctttctaatgtgggaatgcagagaggtaattagaaaaaccttcttccctaaaaatagattataaaaacattccagatttttattaaagatgttctgttacccatacatctgctctattagattcatttttagcatactaatttccatggatttattcaggaaaagaaaataggctgaaactgaaatttgcaatcataagcaaagaagatcagtttacatggatgtgtttaatttcacatctacttatgtgaaattctaaatgtgaactaaaacatattgcagaaactagcgtaaaaccaatgaatttatcttggttatttcatttatgttaaatcttaatccattcttattttacctttttttattttaaacagaggaagaattgttttaggatatactgaagcagagctgtgcacgagaggctcaggttatcagtttattcatgcagctgatatgctttattgtgccgagtcccatatccgaagtaagttgtagttccttatgaacatgtcagaagaaaacggcatatactgttgtacatgtttcaaattcttacgtaatgtaaagtgtttaagtaaagtatatggataaacttctacttagtaacatatcattatgattaaccagggttacactctttgttcattaacttgtctacacctgccatgtagaaatattgttgtttagttattaaaaaatgaccattttggcccatgaagttttgcttgggaattttttaattacatcgttatcaattcataaatctatgttaatattgtaacaataatagtgttaataattctagtttaaaattataaagtattaggctgtaggaaaatattccctatttaaaatgaaaataattttttccccaacttatgttctctctatactttcctgtgttactagaattgtttggtacataatcttccctttaacatttaaaataataaatttaaaacaactctgaaaaactatttccatgccttttattattttttgtttaaaatttattgtctttggggataaaggaaatacatccagaactatgtcacaagagctttgttttaggaataatctttactatattgatttgggggtttgataatttaattttttaattttattttagtgattaagactggagaaagtggcatgatagttttccggcttcttacaaaaaacaaccgatggacttgggtccagtctaatgcacgcctgctttataaaaatggaagaccagattatatcattgtaactcagagaccactaacgtaagcacaaataatgtttcctgttttaacagttttgttttcataagtcctcttatgtgaaagcataaaaataattcaagcagactttagtctgtaaataaaaattgaaaagtttaattcatctagaaagaagagcacaggtgagagacattgagaagatagaattgacgaacttgattgagagctacatgtgcagagctatagaaagaataataaaactctagggttttatcttgggcatatgaaagacacatgaaaagctagtgtcattggtaaaaaagaagaaaaatataacaatgctttatttagaatatattctctaaacccagcagtgattttaagagtttcttacacatgctgcagatgagtcctttatcaaatatttgtattgcaaatgtttcctcccactctggagaattgatttttgtctgtagcttgaggtaaggattgattccccccagccattatacgtatacccaattgaccagtaacattgaaaagatgatttaccgagaaggtcattgtttcccggctgcgctgtattttgatcaggggattttgtctgtggttctctgtctggattgtgttgttctattaatagctccattagtgcagttgtctattttgtctagcattacactgtcttagttattctatctttattatatatttctatgtcagagtgtgtcattttgtttgttttgccttttttgttctccttcaagattgccttggttcttctttgccctctataattccatatacattttagaaagcagttgtctgaaaatctgttgagattttgagtgcaattaccttgaaactgtagatcatttggggagaattaacatctttttaatactgaatctttgagcccatgaacatgatgaatgtatgtatgtgtataagtacccatggaagtacatgagtatgtgtgtaccatatgtatatgagtgcatgggtatgtgtgtacctctacaaatttgtcacttctcccttgatcaatgtttctagaaggcactttttttaattagattttattagtctttattaggatccaacttttggtttattgatttttttctattttatacatttgttttcaattttaattatgtctgctcattattattttcttccttctactttctttgggtataatttatcattttttgcaacttttaaaaaatatatacttaaacatatatatcagtttccctttaagtacagcattacaaccctcatcttttgctatcttatttttattatttaattgaaaatactggctaatttgtttttatttttattcatgaattatttagaaatacagtgttactgtactttttggtgtttggggatttttctagttgcctttttatgattgacttttagcttaattccattgtagtcagaaaatattctctggatggatttcagtttttttgaaatttgtggtgacttattttatgatctaatacatggtctatgttggtaaaatatcccatgtaatcctatgaagaatacatgttctgtagtttgggagtatcttatttttatatatcagaagtctagtttgttaattgtgttcatatttgtatacatttgttgatattttatgtgcttctgttagttactaagacattttgttttcatttattactgaaggggggcatctttttacatctttctgttttttttttttttttgagatggagtctcgctctgtcgcccaggctggagtgcagtggcgggatctcggctcactgcaagctccgccacccgggttcacgccattctcctgcctcagcctcccaagtagctgggactacaggcgcccgccactacgcccggctaatttttttgtatttttagtagagatggggtttcaccgttttagccaggatggtctcaatctcctgacctcgtgatccgcccgcctcagcctcccaaagtgctgggattacaggcgtgagccaccgcgcccggccctttttacgtttttctatgacatttttcttttataaattacatttgtatcatttacctgtttttctgttgagttgtttgcctctctctcagactctattggagctctttattatggatatgaaattttataagtatattaaattataaatacattatgttacaaatattttctttaaaaattctattgcccgaggcgggcggatcacgaggtcaggagatcgagaccatcctggctaacacggtgaaaccccgtctctactaaaaatacaaaaaattagccgggcgttgtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaatctattgcaaaaatacaaatactttaatattaagtaattttcatattattatgccaatctgtctttatagctgctgggttttattatagaggttagttgtttcagattcttaactttctaattcctaatttttttatttttttattattattatttttgagacaggatcttactctgtcacctatgctggaatgcagtggcacaaatgtggctcactgaagccttaacctccaggctcaggcagtcctcctgcctcagactccagagtagctgaagactgtaggcatgtgccaccatgcccagctagtttttatttttttgtagaggtgagggtcttgccatgttgcccaggtttgtctcaaaatcctgggctcaagcaattcacacacatcagcctcccaaagtgctgcaattacaggcatgcaccaccatgcctggcccctaaattctcgtagtctgtttttatgtgtagatatttattccacacaaatttattatttttttctttttttgcagggtgtcaggtagggatgtaacctgaccatggaattaactaagttattttttaaaaattaaatcatttaaatatgcttgtctgaaaaacaattttatagcaccagtcatgagaataattgaggtgaaaataaaatatgtccctttctgaattcaattacaatgtattttgctttatgtttttcttttttaaattatttttattttaaaatgtttgatagaatttttttctaagacttttttgtacacaattttagagatgaggaaggaacagagcatttacgaaaacgaaatacgaagttgccttttatgtttaccactggagaagctgtgttgtatgaggcaaccaacccttttcctgccataatggatcccttaccactaaggactaaaaatggcactagtggaaaagactctgctaccacatccactctaagcaaggactctctcaatcctagttccctcctggctgccatgatgcaacaagatgagtctatttatctctatcctgcttcaagtacttcaagtactgcaccttttgaaaacaactttttcaacgaatctatgaatgaatgcagaaattggcaagataatactgcaccgatgggaaatgatactatcctgaaacatgagcaaattgaccagcctcaggatgtgaactcatttgctggaggtcacccagggctctttcaagatagtaaaaacagtgacttgtacagcataatgaaaaacctaggcattgattttgaagacatcagacacatgcagaatgaaaaatttttcagaaatgatttttctggtgaggttgacttcagagacattgacttaacggatgaaatcctgacgtatgtccaagattctttaagtaagtctcccttcataccttcagattatcaacagcaacagtccttggctctgaactcaagctgtatggtacaggaacacctacatctagaacagcaacagcaacatcaccaaaagcaagtagtagtggagccacagcaacagctgtgtcagaagatgaagcacatgcaagttaatggcatgtttgaaaattggaactctaaccaattcgtgcctttcaattgtccacagcaagacccacaacaatataatgtctttacagacttacatgggatcagtcaagagttcccctacaaatctgaaatggattctatgccttatacacagaactttatttcctgtaatcagcctgtattaccacaacattccaaatgtacagagctggactaccctatggggagttttgaaccatccccataccccactacttctagtttagaagattttgtcacttgtttacaacttcctgaaaaccaaaagcatggattaaatccacagtcagccataataactcctcagacatgttatgctggggccgtgtcgatgtatcagtgccagccagaacctcagcacacccacgtgggtcagatgcagtacaatccagtactgccaggccaacaggcatttttaaacaaggtaagggtgttatcaaactgaattaaatctttcagtgattctttttaccttatagacatgttacacattttttatgtcagctgattttaatcggttatctacagcattcatggagacagcattttttattatatctgtgactaccttttttttttttacaagcctgtactttttccagtatgttactaatatatcattcacctgattcatgagggagaaagatatcaaggaatgaagcaacatgaatgtgtccttaatataagatgacctaaattaccaggtgaaattagtttttagaagtattttgtttaaaatagataatttggtttattctttctggattctttaaaaattatatggctatttaaaaattcaagctttaaaaaacgtattgcaatttttaagaataatttcttcaaagctctatttttttatatatgtttgaaattgagttaaactcaaatttaagtgtgctttcttacaatgcctctgaaaccctagattaattatatccctggaattcagtcctaggcacctccatgttctctagctattcctccacattacctcccctatcctcatctcatcctttaaggtagaatggctttcttttctggctttcttaaaagaggtaactcagctggctttctgtcatggaaatcaagcttgatagtgcatttttgttgtttaaatgtgtcatcagaatccgtctggcagtgagcacactttaaatctaaaaatgatcacttaaaaaaaaaaagttaacataatgtcagtaactgctgtctctggccactcaggaatacatcatgtttgcatttatgctttttccattagaaaatatttagttcattttaaagtatatttaagtttagttttaaagaatatcttgactaaaattaagctccttgacccctgtttactctgtattagagtataataattaaaagtatgacctgaagctttatctttaattgtattttctggctttttcatacattttgcttgtctaatcgtatatgagctttttaatagaaaaggacagtgaaaatttttcttattccttacatccttcaattatattaaaattgaataatattcagttatagtccgtctcacaaaattgctatgaaagtatattttactcttgagtaaagcaaattgtacagaagttaattctgtaaaattacattttgaataaggagttgcatgagtaccacataagttctttgcagtgttttcccctcactacttttcactgcttctttgtaaataaccaaataattctatagacctacatatgttccagagtacatgttattgagctaagacactcaatattgagccactgagtagctgttcagcacttgaaatgtggctagtccaaattgagatgtgctgtgtgaagtacacattggatttttggattttgaagacttggcttgaaaaaagaatgtaaaatatctcatcttttattattgatttcatgttgaaatgattagttttttcagtagccgcattacaaaagtaaaaagaaacaggtaaaattaactttagaaatgtattttatttaatctactgtagccaaaaatttaagttctgtatgtggctcacattatatttctattggattacactgctgtgtacagtatgtttaaagagaatggtgacatgaattgtgttatgagtaatgagaaaaaatcattttaaactcaccattatctggccaggtaatactaactttttatttaaagaatttacagtgttgccattcattgaagatacaggttatatgatttttactatagattttatatatgttttggaggatctgtgaagtaattaacattttgattactgaagccagttatgtaggctttacaaaggtagattttatttgaagcaattaaggatatgattttaatctgttttaaagtttccagaacgtccactaactaaaatataaaggctctgtaatctataaaactctacagagctatacatcttcatgtccttcctttttatttttcttttttctactagcagttatagaaaccagattcattgcagtgtaagaaaacaagacagagcattttcttttggtaacttgattctgtaattagaactatgctttcagtagtattcattaattaaaagtatattatgaataagaaatcggttaagaaaatcatacctgtggtgtaatattttaggaatatttagaaacatttagaaaatcagaagctgccttttttggaaaagttttgcattccagtgtaagattcctgaatataatcaattcattgatacctataacttcaaacctggtcaaagcaaacctacttatgatagagaatatttaactgtaatttgtgacttgtgctgtttgacccatcaattcctacctgacccaaaggcaatctgaaatgagacagctgcatcactcatctgtaccatgttcaaaatttcctgtcaaattaatggaaaaacaggttataaatgcaactaatacataatatgtcctcagtatgtcttcactgtgtgaaagatttaaaatttagcaacagtaaaggaacttgaagtttacaactctcaggggtaagattttaaaaatacatgttaatgttatttactggcttaagatacttggaagatctattccaataagttgcatcaccatttttgttttcagtttcagaatggagttttaaatgaaacatatccagctgaattaaataacataaataacactcagactaccacacatcttcagccacttcatcatccgtcagaagccagaccttttcctgatttgacatccagtggattcctgtaattccaagcccaattttgaccctggtttttggattaaattagtttgtgaaggattatggaaaaataaaactgtcactgttggacgtcagcaagttcacatggaggcattgatgcatgctattcacaattattccaaaccaaattttaatttttgcttttagaaaagggagtttaaaaatggtatcaaaattacatatactacagtcaagatagaaagggtgctgccacggagtggtgaggtaccgtctacatttcacattattctgggcaccacaaaatatacaaaactttatcagggaaactaagattcttttaaattagaaaatattctctatttgaattatttctgtcacagtaaaaataaaatactttgagttttgagctactggattcttattagttccccaaatacaaagttagagaactaaactagtttttcctatcatgttaacctctgcttttatctcagatgttaaaataaatggtttggtgctttttataaaaagataatctcagtgctttcctccttcactgtttcatctaagtgcctcacatttttttctacctataacactctaggatgtatattttatataaagtattctttttcttttttaaattaatatctttctgcacacaaatattatttgtgtttcctaaatccaaccattttcattaattcaggcatattttaactccactgcttacctactttcttcaggtaaagggcaaataatgatcgaaaaaataattatttattacataatttagttgtttctagactataaatgttgctatgtgccttatgttgaaaaaatttaaaagtaaaatgtctttccaaattatttcttaattattataaaaatattaagacaatagcacttaaattcctcaacagtgttttcagaagaaataaatataccactctttacctttattgatatctccatgatgatagttgaatgttgcaatgtgaaaaatctgctgttaactgcaaccttgtttattaaattgcaagaagctttatttctagctttttaattaagcaaagcacccatttcaatgtgtataaattgtctttaaaaactgttttagacctataatccttgataatatattgtgttgactttataaatttcgcttcttagaacagtggaaactatgtgtttttctcatatttgaggagtgttaagattgcagatagcaaggtttggtgcaaagtattgtaatgagtgaattgaatggtgcattgtatagatataatgaacaaaattatttgtaagatatttgcagtttttcattttaaaaagtccataccttatatatgcacttaatttgttggggctttacatactttatcaatgtgtctttctaagaaatcaagtaatgaatccaactgcttaaagttggtattaataaaaagacaaccacatagttcgtttaccttcaaactttaggtttttttaatgatatactgatcttcattaccaataggcaaattaatcaccctaccaactttactgtcctaacatggtttaaaagaaaaaatgacaccatcttttattcttttttttttttttttttgagagagagtcttactctgccgcccaaactggagtgcagtggcacaatcttggctcactgcaacctctacctcctgggttcaagtgattctcttgcctcagcctcccgagttgctgggattacaggcatgtgccaccatgcccagctaatttttgtatttttagtagaaacgggtttcaccatgttggccagactggtctcaaactcctgacctcaggtgagcctcccaccttggcctcccaaagtgctgggattacaggcgtgagccactgcattcagctcttcttttctttagatatgagagctgaagagcttagacacattttgcatgtattatttgaaaatctgatggaatcccaaactgagatgtattaaaatacaatttttggccgggtgcagtggctcacgcctgtaatcccagcacttggggagggcgaggagggtggatcacgaggtcaagagatggagaccatcctgaccaacatggtgaaaccctgtctctactaaaaatacagaaattagctgggcatggtggcgtgagcctgtagtcctagctactcaggaggctgaggcaggagaatagcctgaacctgggaatcggaggttgcagagccaagatcgccccactgcactccagcctggcaatagaccgagactccgtctccaaaaaaaaaaaaaatacaatttttatttcttttactttttttagtaagttaatgtatataaaaatggcttcggacaaaatatctctgagttctgtgtattttcagtcaaaactttaaacctgtagaatcaatttaagtgttggaaaaaatttgtctgaaacatttcataatttgtttccagcatgaggtatctaaggatttagaccagaggtctagattaatactctatttttacatttaaaccttttattataagtcttacataaaccatttttgttactctcttccacatgttactggataaattgtttagtggaaaataggctttttaatcatgaatatgatgacaatcagttatacagttataaaattaaaagtttgaaaagcaatattgtatatttttatctatataaaataactaaaatgtatctaagaataataaaatcacgttaaaccaaatacacgtttgtctgtattgttaagtgccaaacaaaggatacttagtgcactgctacattgtgggatttatttctagatgatgtgcacatctaaggatatggatgtgtctaatttagtcttttcctgtaccaggtttttcttacaatacctgaagacttaccagtattctagtgtattatgaagctttcaacattactatgcacaaactagtgtttttcgatgttactaaattttaggtaaatgctttcatggcttttttcttcaaaatgttactgcttacatatatcatgcatagatttttgcttaaagtatgatttataatatcctcattatcaaagttgtatacaataatatataataaaataacaaatatgaataatatgttttaatgtaaattctttctggtccacgtaaaggaaattatttattctgtagtattataactatgttagatgagggcaatctacaatacttagggatatgttaagtcagtaattcataaacttcttatacaattttgccccccaatgtctgacctttatctggatataaaaaacactctcagtagcttcataaattaaaatgcttctgaaatgaacttttttaaagccctgtgttatcagtgtagtagtgtgtcttagattaaaatccaaaatcctattttaatattttaagaatatttctgaagaaattcgaaataacccttgttagctgtattttgtgcttagtttagaaaaaccattgcccaaacttagtatttctgtttaataagtataaatgatacagaagcctttggccttaaattcataactgttgaacattcatggaaaaccctgcaattagaattgattgaagaagaattcctgagaaaatgttttcattcttgtgacagttatttttctattagttttatatttgttctttacaattaggcatttttctcaactagcatatcataagttagcatcatacttaattctgaacattttagactaatcctgagtctttaagaattacataaaatatttagttttaactatttgatctgaaaaaaatcaagtaaaaatcctgataacctgagtgcatctctgcttgcgcttaggtgatttctgtcaccatgaatgactctagcttgtccaatttcaccagctctaccaaacaccgacccagggatgttggccactgacagggctggatgacatctctcatttctttcactgtctgcagatgaccttgcttccgtttttactaataaaatcaaggatatcatcctaagtttgtaccttcacctcagcaattcctctatccttggacttacctccagtatgtgaggaggagagtttcctgaactccagggttagcccccgtcctctctcgttctcatgcacacagcttcgacacctgctttctgagaggctctccttctctgtaggatttcctgtgaataggtcctcctccatcctggaaaaaaattacttgaacctgcactttcttctctattaaattacttctttaccttcttcctttgtaacaacagttttgatctcctgagatctggttttgttttccatccttccattatattgcagtgttgcggttcactaaacttcttaccataggctcattttctatggccctgcaaccaaactgattacactttcaatgaacttttttcttcccttccatgacattagttgtcctgtaagctcctattatcccttttctttcctttgttaaccactctttcctcctcccacctggcagcaggcttagttttgaccatttgtggctctttctgtacatactgtctaagaagaagtgattcaatgccttacctctgattgacatttgtgaagcaattctttccctgagagagcagcatagcatagccaaactaaacacacagactctggagtcagactactaggtataaatcctggctttgccacaaataagatgtcattgagaaggtttcttactttctcttagcctaagatgccttttctgtaaactaaggctaacagtacctgcctcactggattgctggaggattcagtgatttatataaaatcacttagctgccagtagccaaaactggaataatttgagcaactaaataagtgatgatagcattagattacagcacaaagaataaagtaaatatccatgaatccatactaatataaataaaatggttgaaaaataaatgggggagaaggagcacatctttcctatagaagaatcccaaataatattggtagctactatgccctctgatgcatgagcttagttctcctcccctggaaggatgagttagacttaatgacttgctttcaaggaatagagtacagacagagaagaaaataactttacattgttgaaatctggcaagcactactttaaccaagtaatcaaggttaacatcaccagtgaaaagtcatgttgatataacatgtattatctgatatgatactttgagaagtgtacatctcaaagctccctgattttcttaaaaacacatagtctaattatgacaaaacatcaaacgcaaattcagggacattccacaaaatttctgagaggattttttaaagtgtcactgtcacagaaagagactgaataattatcacagagcagaggaggctaaggaggcatgatgactgaacttaatgtgatatctccgattgcatccttcatagaaaaagggcattactgagaatctgcagaactctaagtctagttaatagtaccacatcattgttaattttttggttttgaccaatgtaccatggctatactacgttagaggtacctggctgaagagagtaaaggaactctatatccttttgacttttctgtaaatctaaaattattccacagtagattttactttttaataaaagtacagtttttattgccacatagcaagtatctttatgtctctcattactattttcctgtatcttcacaacctcctcttagttggaggtaaagctatacattgacatcagtccccattaactactgatttgacgaatatctttttttttttaatttaagttctggggtacatgtacagaatgtgcaggtttgttacataggtatacacgtgccatggtggtgtgctgcgcccatcaacccgtgatctacattagatatttctcctaatggtatccctcccctagccccccactggtgtgtgatgttcccctccctgtgtccatgtgttctcattgttcaactcccacttatgagtgagaacatgcggtgtttagttttctgttcttgtgttagtctgctgagaatgatggtttccagcttcatccatgtccctgcaaaggacaggaactcatccttttttatggctgcatagtattccatgctgccagttttcccaacaccatttattaagtagggaatcctttccccattgcttatttttgtcaggtttgtcaaagattggatggttgtagatgtgtggtgttacttctgaggcctctgttctgttccattggtgtatatatctgttttggtaccagtaccatgctgttttggtgactgtagccttgtagtataccacattctctttatccagtctgtcattgatgggcatttgggttggttccaagtctttgctattgtgaacagtgctgcagtaaacatacgtgttcatatgtctttatagtagaatgatttataatcctttgggtatataccctggaatgggattgctgggtcaaatggtatttctagttctagatcctcgaggaatcaccacgctgtcttccacaatggttgaactaatttactctcccaccaacagtgtaaaagcattctgatttctccatatcctctccagcatctgttgcttcctgactttttaatgattgccattctaactggcatgagatggtatctcattgtggttttgatttgcatttctctaatgaccagtgatgatgagctttttttcatatgtttgttggcagcataaatgtcttcttttcagaagtgtctgttcatatccttctcccactttttgatggggttgtttgttttttttttcttatacatttgtttaagttctttgtagattctggatattagccctttgtcaaatgtataggttgcaaaaattttctcccattctgtaggctgcctgttcacgctgatgatagtttcttttgctgcgtagacgctctttagtttaattagatcccatttgtcaattttggcttttgttaccattgcttttggtgttttagtcatgaaatctttgcccatgcctatgttctgaatggtattgcctaggttttcttctagggtttttatggttttaggtcttacatttaagtctttaatccatcttgagttaatttttaaataaggtataaggaaggggtccactttcagttttctgtaccattggtgtatatatctgttttggtaccagtaccatgctgttttagttactgtagccttgtagtatggtttgaagccaggtagcatgatgcctccagctttgttctttttgcttaggactgtcttggctatgcgggctcttttttggttccatacgaaatttaaagtagttttttctaattctgtaaagaaaatcactggtagcttgatggggatagcagtgaatctataaattactttcagcagtatggccattttcacaatctttactcttcctatccatgagcatggaatgtttttccatttgtttgtgtcctctcatttccttgtgcagtggtttgcagttctccttgaaaaggtccttcacatcgcttgtaagttgtattcctaggtattttattctctttgaagcagttgtgaatgggagttcactcatgatttcactctctattattggtgtgtaggaatgcttgtgatttttgcacattgattttgtatcctgagactctgctgaagttgcttatcagcttaaggagattttgggtgagatgatggggttttctaaatatatgatcatgttatctgcaaacagagacagttttacttcctcttttcctatttgaacacactttatttatttatcttgcctgattgccctggccagaacttccaatactatgttgaataggagtggtgagagagggcatctttgtctcggcctgaaattttctttttttgttgtgtctcagccagcttttgatatcaggatgatgctggcctcataaaatgagttagggaggagtctctctttttctattgcttggaatcgtttcaaaaggaatggtaccagctcctctttgtacctctggtagaattcagctgtgaatctgtctggtcctggactttttttggttggtaggctattaattactgcctcaatttcagaacttgttattgttctattcagggattcaacttattactggtttagtcatgggagggtgtatgtgtccaggaatttatccatttcttctagattttctgttttatttgtgtagaggtgtttataatattctctgatggtagtttgtatttctgtgggatcagtggtgatatcccctttatcattttttattgcgtctatttgattcttttctcttttcttctgtattagtctggctagcggtctattttgttgatcttttcagaaaaccagctcctggcttcattgatttttagaaaggttttttgtgtctctatctctttcagttccgctctgatcttagttatttcttgtcttctgctggcttttgaatttatttgctcttgcttctctagttcttttaattgtgatgttagggtgtcaattttagatcttttctgctttctcttgtgggagcttagtgctataaatttccctctacacactgctttagctgtgtcccagatattctggtacgttgtgtctttgttctcattggtttcaaagaacatctttatttctgccttcattttgttatttacccagtagtcattcaagagcaggttgttcagtttccatgtagttgtgctgtttttagtgagtttcttaatcctgagttctaatttgattgcactgtggtctgaaagactgtttgttatgatttccgttcttttgcatttgctgaggagtgttttacttccaattatgtggtcaattttagaataagtgtgatgtagtgctgagaagaatgtatactctgttgatttggggtggagagtttgtcttgcagatgtctattaggttcgcttggtctagagctgagttcaagtcctgaatatccttgttaattttctgtcttgtttatctgtctaatattgacactggggtgttaaagtctcccagtattattgtgtgggaatctaagtctctttgtaggtctcttgctttattaatctgggtgctcctgtattgggcgcatatatatttaggatagttagctcttcttgttgcattgatccctttaccattatgtaaatgcccttgtctcttttgatcactggtggtttaaagtctgttttatcagactaggattgcaactcctgctttttttgctttccatttgcttggtaaatattactccatccctttattttgagcctatgtgtgtctttacatgtgagatggatctcctgaatatagcacacggatgggtcttgactctttatccaatttgctagcctacgtcttttaattggggcatttagcccatttacatttaaggttaatattgttatgtgtgaatttgatcctgtcattatgctgctagctggttattttgcccattacttgatgcagtttcttcacagtgtcaatggtctttacaatttggtacatttttgcagtggctggtaccagctgttcctttccatttttagtgcttccttcaggacttcttgtaaggcaggcctggtggtgacaaaatcagcatttccttgtttgtaaaggattttatttctccttcatttatgaagcttagtttggctggatatgaaattctgtgttgaaaattattttctttaagaatgttgagtattggcccccactatcttctggcttgtaggatttctgctgagagatccgctgttagtctgatgagcttccctttgtgggtatcccagcctttctctctggctgcccttaacaatttctccttcatttcaatcttgatgaatctgatgattatgtgtcttggggttgctcttcttggggagtatcttcatggtgttctctgtatttcctgaatttgaatgttggcctgtcttgctagtttggggaagttctcctggataatatactgaagagtggtttccaacttggttccattctccatgtcactttcaggtacaccaatcaaatgtagatttggtcttttcatatagtcccatatttcttggaggctttgttgattccttttcattcttttttctctaatcctgtcttcatgctttatttcattaagttgatcttcaatctctgatatcctttcttccgcttgatcaattcagctattgatacttgtgtatgcttcacaaagttctcatgctgtgtttttcagctccatcaggtcatttatgttcttctctaaactggttattctagttagcaatttgtctaaccttttttcaaggttcttagcttccttgcattgggttagaacatgctcctttagctcagaggagtttgttattacccaccttctgaagcttacttctgtcaattcatcaaactcattctccatccagttttgttccctttctggcgaggagttgtgatcctttggagtagaagaggtattctggtttttggaattttcagcctttttgcactggtttctccccatcttcatggatttatctacgtttggtctttgatgttggtggccttcggatggggtttctgtgtggacatccttttcaatgatgttgatgctcttcctctttgttagttttccttccaacagtcaggcccttctgctgcagatctgttggagtttgctggaggtccactccagaccatttgcctgggtatcaccagctgagtccgcagaacagcaaagattgttgcctgttccttcctctggaagcttcaccccaggggggcattcaccagatgccagccagagctctcctgtgtgaagtgtctgttggcccctcctggaaggtgtctccccctcaggaggcacaggggtcagggacccacttgagaaggcaatttgtcccttaccagagctcgaacactatgctcagagaactgctctcttcagagctggcaggcaggaacgtttaagtctgctgaagctgcacccacagccaccccttcccccaggtgctctgtcccaggagatgggggttttatctataagcccctgactggggctgctgcctttctttcagagatgccctgcccagagaggagggatctagagaggcagtctggctacagtggctttgctgagctgaggagggctccacccagttggaacttccccatggcttgctttacattgtgaggggaaaaccacctactcaagcctcagtaatggtgggcaccccttccccaaccaagctcaagcatcctgggtcgacttcagactgctatgctggcagtgagaatttcaagccagtggatcttagcttgctgggctccgtgggggtgggatccgctgagctagaccacttggctccctggcttcagcctcctttccaggggagtgaatggttctgtctcgctggtgttccaggtgccactggggtatgaaaaacaaacaaacaaaaaacctcctgcagctagctcagtgtctgccctaaaggctgctcagttttatgcttgaaacccagggccctggtagcgtagacacccaggggaatctccggatctgtgggttgtgaaggccatgggaaacgcatagtctctgggcgggagtgcagtgttcctcatggcacagtcccacatggcttcctttggcttggggagggagttccccgaccccttgcattttccaggtgaagtgatgccccaccctgtttcagcttgccctccatggactgcacccactttttaacctcctaaaacgttcctttcttctttgatctgctaacatcatccttatcaatggcccttcttggtttgttctcatagcttctacacatcaactataataacctatttttctgttccaactaagtacagccacacctcagagtttgagcatttgtaactgccttacctctatcaacttagtatctccttttccaatcttttcttccttgttcaactagctctgcaccctccttgtgctccttgagtatacattgttttttcatagtccagcagcctggacctcagtttcaggatttcagaaatatttttgcttatatcctggatgttctcacttattagtaactgctgatccagtccatggccctggccaaaaagactctgttttcctgatatgcagtcttgctagagaaagtcacaaaacagaaataattggcttcaccacagtcttatcatgtcagtggcagagactgacagttgcctacagagatatcttcccttccttagtaagagaaccctgacttttcactggttacattgaggaaataaaagactacattttccagcctcctttgtagatacacataactaacataacttctgcccaaatatatgaaagcaaaaattttgtataatacttccaggaaggctgcttaaagggacttaatacaactaaaatgagcaatttttgcctttctgcttttcctctttgtaaccaacacatatgtatctagagagccaccagccactttgaaccatgatgacagaagccatgaactaggatggtgaagaaaaaatagaatgagcctggtttctcttgacttggaactaccaaacagtcaatccctagtctgcctactacctctgggcttcctgtacataagagataaacagagtctctgccccaccaccacccctaggtattttcatctcactctagaatgacattatctccaacttgactgaaaacaatctgaaataatcttcagttttctactttatgcctttgtattcctttctatcaactatctcctcagattttccttacctctttttgttgcaacttctgccattaaatacatgagtttcttccctttttttttctaaaatatgttcttattatggttttcttcttctataatggcagaatatctccagtttttatatttttatttttactgttttttaattgatatataatagatgcagacattttcaaggtccatgtaataatttgatgtatttatataatcaaatcaggataattggggcatccatcatctcaaatatttatctgctctttatgctaggaacattcaaattgttctagctattttgaaatgtataatagtgttaactatattcaccctactgatctatcaaacaccaggtcttccaaccctcttctaaaagtgaaatacaactaccactagatttttctttcttttttaacttgctatacatttgaaagagcagctggctaagacactttctttacttctttaccaacctctgtttcttaaaccttcccagtctgaatttattcccaattttctaggtacaaatggtctattaagtcaagaaatcttcattccttgagactttcttactttggcttctgtaacattgtactctcctttttcctgatttctgatttactttagccctctttctgtaattcttgcaaatcattagtataatctcaaaatgcaattattagactaaggaggcctgccccagactacactgtgaccctgactgcacttctgactctcacctgaaaagcaaaactgcctccattaggcgaactgcccttctctcctagtctcctagtagacctttaagatatcaaaactttctgaataaagttggccccaataactctcctgtgctgttgagtttagacttaaaaccctatcctaggcacagccagtcctgcctccagttctcacccccacccacagccccaccaccaccatcttgggcagatccagaccctggggggtcagtttctgatactagtctctccatctccagcaaaatttctcaagaggtaagatgggccacactctatgtgtgatgtctaaagtatacagtcaagcatgaaacaactcatatattaaaaagaacaaccagaattgtgaagaaacaaattcatacgtataagaatcttataattcatacattataagaaccggtgattaatatattgaaaaagagaagagtgatctgtgatatgattacatccctcaaataactgatattctagcatggaaagtgaagattcccatttggggcccagaaattaagccaggatcattgataaaagttaacagacctttaccttaatttgaagaagactaccctttgaaagatgactggagataaaacaacctgctttataatgtaatgatcttgtttctagaaatgatcacttagaattcataagaaaataattcaaaattctaatgtgtgttatagtttatcactgctaagtatccttctacttctgagactatacagttgcataaacttccatgttagatgtgatctttgagataatgtattttacacccgcaacattatgtttgaaaaatataaaggcctagagactgttttgtgcaagtatcattgtctgtgataaaattatttcatgaattctcagcttggatctgagtattcattctacagcacaagaagtcagctttattcttagggaaaacaacatattcacacaattttatttttagctttgataaataaaatttttgttttccttttattcagaattatggtttcaccctcctttcaggtaaagctgagcatcccaatgcttacggaatgtctacaaatttatcttcaactctattttcccagagtcctgtatggttacttaatattttttactaaaaggttaatgtcctttaaacatttttaaactacatatttcctgacatctgacagtatcactatctaacctgggggcttcagcataaagattagacactgtgactaaaacttgtgtttcagaattaggttagcttaaattcttttttcaagtgtattaatttctactgtctttgaaggtatttgtcttcctccttatggaatcaactgatatgtagaaaattcagactatctttgaataggaagatccactgcatgtagaagagaatagaaaatcttaccttattgtgaagagctgtggagattttaccctactttgaagatagcaagttagccagtcacagtttgatggatgctggcaaaatgacatgagactctggtatcagaggcaaaggaagtttattactcacagcaatagcatttgtgttgattccccacaaggcaacacaaagacagccaggtggcatctacacatgcaattccaggagaggaaccccgaggttagggttttgtaatgggcggaatgcatacctgatcctttgctctgaagagggatactacctctgtcttttaaggctgcttactatacagacatccttgaaaagtttgctcagataaaaaccagtccctctgctcacaggatgtgcagaaacacgagattcatggggaattgtctccatcttttatcatgactggctctgcctgctctttcaactaaaattgccaacctatcctgctctcttgactgcatcccagtctagactgcagaggcaacttttatttgagataaatagcatggcgaatctgataaaattctctgttctcaaattacaccattcttgctccccatggaaaaacctttgaaaccctgacttgaacactttgctccaagtctttataaaaggcaatatgccgtgatatttaagattcagggaagtgtatgctaggtttgaattcaggctctgctcccttgctagatatatgattggggagtttatttaactgttctgtgcctttgtttcttcttctgtaaaaagaagataataaaatggccctacttcataggatctttataggaaccaaatgagatactgtattcaacttgctcagcacaatgactggtacgtgataattggtgctaaagaattgtgagctcctgttattcggtgagtctgtattagagtaaagccaatctggtataatgaaataccaaaaaaagcattctttaaacattaggtgtgtatttgtctaatgtaggtggcctctgctccacaaagcaaacccacgtggtgaggcaactctttttcattgtcaatatgctcccaacactgccttttctaaccaggaggaaggaatgggagggatgtgtgcaggccaaggagctgtgagagaacaagtaagagcttggtacatatcacttctgctcacattctgtacccatgaacatagtcccatggtcacacctagctacaactataggcctgactaccatctgtctgtggaaaaagaagaaacagactttggtggaggatttaaagggccctcaaaactaagtagcacctctcttttttatttgaattttgaagcttttcagaaataacttgacaaagcataaacagataaagaagggggagaaaaaagtcatcattatgttaaaatcacatcatcattattaaacatgtcaccataacttagcccgagagccaaaggaggatggcccaccccattcccccagctccaatctaaacctaagaacatactattctgggatactctgactggaaagagccaacctactttctgtgtcactgactcctacaattctagatagacaaaagcggagaaagagatcaagttcttcatacccagtaccattgatagatttgcttcacatatttgaggaatgtggacagtggctgccacccactttggccttctaccacggggagaattaagtgatgatgagaagggctatttccctacaccccttcacaggacacgtgaagggtaggctcgtttactcagcccacagctctgaacctctcctggaagggggagcacgcaggtcagcaggtgcaggagcaggagtgaacaaatgctggaaccagccagttgctcctctcaggcggaggcaggttctgtgcaggccctgcagcagcatctaagtgtgttacaatgctcttttagctctgccatccaggagggggtatctgtgcccctgggaccccagagggtatgtgttacaatcagtgctctttcagcatttgccatctgtgggaagctacgcattaaccagctcagtggaggatcagggtggcagccttttacaccctgccctcttggtgcccatgttcttctctgacatccaggaagaatcaggtcacacaaatgaattgaagggtggtgtatgtggaggattgtattgggtgggagaagtggcttgcagtgggcacaggagctggaatgggaatggagtggaaagataatcttcccccggagttccaccacccccggccaaactcttctctaaagtcccgccatcaggtcatttatctgacatccagctgctgcttctcttctttccttctctgccgctcctctctgctctcctgccagtggtgcttggggtttttatgggtacagggtaggaagtggggtaggccagggtggttttggaaaaggcaacattcaggtgggaaagcaaggatgtgaagttctcatttagggctgcgggttcaggcatgagggtggaacccttgttggggaccccacccttttctacttagtatttctctgcctcctgtcctttttaatgagtcaagagcctaagaaaacttatccttcttcatggaaacctcataataggaaaaatacttttctatcaaaaacatcacctccaccaccaccaccatcatcatcataattataaggcaaatttaccgttttacccgttgagtaaaaacttttcctaagggttctttacattgcccattattctatgaggtgcagaagtcagagttcagacttaaaatatacttgtcctttctggaaaaattctgtataatttgcttacttcttgtacacttccaggaagcatagaattcagttttttacttatatgcaacagcttccttctgcctttatttcaggcaaaagtatatgtgtttctgccttactggtattcctacttcatttgttacatccctcttgataacacatcctttttttaaagttttaatgtaagctgccacatattcttttatggtaggatttaaattatccaaataaggatgcagaaagtaaacacaatgatgtagagagaatattggaagtgaactatgctatccatgagtgctgttagataaaatgttggcaaataaagctttgcagcctttacaggagatgaattggctcagtgtagaagtagtgcctcagtaatgggatgatggctatgaataatggtttcaatcctgtctttccagaggctgtcatttaacttatggttatttgcagtgtccatgaaattctttgctttttggcctctttaatgttcccagtcacagttgtcttaaatcatctgttatttcctattcctattatctgttttcctcgctggaccagagtaaaccaaagtggccccaattggaaagacttgagagagagagttcaccgggtgaatccatgtgaagcatcctctaaatatctttataaaaataaatgggtgagactgtggggaggttgtaagtccttcctttcataggtggggtcatattaaaacttgagtcattattaccaattctcacagggtgatgagaaaactcaagttacacacttaaagctgaggaaacaaaggccaaaaaaagcaaagtagcctgttcatgtcacacaggtagtggtggagagagatctaggctttgcacctgctaattaagagctctttcagagagtagacctaagagcatcatgtatgtgctttgctctgtttttctgccagttgcttaattcaggttatttcatttactcactacatccacattaggttaatacaagtaccctagtcttacacatgattaagttagaaatacttttttaaaaaagaaatcttatgtttaaaaggcagtttttcaaaaaagccataaagatgactaagatagctgaggtagacagaagaggtactaagcatgtgtgattaagttaaggacattgagatggggaggtgctaatataatcataagggtccttataaaaggagggtagaagaggggatgtgataacagaagaagaggtcagagagagagagagttgaagatgaaatgatgatggccttgaagataaagggtcacaagccaaggaatgcaggctgcccctaaaaggtagaaaaggcaaggaaactaattctcccttagtgccaccggaacacagctctatcagcaccttgattttagtactgttaagataatacatttgggttttttaagccactaagttgtggtaagttgttacagcaccaatgggacactaatacaatagttacagatcttaacgaagccaagagatgcattttctcctccatcgctagagaaaaataggagagctgttttctgtacctctccctggctttgataacttctgcaggggaagaccaggaaggtctggcagcacttcctgtccctcctctctgaaaggcaatggaagggcaccgtggatcaacaaggccgagaggagagacaaagagggcaaaaatcttctttattgagctctcgggcgaggttcactggtccgcagggggagggccagggaagtcgcgctgtgccaaaggggcagcacgcttttatggatgctgggtgaggagtgggcggggtaggggcggggtcggttgagtttcgcacttctctgtgtgacacgccctagtgggcatgcgcgttagtcgggttggcgggaacaggaaaggtgaacccggaaatgctgagtcagggtatccgaggtggcgatcgccatcttggagtcttcacccgagtccaatcactctccactctcagatgccttgggacctacaaaagaacctccacttgacgaggctgacagttgtgccttctgggctccagccttgccttggtattgcaaagaaatgtggaagaatagccaactcacagtttcattacagccttgccttgaacagatgtttagctcatgtcagaagccaggaaatgcatcgcttacagccccacatgtgtttctgcaaaagggtcctgataaatgtctggtctttgcaataatcctactaattggcccgattcctggaagaaaaatggctgtattaaagtgggttagacattacataaacaatgtcagttacacatctttaagtgttacttctgcatttaaaattaacaaagctattttggggacactttttacagctatacatcttaagatgtttgtatatgaaaaaaaaaaccaagtttgtaccggtatcatcatattatcatccagtaagctctaagaaaagacaattaaaagagaaaagtgacccaaaactgtcacaaaagctcttcttttctggacatagtgcagcatatatttgttcataactttatttgcacagaaattttacatccattatcagaattgattctgactactacactagaaggtgagttctcatgaaaaagggtgaatccaacattattaagtaccacacagctagtaactgatgatatctttttttttttttttatggagttttgctcttgttgcccaggctggggtgcaatggcacgaactcggctcaccacaacctctgcctcctgggttcaagcaattctcctgccttagcctcctgagtagctaggattactcaagtcatctgacttccaagttcaaacttttaaaaatatctcatggtggtctttgacaggataccataagtgttgaaccattggtttaactacatgcatcaaggatatacaatttcccttagtttctatgttcaactatgggctaatcccaaggaataaggcaggattactgttgtagaatctattgaggagttattattcccatggttgaggaaattgagaatagaatgtgagataattaatgcttattctgtctgaagtgcctctcatttgtatagtaaattaatataacaaaattttagaatgatttagctatttagctgaccaatctttcagggggtttctctccttgattcaagtgagatatgaaattaaatgtctctcattggacatcagtgccatctattataggacattcaagatgactctctttgttctttccagaattccatcttttctggaaaattatgtgtgcctctgccacttacaaaatttactcttacatttgtgtacgtgtcgaaggaaaagcttaaattgcaaattggatatttaaaaagttatgagaatatttcagtttaaaatgaaaacacaatacttggataatagactcccatattttccttccatttgcaaactacagcatttaaaaattcatttcaaaagtcaaattacccaatgtactttatagtatagaaaggaagtttcacttctgagtatcacccatgtgccagacatttaatagataataaatttttaccagctgtttggggttttgaggaggccattcttccattgtaaacttgtttgaagtgtagatataccagaattctattctggccctgggtgtgcaagaacactgagttaatgtccactgttcctgtaacatttttcactatgacattttcttggtgattttaatctcaataatacattgagtcaatatcttcagaaacattctacaaaatgtttttcaatatgtgttttacagaatatcaatcacacaagatgttaacatgcagatttcattatcaaataagtttgggaaacactgggcaaataaaagttaaccagattccttttctgcaggtctctaatgtattaatatatgttgtaattttccaaaaagtggaatttggtatgcaatatttttcaaactcatttgacactgaaaccattttcagagcttatcacatggtgctagcattccaaggaaaatacttaaataaaacctgatttatgataaaagatcccaggctcttttcttgtatgatccctgtggcccagagttcttatttaagatagtctttggaatacaaatgatgcatctgtccacgttaaacttatctgacatttctctgcctaagcacagagatttataagaatttcctatactcttctaccccatcccctaatctagcttttcaccgtgtggaagagtttaatgttatctccacacctaaagtatataatctttataagtgatatggtcatttctccacatcacttataaagatattcttaaaatttcttccgctcaaagttgactatcagataactctttgtggttcagctctatcatttgggccatctgcagaaagtgtttcactgaggtttgttgtgttgtttttgtcttagtttccttatgagacatattactctatttactctagggtacgtagttaaacctcttagaaaagatccataggccttttatttaagtgttagaactaagaaaacagcctgttttctccctaacaaactgtaaatgattccctttttatttcaaacaccaggaagctcaaaaccaaatcaggacaccactagagtaatgaattatgtccttacatgtctgcacaattgtgttatcatttcacctctcactagcttgtgttaacctgctactctccactttctctgctgttattttgcatttagatcttccgttcatgctacatacaattttatttaatgtattcttgttctaatcaaattcaagtccttctccatcccttctgcccccaacacacacacacactctttgagaatgatttagaaaaaagaacaaaccaaaaaatgtaaagaaaggaagaaaaattattctggtcacaaccctgtctagctagaagctgtggtactagatataactgatgctgagagagcatttaacattcatagtcaatttggaattcacgtcaataaagttcatagtagctgattctttttctgattttatgatggtggcaatatacccattaaaggatctagaacctccagttctccttaattgctttagttaaaaatccatgagaatttaaaaagtttgacacaaaccatcaatacagttatgaatggtacaagctgactttttgaggcaagcatagcatttcctcaccacttaaaaggaatgcccctttcatctctatgtagagcaaggttctcttcctcagcactatttgtgctagagaagtcttctgtgtagaaaaggctgtcctgtgcattgtaggacattcagcagcattcctgacttctacacctatagatatcagtaacacgcccacctccaggtgtaataaccaaaaaatgtctccagacattgttgaatgctcccttggaattgagaggaaatcacccttagttgagagccactaatagaagaaggagcactttcaaaaggacagagtttgctgtgttgaagaaagtccaggaaatggacttaagtggtagttttctgagaagtcctgtgtcacatctgtgtctttctcttttccaactgcccccatgaaattagtaaatggctgcttactctgtagagtcgatcacctggcacaatgtggcagttagaaggaagccacttattcatgcagagtccagagaaaaaaggcctttgatacaataaattatatgcagtgaataacagtttgtagtatgttgatgaccaaacagtggtaggattggtaatattatataatcaaaaattgttcatctgtattgttgtttcagcttacagaaataatatatgtccactgtacaaagtcaagcattaataaacattcaaaaaaatctacaaaagtagctcttgctattgcaaaaatttcagagtaaaggaatgtgtgaaacaaaaagcaaggccaggcatagcagctcacacgtgtaatcctagcacttgggaggccgaggcagatggatcacttgaggtcaggagtttgagaccagcctagccaacatggtgaaaccccgtctctactaaaaatacaaaaaattagcacagtgtggtggcacatgcttgtaatcccagctacttgggaggctgaggcgggcggttggttgaacccaagaggtggatgttgcagtgagccgagatcgtgccactgcaccagagtgagactccatctcaaaaataaataaataaatagataaataaataaagcgaaattaccatctccctaagccagtcttcaaaggtagccattttgaatgacctgtgaatatgaagatattaatacataccttcatattctatttctaagcaatcatttcaatgtagtgtgtgtgtgtgcgtgtgtgtgtgtgtgtagctttttcactgttaaggtgttgattgcatgattgtatatgtaagtcaattttttttacaagaatatggatagtgatttaatgtattcctgcaacacaaattatctaatctattccctattaatgagaatttaggctgtttactttttttactatttgacaatgcagaaataattatctttgtatgtgcatctttgtgcacttttggagacattttggttcattaaattcttagtattgacatatcagcaacaaaggatacgtacatttaaaatatctaaaaataactgccaattgctctccaaacagtttagattgtaacaaagcaaattcccaatacagtgcttaaaaattcatcaagtagtaatgactgctttataatttttaccgttgtgatagaagaaagactgagattctttttttaaacatattttacaaattaaataataataattacagtttcagagaggtgattttttgcccaagttcacaggaacagtgagtggcagagctgaatcacaatcctgggctatttgactcctaagtatgtgcttttcttttctccagtgattcccaagccagcagatcactggaaacacacacagagctttaaaaaacacagctttgctccagcagagatccatctgcattttttaagttccttggttgactcaaatatcagttctatctctaattagatataagaaagtgttataaagttaacatactcagtaaagcaggctgaccggctggaaacttaacctgtatgtgtctcttctgtgggtgcccttcatggaggggcaggaggagtgaaccctgtggctctttagccaggtatggaagagaaacattctccttctaggaggtggaagggctagtcttttctatgtctaaggtccaaactcttcctaatgggacagtgggaatggagtaacctcaccatggagtgaatccatcagtggagggctgccctggccaggcaggaagctgaacttatgtgggactgcaatggcagtgaaccagtgtgagcagagcctgacatgaggagcagcacggggtctgcagtagccaccagtttggacaccaaccccaggcctccaacctcaccatctgccagaggcaaggctcaagccttccaaattattgaatgaccagagagagaaagtaatccggagtttctgccacttgatggttggcagctgggcctagttctaatttgacttggtaaacaaagaaatgtggcattattcacaactttagatcatagagcagtttacactggcaacctatacaatagtaaacatatttttcctataccctagtataggaaaatataataagttcagtaagtttatagtaagtaaatatagtaagtttagtaaatatagtaagtttatagtaaaaataacttttatttttctactttaattactccatctttttcaaaggaaaagtaactttcaaggtccctccattattttataggaacagaggtgtggtggagtctgtgatttggcttgcaagtgtgatcttgcagtctcttgctcttttctattttgcatgtgtttgtaaattttgggcaaccaaatattttatttaaaatattaggttatatataatgaagcatttttgtatcctcacatgtagtctaatatccaaatatgtatgtttttccagcttggaggtataattattgaggtataattaacaagcaaaaattatatatatttaaagtgtacaatgtgaggttttgatatatgtgtgcagtgggaaataattacagcattcaaactaaggcagtctcttgaatgcaccaaaaaaagcaaaagtactatctcccgaaatcacttgccagaggtagtttttgaaacaagttgaactgtagatcacattttatctttgtgagctgtcctataagatcctcccacacccagcctgtctatattcagacagtgtttgctagaatgtagctggacaacctctacttcaacactcgagtgaggtggccaggggccaggagcagtgggcatggcccagtaccccttggcactcccaggcagagcccacttctgcagactgtgctggttctgagtaatgggttaatttatacacaatgttcagccaaacattgaggcagagaatgccaatgcaaagaattggcccaagtgccaaccaaggggcacaccccttcagtaggctcagtttcgaggttggaggtggaattgcataagaattcagttactgtttattaacatagctctgtgcacctctggcatctactggccagagaccctctggttttcacatttaccctcagcaggacaacccagactgtatggattgtgtttacactggaaaaaaaaaaaacatgatattccctacaatgtgagaaaagaagttagagatcttctcatcttcgctccttctttatagaaatgacagtactgaagcttaagaggtaaaccaactttcccaatccagcattgctcgtcataaacaaatccccacatattttgataagaataaaatccattttatttgcaatctcaaatattagggctttattaccatggaatgaagatcattccggtacttcttgatcttgaacatgtgtgggaatccctgaagaatcttgttacaatgcagactctgattctgtaggtccgggtagggcctgagattctgcactgttaacaagctcccaggtggtgacccaactactggcctacgcttttgaatattgagcatttataggcaatgccttgcctagtgtgggtggacttgagcctccacaagaaagtatgtagggctttccactgtgaatacatttcctggtatggtgaggagttcccatcaaagaattcttttgctatgcctaagaatagcaaaagaatagaatttcatgcaagtgctttcttcagaaataaagtaaaactgagaagatggatcatttaaatgttttgtatttctgtaaatgcacaaatcatatttctaagtgtccttggcagaggaaccttatcatagttaagaaagtttacatctgcatctcccactcagtctgagcatgctttacttcctcttaagtaataatcgacattgcgaaattgcagctaggcaactagcaaaatgttcacagggaacacaactgctagctttcgctcataacaagctcccttccctaacccatgtcattccctacatgagcttattcgtgggtttcgcagccttggcactactgatgtttggggtcattgttgcaggggctgtcctgtgcacagaaggttgtttagcagcatctctggactcaccgcactagatgctggtagcactccacccccagttgtgacaaacataaatgtctccaaacattgtcaaatgtcccctaggagacaaaatttcccttggttgagaatcactcctctacaaaaataatttatactatgttggaaaggacaactagcttaaaacattgatttatatagtttcagattggaaagagagctttactgcatttgggggtcacacactgagacagagtctcacagtcacccaggcagtggcacgatcatggctcactgcagcctcgaccttgtttctacaaaaaataaacagttagctggatgtggtggggtactcctgtagtcccagttactcaggaggctgaggtggaaagatcccttgggcccaggaggtcaaggctgcagtggagttgtgatcgtgccactgcactcctccagcctgggtgacagagggatacctagtctcaaaaaaaaaaaaaaaaaaaaagtgtttcctattctttactcatggcttctcagccatgtagctaaattctggaacagctcatgtgtacagtcaatgacagtaagtccgcttacaatacactccacatcactttgagagagaatgttttactaacatttaactgacaaaaagaagagagaaagagcaattaatcaatcaggtatttgcctaaatgctgaacaaaagtgatctactaaaataaccacttgttcttagatctgttgtcttgctgttaagggaactctgaagtaaaacacatattaagtacttcaaaattcacttcttgttcacagattctctaacattgttaagatgtgacagcctgaaaacatgtcatgcagacactagttatttactgtactaatattaataactggaggccctggcacagggccagagtgaagggaccttttctatcctcttttttactgaaagggaggaaaaggcattctctcagttctaagctggaggtggcatccatcacctgccaatgaacaagatctgctgctacgcagctgccaacaccccttccattcacactcagctgatatttattgtacacctaccatgtgccagatactaatctaggcaccgccacataatttatctattttatttttacaataactcggtacatttgggcacaaatggagaatctaaggaaaagggtttggctaataatgccaagcctattttacagccctttgcgcttaaaaaaattttttaagagaatttgaatggattttaagtattcattatgttcattacattcattacttacttccttgcttgatttctttatgcaatagatgtccttgaagagtttggaagcaaattgcagttttgtaagttgactcacttttgaaatgttttagtgtggctccatgatatttatgactcatgcagcaaatttgcctaaacaaaacaacctttagtaagatgactagccactctatctgatttttaattctgaattttaacttagtggtttccttatagatgaacatatataacattttctcaagtcatcaataaaatctaagccaacagtagtttgcattttgacagcaatgaagtaaacttagatacttggtgtaggaataaatattaaccccaatagttcaaccaatcaaatgaaatgtacagctgtatgtcttgaatgacgtcaatgtttgtattagtttcctatggctactgtgacaaattaccataaactgaatggtttaaaacaatgagaattttttctcttatagttctggaagtcagaaatccaaaatcagtctccctgggctactgtcaaggtgctggcagggctggttccttctgggacgtgggaagaatctcttttcttgcctccatcagcttctcaggccatctgcattctgtggctcttgacctcattctcatgtcatcccaacctcttgcctctatctgctgtgagtcactctgatctcctgcctccctcctataaagactcttgtgattacattggcccaacccaacaacccaggataatctctcacctcaagatctgtaacttaatcacacgtgcaaagtctcttttacaaagcaaggtacccatattcactggttctgagaattaggacttggctgtctttaagaggccattattcatcctatgacaacactgaaacaaaactcaaactaaacttagtaaaggattggtacagagccaactaattacctaaatcagtttaagtaattaagaaatagacctggaaaaaatgcagcgagtgatgaattttaatccaatctgccaatacaaatctgggactttccatttttataagaaacgcagcagtgagatgaaaataatccttaaaacatcactgaaaggccctgtaattataacctgctccctggaaattaaaggaaaactaaaagaagtatccagaaaaccccaaacttggctgtacttatcacagacattggtaagtaataatactatacaacattcactttggattattatctagaaaaattgattagcttgactgaggccattattttttcccagaccccatttataagcaatgctatctattgatgaaaagctgtttgaaagcagagtgtggcgtggatctcttctccataagcaacctgctctgaccaccctgaatgagcctgattagatgcattctttgctaagcaaagggcactttgtttattttttatttatttatttatttatttatttattttattatgttttagcacaacttgcacagtaatattcaaggaaaaatgtttgaaaccaagtgtctctgtctcactatggaatgaagttaaacagacatagttatgcatctatactgctttaagcaggggtaacaataaaatacttcagttagattgtaacagtacatgcactgcaaaatgcactacttatttatttatttatttgacagggtctcactctgtcacccaggctggagtgcagtggcaccatctcggctcactgcaacctccacctcccgggttcaagcgattctgatgcctcagtctcccaggtagcgaggattacgggtgcgtggcaacacgcctggctcatttttgtattttcagtagagacggggttttgccatgttcccaggctggtcttgaactcctggtctcatgggatccgcccgccttggcctcccaaagtgctgggattacaggtgtgagccgccgcgcccaaccgcaaagtgcactttaaatacagttgtatttatcttccaacaggtataaaaaccattataaactatataatgaattggctctaccagtttattcaataaatatttaaacagttattaagatggtaattatatactttgaaggaaacgtaataatggattttatccttgaggctaaaaagcacttgtggggcttttggtctcctcctcttgaggaaatttgtgactgtttttaaccactacagttcagcagaaattatgcaaaataattgtccaaagtagggacagaaaaaaccaagaagctgaaaagaccatggatgtcaggtggaataaacattcactcccagagccccaagctgccaggtgaaaagcctaactatcctgaggctcagaaggtatgaggaagaggccatgccgtgtggagagcccaggtgtaaggtgttaaagttgacagtctcagctgcagccagccttcaagtcattccagcccaggcaagatctataaatgaagaagcctccagataattcctgcccagtacaatcaagtcagctggagctgctacactgtggagcacagataaaccacacctgccttgcgatgtccaagtttctgacccatagaatctgtgagcatgatgaaatggtggtgttacctgccgctaggttttgagatgatttgttacatagcaaaaataatcagaagagtctttcaaggctgaccacaaattaatgtaatgtaatgtcaacgaaactttttgtgttaacacggaattgtgactgaagccacaaagctgacaaagtgaggtgttataagtgtatcaactctcattagagctgcccaaaatagggccagccaagagcagcagcacaatggaccattgtgcaatcacaccagcccccaatgtatttgacaggacacttattttgcaaatcttcatttatcgttaagtataaacaggtgtttacctcaccttcaatggtcaacaacctaaggtgacttaaaaaaaaatactgataccaagtccctccccagatggattgaatcagagctacttagggtggagccaaaaggcttgttttttaaagcttcccaggtaattctaatatgtgtgtagtcgggtatgagaacgattgcaagcaaaagcagctgagggacgctgtccaaggagtaggctcagtagcacgaactgcaaatacttgagaagggaaaagttcagccttgtgctggaaagtggtttagcatgctggagctggttttctgcttggtagccctacaactttggcccaactacttggcctctgggactcagattcctcctctttaaaatggtgctaataatagcacccaccctctgtgaggaggatgctgtgaggacaaaatgagatcatccacataagccgtgaaccctgttcctggtaaggtaagtgctcagtaaatgagctgctattagtacaaggttatgttggaaatttatgatgaagtactgccatataatgaagttctttttagtttttcaaacatttcatgaatgtaccttatttcagctatagttagtatccaaacaactttgctagattgatccactttttatcagatttttcttgatatcaggaaaagctgtgctttgcctgagcaaccactttttcattttttattttttcttaatttggatgcaatgaatcttgcggtcaatttgtctctttgctttggcattagaaaactaaactgacccaaatctcataactgaataaaactggctatattggtctctccttgttttttccgttcctccttaaaacctcagctttgattttatactttcatgcaacatgtacatctttttagaaggtgactcaagcacttggtaggatgggaccaaggtaagttatctgtattaggagagtttttctatgatgaggtccagactaataggcaactggttaattgaaaaatgtggttaaagcagggagtccttaaaacatgtatacacaccttaaatttttttaacttaaaacatacaaatgtgcatcttttaattgatcttttggtatacaggttgttacaagtccttgtctttagaaaaggatctactgctagaacttgtcactgtgtttcttgtatctcccacacctgaaattcatcaactactataaccactttttaaaatagaatgagaactgagacacttttaaagagtgtagaatcttcctagaatgttaatatattcctcccgaatctttaacaattttcttgcccacatcgaattcaaaaacatttttaattacttccattgtcaaaatattttaatacttttaaccaaattttcataggagcagtaaatttcttgttgcatttcatttgtaatatttttattctcaggtttgggacaaataaattgaatctcaggacacaactcaactggtggaaacaaaagagcttgaggctgtccattagcctatttgttgtgaatgtccatgttctgtcactttggtctgtatgttttggacagagtggggagttttgtataagtggttgatatagaaaaatagcgacatgaataggcccatgtaaaaatacatagctaaacttagcaatgagaacattcagaggtatccaaatatacaagtatgtagaggaacacgagtggatgaccatgggttagtacatctgtgtagatggctgtgtgcacatgtgcccatgctttcccataaatgattgtttttattctcttcctctcataatattgctcttggaaagatctgacagtacctttcatttggttgccattttcagaatgaatgtaactttagtttttacattggttccatgtagttcaaaagttgtttcctaaactgatgtttactgttctttaatatttctgggaatattttagatgtttgtccaaatctaaaaaaattataacacagcatgcttgggagagcacacacattttattggtaagaaacattctttcccttcatgactgtcttttaaaatttcctgattattgtgcctcaattatagaggaaacattcttgacttgggggattagcttcataaactcatgaatctcctgaatatggtaggtagatttaacactgagcaatgaaaactactaaatattaaaggaaaagtgaaagttgtacctcgtctgcagccaactgtgataggtagcaactttgtcacctgaggctctctagaacactcagaaaaggagatttgttcttcccagggtgataaggaagggtcctagtgatgggtgtaaaattcttttcaggtgcacaataaaaagcattaaggcaaaagcttttatctgattaccattaagtaaatcagggatttctgtagaaacttacatttcaggtgtatcttaaatatgataattgggccgggcatggtggctcactcctgtaatcccagcactttgggaggccgaggtgggcggatcacgaggtcaggagatagagaccatcctggctaacacggtgaaaacccatctctactaaaaaataaataaataaatatatatgtgtatatatatatatatatacacatatatatatacgtatatatatatacacacatatatatatacatatatatatacacatatatatatacacttatatatatatatacgtgtatatatatatgtatacagaaaattatctgggcatggtggtgggtgcctgtagtcccagctattcggcagtctgaggcaggagaatggcgtgaacctgggaggcggagattacagtgagccgagattgtgccactgcactccagcctgggcgacagagcgagactccatctcaaaaaaaaaggagtacaaattgtccagtttaaataaggtaatttaaaagaaagtaactttcccaagattaccaaataatgaagcacagagaaacctgcttgggtccttcccttctctttatctttattttatctttattctttaggtccctttatgggtccacctctgcctatcttaatgattaactatacaagctgaaaaaaattatagaaatatattaataactgatttaaccatattaagttcaattacaaagttcagctggtctctcagctctgggtgtgaccacagatcacaaagttctgagaacggctgggaagcatgtctaatagattgtgcttttctattaatcacacagctcttagttctggggttttatgataaatcctaaggtttatcccaaactactttcttccaatgcagcttttggtatatgaatattctatgggtagtatattttcattaataatgtctattaagtataagttagaatacatgtccctaaatactttaaacatgtggagaaatgttaaatctttaggcaaattacatacagaatagtcaatcatctttattgttcttccccagagaccaagggattaataagatattaaatggccaattttaagtattgtgttaaggcaaagttgattatagttcacagaaggaatgttagcaagatgcgtaattaaacattatttgggtcacagcctaatagtcatggattgaagagtgatagtgacctaatcttgaagtcttagaatttaaagcatgaaaacacttaacagcattactctctcaagtgtggttattgcctcccaagaagtgcacaggagaatctactggagtacacgagttaataccagaacttagaaatgtaagtttacattgtatatgaagaggaaacaagacaaactttacttgatccactcttcaacaccaatgctatggttcatagtgcatccctgaagtcacaagacatagactgcttgtgaggtgctccaaggacaggaagggagctctacagcccagagtagagcgatagaagcatctgtagtcattcattaccttctaaaatttagagacccattgcagtttacctatgaaaaatttttgtttcaatattcttctagatgtcaggataattttttcttgattttactaataaacttcattgcttttgtttatattctaagaattttattcacttagttctgtaataagtctgaagacaaaatagtttaagagtctgtactttatgttttattgaaatgttccaaaatgtcattacaacttgcagtttaaaatggtatatttgagcttcatcaacctttaaaataaatgtcatatcttgagtttgagcttctcttctgcatctctaaaatatattttagagaatttaaaatatcattgtcccatcttccaaagtctgaaaaactttgcaatggatagaccatctcattaaattagatcatttaaagaaaaatccaatttgatgtgtgtatttaaaatactgcgcctttgagacaaacctggaaaatatatatataaatatagaactgttgaaaaggtatgcgaatagtccacaacttcagggtgtcctggaggtgagtcctcatctcatgagacttagataatgagctgctcacagacatattccgtgtacttactaaaaaagaatgctgtctatatctttcattacagctctactgtcaaaagactatgaatgttgtcagttgttcattgtcaaggtacaatgtccagaacttctttgttgagtaaagtcaagtaaagtcatagccttcagttggcaaaaaatggtaaaaattactcctaggttgtctattttactacttgcacacaataatcaattgactggtgtttgtcatatccaaggcagaatctgcaataatggactcatattcgatgtttgtttatatcacttaatgagacagccaagtgtgaaggggttcctggaaaaattccaaccagcccgtgcagtggaaagtgtgcacgttggggtggagccacagaagtttgtgccatttgcagcagggaggagcttggcccttcctctctcctgggaggaacctgggattcaatctgcgaggcaggaaggatatactagcaggactcactctgctgagggtacctgtttccccttttcttcctttttgcccaataaattgcattttctcaaccttgaaagtatctgcaagcctcatactttatggcaatgtgacaagtaccccatttttagctgaactaggtagaaaatcctacaacattttgttcatgttttccaattttcttgattaattcccataagtagttgtgtgtataagttaccactgttttttgaatcctgactttttactagcaatcttgcaaaaatagatccaaatcagcaattcatttaatgattatgtgatttccatgagatttcctttgaggaaaaccatatttttatcatgccttttgaagagcaaccatttttatataaaaataactacaaagatcattttttagcacttgaagataataccaaatgctctatttattattcaagatgcttgtctgatggatttttattttatttatgtgtaatccaagcaaacatggtgttctttatcatctgtcctaccaagacttcagaggtccttttgtctatagaaagcccatatctgtctgttttattaactactttaacccgtaaacttgtaacagcttcagagaggttaagaacttttgttttttgtttttgtttttgttttacaatagaagtatctaaaagaaaactgagtagataaaaatatttaatataaatattcttgtaaactttccattttaattagtttccacacagtgagccccttttaacactgaacatattctgcttttcattaaatggtaaagtcgaatagaacttcagagatcagataaatcctaaaaatcccttaggcagagccaaattaaagcaaaattttacagaaagtgattcctccccaccccaccgaaacatccattcctcctgctcctatatcccccaaggtatacttaatccaaatcccacacatatttaatttcaattttgtggtgtaattgctcataaaaatttagctcagtagaggtcaaagcctctcccttcttttgtcaaagtgtgttaactttgtattacttacaacagaatagctcccttttccatagaccttctatatctttagtgaattaacctgccgtgtagttcaaatcatgtatctctatattgccacagcaaagaatcagtgtttagagatcaagtcaaatcaatttaaatacaaataaatgagaataacgatacagcacgattacaaatgaatgttttcctttggatcatttattaccatcttatcagaaaatagaccaaagaccaaagtgcttatttcagtgggaagaaatgtgatgattcagtgagttgctccctacagaatcaatagaaagcagatgtcttattcacatacccctgacaatcttgcagtaagtgctggtgcctagaaactctgtttgtaagatcatgtatagcatgtctgcatctaaatgaggatttgtgttactggaaatcatacatgagggattgctgccccacccccatttcaacactaggtaagcgggatacattttgtctatcataactcattagagacagagtcttgttatgttgcccaagccggctcaagcaatactcctgctttagcctcccaagaggctgtgactacaggcaaatgccactgtgcccaacttgtttattgtaactttgagtccaaataaacttgccctgatttatgcactgctttaatgttactacacctagcttctgtaataaatatgcaactctaagctattcttatgcttccatggaatatcttaccttggtcaaattaattgcttcccaacttaatcactgagaaaacagaaaaaatagagggccaagataagaatgacatatgaaatagactgttttaatcatgaagttgacagaatgagccctactggttttctaaattaaggccttatctttgttactgtgagcaatcattttgggaaactgccatctaaagtacatggatgaaagcaatattttattacttatattaacttttatttcctattaaaaattaatccatgtcaattatagaaaaataagaatattacagttaagcaaatacaagaaaatacacagtaatctgtaatcccaccagtaggaaataaccatgattagttagcattctgatacacaggcttctagacattacaaactccttaacctaagggctttgtgctactgtttcctctgcttaagatgttccacagatctgcatgtggcttcttaattcaggcctcaattcaaatgtcacctctgaggatacgccttccctgacaagcccagacaaagcaagccccagcccatcttcccagtcattttctagcacattaccctattttatcttctctatatcccttagcggtacctgcgattcatttgttagtgttcatagtatgtttctctccacttctgtcacctcttgtctccagaacctataacaacatcaggcacatttttgttttttaggaaatatttgttagcctgttgactgaaactgacatacccatgagcattttttttctgtcagtaaatattttcccagaacatctattggtggctatatccagttgctacatgtgtataggtatatgatgtcataaattattcttatgagtctacaattataggacattttggtggtttccagtttttactatgctaattgtatagtgataagcgttttaatagctacatgggtacgcacatccaggattatttccttagaaaaactcctagaagtaggatggctgtattatagggtatatacttcttaaggcctctgacaatatgcattaaattatgctgcaaaaatttgaaacccattaatactcctattgatgtaggacagtgatcaggtatcacacctttgctaatccttgagtattgtcatttaaaattccttgccagtgttacttttagtgtgaaaactgagttgaaatgacaaatattgcatgtgcctgcttgtgtcaggctagcatggagggaaagtgattaaaagtatgtctctgtagcagggtgagccgcagacaaaacctctcagacactgaattgtagaaggaagggctttattcagctggcagcatcggcaagctactgccttaaaatctgagctccccgaatgcacaatttctgtcccttttaagggctcacaacactaaagatttcacatgaaagggtcgtgattgatttgagcaagcaaggggtacatgacaggtgctgcatgcaccagtggtcagagagaaacagaacagggcagggagtttcacagtgttcttctacacaatgtctggaatctatgaataacattggtttctggagtcatgagttgatttttaactactaggtttaggccaggcaggcccaggtccggttttgggcctgccgtgaggctgcctgtctttgattttacttccctgttgttttttcttaaaacaggtactgagtataaaacaatataacacaatatgagagggtctctcttttctctcatctcaagattgttcttcagggccttcatcatgacatgactttaactgagcaccgtctcactggcaactagacctcatcttgttatacatctttctttgttctaacactgaagctgatttggctccaaatgagctgccttaaactgtaaatattatgcaattcatttaagtccagtaatgttctaaacttggatctcattattttttgttaacatctaaaaattttgcgagcagaaatacatcttaggccagaaagtaatttgatttggctagggtacaatcagctctctttatctgtgggttctgtgttcatggattcaactaaccacagatacaaaatatttggaaaataaagtggatgatggtgtctgtcctgaatatgtgcagatatttgtccttgtcattatgccttaaacaatgtggcataacaattatttacatagaatttacattgtattcagtattataagtaatctagagatgacttaaagaatacaggaggggatgtgtaggttatatgcagacatcatgctgtttatttgaaagatttgagcatcctggattttggtatccttggagggtggggttttaggaccaatcccccagagaaactgagggaattattgttaaatatctaaaactcttcataagaaatgcaaaaacagttcataagaattgcaaaaacaaaatgggatagattgagagcccttcctgtgtatatagggtgttcacacattcttttgctcagtaattcattgacttggtgaaaaaaaaagccagctggtgcaatggctcacacctgtaatcccagcactttgggaggccaaggcgggcagatcacctgaggtcaggagttctagaccagcctggccaatatggtgaaaccccctctctacaaaaatagaaaaattagctgggcgtgatagtgggtgcctgttattccagctactcgggaggctgaggcaggagaattgcttgaacctgggaggcagaggttgcagtgagccgagatcgggccattgccctccagcctgcatgacagagcaagactctgtctcaaaaaaaataagagcctagcattgactcatggtaaaatgaattatgatgtgaagaacaccaagaaatatcacaattgattcctgaacccaaatatactctttaactctgaaaaataaatcccaggcagaaaaaaaagtttcacggtaagaatactgggcgatctcaaggtagttaatgacagactgaatgtttgtttcttggaacaaagtaagcgcagagggtttggaggatgtcgtggtacccggcagaagcggagctagaatctgagctgggtggcaatatttcaataagagttaaaacctcatctattcttttttagataattggtgggcaatcaaaatctgaacagacccaattggcttcagaaatagtcaacatttatttagatttagaccttccctcatggattccaaacaggcttttctggttttgtcccttcaagtatcctgtgttccaaccaatccaggtgacttagtggttgttcctttcccactgttacctttgtgttcattggttttcagtcttaaaagtgtaaatcttaccaagtacttaatgccaccttcaaaatacaattcagtcacgctttagccaaatgctgccttccctgttaagtgtcttttctgtcctctgctagatcaattccctcctttctttgtggtaatacttaacacattctgccctaaacaatagttactgctgttcttaacttcagtcctcatttgaatttgaaacttcctaaggacagataacatgacctacattttaaaaataattgttccaataatttcccctcttttaaactatcatatacttgttacaaaatgttataagtataaagtcgattgtccatttttccaccaagtaaagacagctatttctttgtgaaatgtttaatttcaacctttttcatgcatatttttgtcattgtgctcttgccaaatataagcttctgtacaataagagctaatattaaatgctgatatgaaccagatactgctttaagttcattcatatgttaattaaatgtcttcactggaaccatatgaggtggttagcatttttatccccctttacagatgtaagaaatggcccagagaggttatgtcatttgtccaaggacatacagctaatatatggggatttgcaaaatggcaagctggccccaaaggtaccactgctttctaaaagattcagatatctttttcagtggaaaccaaatgttccatcatgttggtgtatggtaatttacttaaccattttctgatcttaacatttaatttgtcatttaaaatgacactgtcattatcattttaatgtcccaaactttctaaaaggtaaagtaacaatccaagtgaattattcggtcaaaagatattatttgaaggtctatgatgcatatcaccaaattgttttccaaaagagttttaaaaatcgtggttcctagagtagttcatgagagagtattgtagtgaccacatattactaacactgaaaattttttaaatttttttatggttaatttcataggtaaacttcttgtcataatatgaattgataaaaaacttagacaaattgcattgaacagagtttaatgtagcaaagaattattcatgaattgggcagcccccaaccagaataggttcagagaggctccagcatagctatgtgatggaagatttatggacagaaaaaggaacatgacacacagaaagtggaagtgagatatagaaatagacaactggttaaaacccagtgtttgccttatttgattgaacacagtttgaatagttgccacctttgattggccactttgattcacttagttagtggattataactaagttatagctcactgtgtatggagaaactttaggctgaactaagaatatgtgaagatgcagctttaggctaaacttaacagtatctcttccatttctagtggagatagataattttatgcaaattgcctttttgtgtctttcttttgcaacagttcatttcgactctttgcccattaatttattgaacatgttagtgtttttttctatcagcttgaataaacagctctgtaatagaggtaataaaatatgcctgttggaattactacagattatatctgtgtttggtaatttggctacctatttcagttatttccagaaatataaatgtttaataattttatcttttgattattcaattataatttattctacctcttttaaatctatgaagcccttcttcaaagagttaccaaatattcatttctagtttcttttaattctaaagtagatacagctgttttttaacaacaaattcttattctacctgtaactgatatacggatttggcagtataattaggagaaaaatcaaaattttcaaaacatacatgttttctccaaatacataatcagttaacaccagtggttcttagtcacgtatgtgcattttggaaggttcaatgcagagccttacaaaatccaggcacagcatgaaagatcattacactttgcctgagactttggttttatgctattggctgtgatttgaggaaactaaagtcattggcacaaaaagttgttggtgctggtgcatggatttttattcatctcaaataaagtgaagggactttgaaatctggcttttccatgtcttccaagactgtttaatgaaatatttctctttaagaagtgatgtaaaatgcctaaggaaagatttagatgtttctacaagaaaaaaagtatatggtatcatgggcaggggatttgttgttctccttttgttgttatgctgcagcaaataagtatttaaatgacaacacagctcagtcatggtggcctcaacattgatggaaaacaaggaaaaacttacaaaagctatgtaacttacaaaccaaaacatcaaacgattttgtgcgtattaaattgtcagagatatatttctgtaatcttgaggccatttttttttttaattttacttctggtatacatgtgcagaatgtgcaggtttctaacataggtatacatgtgccatggtggtttgctgcacctatcaacccatcatctaggttttaagccctgcatgcattaggtatttgtcctaatgctctccctctccttgccccccaccccccgacaggccccggtatgtgatgttcccctcctgtgtccatgtgttctcgttgttcaactcccacttatgagtgacaacatgcagtttttggtttctgttcctgggttagtttgctgaggatgatggtttccagcttcatccatgtccctgcaaagtacacgaattcattcttttttatggtttcacagcattccatggtgtgtatgtgccacattttctttatctagtctatcattggtgagcatttgggttgtttccaagtctttgccattgtaaatagtgctgcaataaacatatatgtgcatgtgtctttacagtagaatgatttataattcttttggtatatacccaggaatgggattgctgggtcaaatggtatttctggttctagatccttgagtaatcactacactgtcttccacaatggttgaactaatttacactcccaccaagagtgtaaaagcattcctatttctccacaggctcaccagcatgtgttgtttgctgactttttgatgatcgccattctaatttgcgtgagatggtatctcactgtggttttgatttgcatttctttagcggccagtgatgagattttttttttcatatgtttgttggctacataaatgtcttcttttgagaagtgtctgttcatatctttctcccactttttgatggagttgttttttttcttgtaaatttaagttccttgtagatgctggatgttagacctttgtcagatgggtagcttgcaaaaattttctcccattctgtaggttgcctgttcactctgacagtttcttttgctgtgcagaagctctttagtttaattagatttcatttgtcaatttggcttttgttgcaattgcttttggtgttttagtcatgaaatctttgcccatgcctatgtcctaaatggtattacctaggttttcttctagggtttttatgattttagaaaacatcaaacattttaaattatttatattaaagttgaacaatactttatttggaatatagtagaaattttaaatctgctaatatggctagtttacatgtaagcattatgaatgtttgtggaaatgtatgtaatacatacttgtatggcatatttgttatatgtgactattaagcaatgagaccatatttaaatactctgagaaataattgcatcagctcatagtgactactttgaaggcaaaacattcatttgtatatataagttctaaaatctttaataaaatatcattttatataaatgtcatatatgcataaaaactactgatcaataatgttagcccttaagtatttctatcagatctcccacatatattctgcccaaattcttttattgtaaataataatataaggcaaaacatttgtcagccatggattaatatttctgggtaaacaaatgaaggaaaacctcactcctcataagacaaaaacgaaaaaataacacccaaacaaactaagtctgaagttgaaattgtacgtaaaatcctatgaatagagaatagatttatggtgactctctaaatgaaaattttaaactgaataccctgacatagctgattacttttaatattagagaatattgcaaatccttttggaaacactgccatataaaacatactctaaaatgcacacatctaacacctacacaaatacacagggactgtgtactcagaagtacaacagatgaagactaacttaggtgtgaaatttgctgaatgacttccaatctgaagtctctgtcaaagaaagttctcagtggtagaaaaatcaaggcatttaatttcttggtagaacttttcatttggaacacaagtgtatcattctcatagcaaatatgattgactgtggctcatcctctgtatgtgcccttgcttcccttatctataatcagggttgatttttgaggaaatctgtaacttaaaatggtccaaactttatttcctctaaagacttgctctgacttagagttgatttaggactggaagtgcataattgggctcattgtttcctgctgccatgctgtattaagaaaaaatttaatgtatcctgcaaggattagcataattttttgaaagctggacctttgcttctgaagcttaaattctattgtctatttttctattcagattttatgcaagttgctttttattttggaggtcttgcgattctcaagtcaacttgtttctttgtttactgtagtgtctgctgtataaagtagaatacacattccatgtgaccaaagtctctgtcttagctacttccgtatttccagtgcttgtcatgtaaatatttaatgaagaaaaacatacttttatttcagtgatgtaatactttgcagaatattttttgtgggttgtcccatccctgtcacccagccttctcatgatcactatctgaattttttacttgagagtactgaacacaattcttctttcctagacctcagttcgtcctcacccttgacaagtgagcctcaaagtatggttgggtgaaccctggggaggaggggtgttctgagatcccatcaggaagttaatgatgtcaaaattattttcataacaataccaacatgctctgtgcctttttcacttgttctctcacaagtgtgtagtggagctttccagaggctaacaggtgatatcagtgctctaaccgctaaaagaaccaggtgcttgtgtacttttgtgtttaaaaaatttctctgttttaatatggtcagtgtcaataactgtgatccacataagcctttgagatcctctctggatctcacacatgacaattacggatggtttttatgggacacaagctcagtgttccaaagaaataacttacaggtggacttttagaaatgccattcataaacagtggatctgttgtttgcgtacaaaataagatgttaaattaaaactattctcttgccaaatttcagcagaggcccctaaaaccaataagtgccaagaaacctgagattcgaaatgggagaataatactatctattcaggacatcctaaattgtgcaactgatagtccatatccagatgatataacatattcttgcatgaaaatcaaggtaataggtattcatttgaagcaagtagtaaatgtattatgtatttctccaagggggatgggaaaggagtctttttattcatctcaaatcaagtgagggaactttgaaagaagagttggagaacttgtcatgtttctgctggcatgtggaattaggggacagtctaaaaatagtccagcgttttgagaaggcaaactgaagagaaaaagggcagtccttcaacaacagcaaatacaagatgcatgcttttcatcggctggatagggagctggctacaaacactcttgaaaaggaaaagggcttctggctgtgagcacagcaaacattcgttactgaagctgagggggctctctaggcaaatgcggtgggaggtctgggaggtaaagtaggtatagaatctaaggaactgtcagaagtgtcctgcaagagagagtcagctttgtcatctgccatgactagcgggtaccagtgccctgttaactgtgccaatcaaataagactccccttcatttactgcttcttcctgtcctcctttgtccaccagaaaatgcagctaggacgtaagagaggaggtggtcccagggagagaaggagctaacccctcctcctttccccactgcaagatccccagcctgaggaaaaatataagttgtaagttggatgacagctttgagttttgatattatgctggacaaagctttttaatacctggaaaaggagactccttatttaatacccgcataagctgtgagatctaccccaagattctctctaaaagtgggaggatggagtttacagtatagattaaaagagatagaagtaaaatgaaaaaaaaaatttcatcttcctctaggacatagggaaggcatcttggtcatatattcaagtagaattgctgaagacatgttaactcctgctaaatgtatttcagctttcttgtccagattttcaatatgaccccaaacctcttttcagcattgcttctcttgaaacacgtgcttatctcttttttcaaccaaataaaactctttgctacccctacccccaacctctcccactcttctgtacacctgtgtatatatatgatttcctctttctcagattttcctatttctgctagttgaaatcccttgtgactttcaagttcacttcaaaagctcttttataaagcttgtaagagagaaacagctgggatggcaaatcctaaaatcctttatgagctgccagtggcagatgacacctcctctgcgggaattatttttgtgggattcactgaaaaaaaaagaaaagataggctcctgatttctagatagagattagtaacaaatcctaagctccctcctgctctagcacacagagatgtggccattggtactttacgcactaaacctacccctttattacaataccaggtttaagaagtgccccatttccaaagggccccaaatggatgctgcttcagaacacgggacactcccataaaaactccatcagccaaatgatatggaagagagcaccacaaagaggaaatttttaactcctccatcttcccatggaaagaatctccattcattgttatagcatcttaaatatgcatatttgaggatttaattttctccattctatactcattatattcttctgtctttggataggtggttttattcagatttcgatattggttgtgatcatgggaatagctctcttgtagagattaaaaagtgacactagcaaagccttccctgacccactacagtgttagcccattttgcattactataaaagaacattgagactgggtaatttataaagaaaagaggtttatttggttcgtgattctgcagggcaagcagaggcatgaccccggcatctgcttggcttctggtgcagcctcaggaagctttcagtcacagcagaaggtgaaggggtagcagatgtgtcacaggtgagacaggaagcaagacaaagggagagagagccagattctttttaacaaccagctctcctatgaactaacagagtgagcaactctcattaccatggagagggcaccaagccattcattagggatttgcccccatgacccaaacacctcatgcgaggccccacctccaacatgggggattacatttcaacatgagatttggaggggacaaacatccaaactatactaactacctggagcacagaaattttttatctctgatagcacttatattatttttccttatagaattgttatggctatatgcctacatgggaagaccatgaggacataaattctacaaagacagggtctctcttgtctgtcttactaatatttgtatcctctgtagaaggcagcacataggagatattcactaagtatcaatgctcatataattaaaatgctgctatattacaattcatcttgaatataacttgggataaaatatgactttcttaaactacattccagaggttcatttattggtgtctcagggacccttctctataaaataatctccttttaagactcttaatatatggaccctaaaaaagttacagtaggactcaatgcatcaagttgcttatcacttcattatacatacttcttagaaagtctgttatccattgtgcaagttcttgtgaaagtacatgggccaactttgttctacaactcttatgccaagttcaaaaccacaatatctcagcagctttatttttcttccaaaacaccataagtattacactatattatgcattgcatacttgccaaagcatttcagccagacttttttgttacataagcacaaaagcatccaacactaataaactcctatttttctttctacttttatgtaaattcaaagaaccaatgcatgtttcttatgcctttcgggtaagaattaaacaatcactaacacttaaaaagtattgttctaaacccaaattgtgagatatactcctcaactgactaaacttttttcttacaggtatagtttacttggtattacagaagttttgtaacaatttttcttggtaatacatctgaaatggttggctttatggatcctctgcaatgaccattggtttttctttttgcttgcttgttttcctaaatgcaggatatttgagtgagtgtcttgctttttattttgtttgcccagtgtatttatttccatgttgctgctgctgataaagatatacccaaaactgggcaatttacaaaagagaggtttaatggactcatagttccatgtggctggggaggcctcacaatcatggcagaccagagaagagaacttgtgcagggaaactcccctttataaaaccaacagatcttgtgagacttattcactatcacaagaacagcacaggaaagaagtacccccatgattcaattacgtcccaccaggtccctcctacaacgtgtgggaattgtgggagttaaaattcaaggtgagatttgggtggggacacagacaaaccatatcattcctcccctggcccctcccaaatctcacgtcctcacatttcaaaaccaatcatgccttcccaacagtcccccaaagtcttagctcatttcaacattaactcaaaagtccaagtccaaaatctcattggagacaaggcaagtcccttctgcctatgagccagtaaagtcaaaagcaagttagttacttgctagatgaaatgggggtacaggcattggataaatacatccattccaaatgggagaaattgaccaaaatgaaggggctgaaaaccccatgcaagtctgaaatccagcagggcagtcaaattttaaagctccaaaatgatttcctttgactccatgtctcacatctaggtcatgctgatgcaagaagtaggttcccatggtcttgggcagctctacccctgtggctttgcagggtacagtctccctcctggctgctttcatgggctggcattgagtgtctgtggcttttccaggtgcacaggacaagctgtccatggatccaccattctggggtctgaaggatagtggccctcttctcacagctccactaggtagggatacacacactccagtggggactgtgtataggggcaccccccaacatttcccttctgcactgccctagaataggttgttcatgagggcctgcccctgcagcaaacttcttctgcctggacatccaggcatttccacacattttctgaaatctagacggaagttcccaaacctcaattcttgacttctgtgcacctgcaggctcaacaccacatggaagctgccaaggcttggggcttgcaccctctgaagccatgacccgagctatgctttggccccttgtcgtcatggctggagtggctgggatgcagggcaccaagtccccaggctgcacacagcatgaggaccttagcctggcccaggaaaccattttttcctcctaggcctctgggcctgtgatgtgaggggctaccacaaaggtttctgacatgccctggagacattttccctattgtcttggcgattaacgttcaacttcttgttacttatgcaaatttctgcagccagcttgaatttctcctcagaaaatgggattttcttttctgtcacattgtcaggctttatattttccaaactttgtgctctgtttaccttttaaaactgaatgccttttacagcacccaagtcacctcttgaatgctttgctgcttagaaatttcttctgccagataccctaaatcatctctctcaaagttccacagatctctagggcaggggcaaaatgcccctaaaacataacaagagtcacctttgttgcagttcccaatgagttcctcatctccatctgaaaccacctcagcctggatacctttgtccgtaacattattagcattttggtcaaagccattcaacaagtctctagggagtttcaaacattcccacattttcctgtcttcttgtgagccctccacactgttccaacctctgcctgttacccagttccaaagtcacttccacattttctggtatcttttcagcagcatctcactctactggtaccaatttactgtattagtacattttcacactgctgataaagacatacccaaggctgggcaatttacaaaagaaagttttaattgactcacagttccacatggcttgggaggcctcacaatcatggcagaaggtgaatggcatgtctcacatggcagcagacaagagaagataacttgtgcaggggaactcctctttataaaaccatcagatcttgtgagacttgttcagtatcatgagaatagcatgagaaagacttgctcccatgattcaattagttcccactgggtccctcccacaacatgtggtaattgtgggagctacaattcaagatgagatttgggtgaggacacagccaaaccatatcacccagctacaagtttaaacctatgtgtttgaattttaaaagttgaaatgtatatacatatacatattgaaaataataattcaggaatttttctgaagcatctaaagaaagataatgaaagttttctatcaataaatgtagctttataagcagtggtccaaatcgtgcttaaagattctttacaaatttctctaaggtttatatagtttataagtccattgtatccacatctttataattaagcactaatttcttctttaagatttacatatcagtctgaaaattaggcttaccacaagaaaataaccaagggctaaggaactactaacagcaagagagttaacaatacagaagctacttagtgagagacaagaagacagtattaaggaaagaaaagccattcagaggaatgcatctgcagcacttcaagagttatttttcatttccccaaatctcaaaaacatttgcagtcttgcaaaaaaaatgtaatttctgtgaataaatatggcaattgaaatatgtaaagtgatctgactcaaagttttccatgaaatgatggaaacattctccaagattcttcagagccatattaagtgacagatgttcttttctgtgccctagtaagtagcagccatcaccatcatgaccattttgaaatatgacattttaaaagtgactactttgcagagtgtctaaagctaatggcaaggtcaatatgacaccaaaagaactagtgagaaatgaagaatttgtctaatctgctccttcctctgtaggacacaaacctccaatttgactggtatgttttctacttgcacacgatcagaaagagttgaggagccaacctgggagcccaagtggtcattatggaataataaggtctgagttttaatatttgggctgaccgtgcccatgcccatcgtatctcatataatcaccatgatgagactgaccaaaatttagggttggaattcttctggaaaaatcgcattgctgaaggtacctccttagttaactggctgtttttctatgttatgggtatacctacagattagctgggagtgtcctattgcctcacttcattgcaaaattcactatggcttccaagttttgtttcctcctcactggaggaaataggtgaaaacagtggagagtttaaagtctcacacacaccctagtgccaaatgatgggccggagtctaaataaacataagaaaataagtcagatactgttcctgcattattttaacttatattctagcatacaagactggatttaagcaagtaaatacataaacacatacttataagttagaacaagtgttttaaatgagaacaaggtgtcatgaggatagtattgagagattcactttaatttttttatttttattaatttttttttgagatagagtctcactctgtcacccaggctggagtgcagtggcgtgatctcggctcactgcaacctccacctcctgggttcaagtgattctcctgcctcagctttctaagtagctgggactacaggcacgtgccaccacacccagataatttttgtatttttggtagagatggggttttgccatgttggccaggctggtctagaactcctggcctcaagagacccaccccctcagcctcccaaagtgctgagattacaggcatgagccaccatgtctggccaagagactcattttaaattggatagtcaggaatggcatttctgaggaaaaaaggaaaactagaaaaatgagaaaaactaaaaaaaaaaaaagccagccataaaaacatgtcaggttaacaaaaggtctggaagcagaaacaagcttagcttatggaggaaacacaaggaaacatagtcgcaggagatggtgggcaaacggtcgggtagaataacatgaactaatgaggtgaatagggcaaatcatgacagaccttgaaggccacagtaaagaatttcttttttcctgcataaaactgcaaaccaaggaaagcatgggataggcaagatacaatttatattttttaagaaaatactctggctgttgagtggtatagagtggaggcagggagatggagtaaaagctggaagatatctgtgcatgtgaatgtgtgtgcacgcatatgtggatgtgacatgtattttctgtattcaggatgttaaaacactccccaagcccttaaaccaaatgtttttgtgtttgagcattataaatgtcaaataatcatgtcaaaaggtacttagaagagaggaaagtgggacaaaagaactttaggggttaggctccagggacttctccattcaccaagaactgtaatttcctcattaccagagtaagccgactttcacacattatgtgaacttgtctgtcatatccttaatatacttagatatccaattctatttttgtttttctgtttttttgagacggagttttgcccttgttgtccactctggagtgcaacggtgcaatctcggctcactgcaacctctgcctcctgagctcaagcaattctcctgcctcagcctcccaagtagctgggattacaggtgtgtgccaacatgcccagctaattttgtatttttagtagagatgaggtttcactgggttggtcaggctggtcttgaactcctgacctcaagtgatccacctgcctcagcctcccaaagtgttgggattacaggcatgagccaccacgtccagcctagatatccaattcttcatttcctctcaatatgttttccaaaggggaatgcacatggcatgtaggtcagtcatattttcctctatattggtttgtttcttgggtcaacgtttggcattcttgcttttcctgggtaaaacaggttgcatcaccatttcatccccttacttgctgccaggtaatcctgtcaataatatgtgtaggaatatttttggaaaggcagttgttcaaagtagagtttttatccctgttgtggcatccactgagagactttccagaacttcacattcttgggcagccagaactgctagaagtagtttataatttggaagttatctctagtgttgtttaaggctttagagtattaagaagaatactgacaaaagaaaaaatgtttcataatatctgactgtgtatgtaactgagtgtgtatgtatatatttataatgatatacagttgacccttgaacaacagcggtgggggaacgagggggaccaaccctctaagcagtcaaaaatccatatataactggtttttgtttttttaaggacagtgtcttgctctgtcgcccaggctggagtgcattggtgccatctcggctccctgcaacctcggttcccgggctcaagccatcctcccactttagcccctcaagtagctgggaccagacgtgtaccaacacacctggctaatttttgttttttgtagagagggggcttcaccatgttgcccaggctggtcttgaactcctgagctcaagtgatccttccaactcagcctcccaaagtgctgagattacaggaatgagccaccatgcctggccccacatataaattttgactcctcaaaaccttaactaccaatagcctactgttgactccttaccaataatgtaaatagtcaattaacacatattttgtctgttatatgtattataaactgtattcttacaataaagtaagctagagaaaagaaaacattaagaatataaggaggagaaaatatatttaccattcactaaatggaagtggatcatcataaaggtcttcatgctcttcatcttcatgttgagtaggctgaggaggaggaagaggaggggttggtcttattgtctccagagtggcaaagatggaagaaaacctacttataagtggactcaaacagttccaaccatgttggttaagggtcaactgtgtgtgtgtgtgtgtgtgtgtgtgtatttgtgtatgcatttatatatcattgtggggagggcagagtagaagttggagagtgtgtgtgtgtgcacatgtgtgtatgtatatatgtatgcattcacgaatggaaagaaaactagttactttgaaatctaaaaaaaaaaggaaacacccttttttttccccacatattcgttcattttcttagccccctggaagaacatattgttttcaaaatctacctgcaggaatccaaaagccaaattttgaagctgcaaaaagagaaactgaaaaatagaactccttctgtctctttgaaccatttccttgtatcttgagggtaactgatacacatttcacaacacgtgactttcaaagatgatgaatgacagggaggctcggtgtcagactccagattgtcttctggatctcttagatttgggaagagatgagaataagcaaaccttttaacataaaatcatcctatttaattagaagggtgtatggaatagtcttaaggtaaaaggaaacattttcaacttctaattcctttctggacatatccttttaggaggaagttctagtgatgagatcaaagtatcacttttcccccagaggacagtaatatcactttccctgtgaaaaactagtccagtccatttaaagacaggattttaggatatattattcatgactgtgcttttaaaaacctaagtgtgagttttataactctaaattcaaaattgtctctatggtttcatttttaggagttctgcacataagctgagcagatcctttgagtcaaagcctaaaatcttagacttagaggtcaggcatcttccatttgaaccctggcataggcacgtatttgctgtaggactggccagactgtcaaatctgtgtctcagtgtcctcagtctttaaatggggataaaaatagcaccagcctcagattgtagaaggattaatcaaattacctcatgcataacacttagcacaattccttctacattataatcacttaataataaatacgagtataataacaacgaaagtaacaaattatgttgaaataaattatttaactcagtacaggcagggcctaaaatgttgacgtgactttcaagtgtcttgagttcttaaggagaatgtaatcccactgcgatgggactgagccataaacaggcagagcttttgctactcctttagagcccacctcagtatcctacagcaatcgaagagacagtacaatacccacaaacagcaactgaaagcaatttaaatctctaatgaggtgtcctgaaaaattctagaggaacattctacttctgatgcagagaaatacttcctaaaatcttctttccctgagactcctataattgtctcaccagaaaaggagttgccttccctttgctcagtttgactcaagctcactcttagtgcagcccacattggcttctgtcctctttctctttgcacagaagcagctcttctgtttatttactgaccctctgccctttccagtccaaagcaatcaagtcacagtggactaatttgaagtctttttctccctttcatctattatgtaacatctacacaacaaaatttgagaaacatagaaatcagagcttgaacctggatgcctaaaccaacatccatctcagcaggtagagtagatggtgagattgtgatgaccatatgttttttcctgaagcatacgtactactatttaaagcatgggtcattttctcctaagacagaacttaacaaaacatgagcctttaaataaagtatcaatgtatgtataaatgaagtcatctcactagcatcattcagtttgaagaatacattcaatgatccagagccaatattaaatctataatatgaaatgggcagaaaaaaaataagactccaaattatcaccttcccagaaaccaacctctctctcaccaactgctcagaaaagaagaaagcaaatataaaagaaatatgaccattttgttattttgctcttacatggaattgaaattaagctatatggaaaattcactaaattctaccgatctatctttttaaaagggaaatgttaagcagttctgaaagagtgcacccagcttcctttccaaaggatactgctaatggagttgaacacacccttcctgtcaccccaggtgctaaatatgtggaagttgggaatatctaaatgcttggagatcctgaagatactccctgaggtggctataaaaagactacgcttggcttctgagaatgtagtggcagacactttcactttattttattttactttattttatcatgggaggaagttttattgagtcaccatccccctacacctcaacttctcttttttaaaaatatgtgtaagttttttctacttctgtctctcaggaacaggtttttggtggttcagaaatttctcccacttttacctgactgtgggcaacctcagcaacagaggctcctggaaatatcctccacctatttttctcagatgtgagaacggttgactggagttatgagggggaagtggctggtgcagaaagttgccaaaagggtgatggaaagttctttactgatgaaaaaagaaaagaataataattcatatttatcttttgaccaagacaagataggaacagaggtgcctttgcttgctttcacctcaagcaggaagtgagagtcctattagcctctgggttctgggaagtcaacgatttggggttatttttcttcccgcccatttctttaccttactcataggtttaatattgacctctgtctttatcactgaatctgtttttcaaattgagcaattctcaatttgtcagatgatttattttttacatatacatgaatgttttgttgaaacaagactttcagcggtatcagtcatgggggagcttagctgtgaacccggaggtgagagtaaagtcttagaacaaagaggaattcgaaattacggaacatttttaacttctttactcagtggtaaagaatggaacatcttttacgtcaaactactgaagttgtgggcaaaattacaagcgatgattatgcaggataggttagtttttggccattttaggcttttcttgattttatggagtagtctgaaaggagtgagctggtgagagaatttactaggtgctgaagcaatgagaactgacagctgatatacaggggaagagctccgtttcagtcacattgaatttgaggtgcctttaagaggaggtaatcaggaagaatttgcaacagttctttaaaccccggtggatatcagagctaatcatgtatccgtgggagttgtcagggtaaatctgatgactgatgccaagaacctcacataaggaggtcaggtggcatgagaagagatgatgagtgagaacacaagctgagaaagaacagtatttagaggatggactgaaggacaagtgggggagtttgaaaatgcggagctgtagaggtaaaggacactgagtatatctgctctggtcctttggggactttccacagcactagcttcaccttggttgcttgccaactgctgagacagtaagtccagattttagtatttgacccacgctgccttctccagatcatgctccttgatattacctctgaatttgctgaaagaaaaacatttccactcaaatatcacttgaacatgatttatgagtaaaatgaataatattttactataaaacatacagaggtgagtctcataacgatattcagggtggccccaagctatcttctttttttttatttttaaagttttcaaaatattttcaggccaagtgtggtggctcatgcctgtaatcccaacactttgggagactgaggcaagaagatcacttcaactcaggaatttgagaccagtctgggcaacatagcgagacttcatctccacttaaaaaaaaaaaaaaaaaaaaaaaactcaaatgtggtggcgcacgcctttggtcccagctacttgggagcgctgaggtgggaaatctcttgagcctgggaaataacggctacagtgagctttgatcgtgccattgcactctagcctgggtggcacagtgagaccctgtttcaaaaaaagtgaatatatttaaggtatacagcaggatgttttaatatagagagttaaatgactgctatcgttagctaattaacatacccatcttctcaggtagttaccttgtgtatgtgtgtggtgagaatacttgagatatactctcctatcaaatttcatgtatataatatagtattactaactatggtcactatgctatacattagatctctagaatgtattcaccctacatacctaaaattttatacactttgaccagcaccttccctttcttctctcccagccccttcccctaataaccaccattctactctctgctactgtgaattcagctgtttgagattccacatctaagctatcttctttattagccattgctaaagagtcactgataagcctgcttcctgtctgttgggtgcaactaaaaagcagacccttgatctggcattctggtggtgaagtgacttatagctctagaacctcccaacccaagccatcctacggcagctgttctgaagttgacttttatagcttctacagaactgtaagcttgccgttgaaagtggcacctagccatttattcgccagtaattataagcaaatgaatcaaatttgaagcaggagtgtaataaaatcagtaatggataggattttaagcaacaggcaaacttctaagaggggctggcacccctttttaaaaatagattaatgtcatctgcaaacagagacaatttgacttcctctcttcctacttgaataccctttatttctttcccttggctgattgccccggccagaacttccaatactatgttgactaggagtggtgagagagggcatccttttcttgtgccagttttcaaagggaatgcttccagtttttgcccattcagtatgatactggctgcgggtttgtcataaacagctcttattttgagatatgttctatcaatacctagtttattgagagtttttaccatgaaggggtgttgaattttattgaaggccttttctgcatctattgggataatcatgtggcttttgtcattggttctgtttatgtgatggattacgtttattgatgtgcatatgttgagccagccttgcatcccagggatgaagctgacttgattgtggtggatacgctttttggtgtgctgctggattcatgtcctttgcaaggacacggatgaagctggaaaccatcgttctcagcaaactaaaacaagaacagaaaactaaacaccgcatgttctcacttataagtgggagctgaacaatgagaatacatggacacagggaggggaacatcacacaccggggcctgtcgggggctgggggctaggggagggatagcattagagaaatacctaatgtagatgacataggtattagggtagatgggtgcagcaaatcaccatggcacgtgtatacctatgtatacctatgtaacctgcacattctgcacatgtaccccagaacttaaagtataatttaaaaaaaggtagtaagatgatagatttaaacccaaatatatttgtaattacatgaaatgtcagcaaagtaagtactctaattaaaagctaaagatcgccagattggaaaaaaaaaaaatatgctactttcaagagattttccttatatagaagaatatagaaaagtaaaagaatggaaaatgtataacatgcaaccaatatgaaacaaaatagaatttaaggcaaggaatattattcaagataaaaagggaaggctgggtgaagtggctcacacctatagtcacagcactttgggaggccaaggcagaaggattgcttgagtccaggagtttgaggcaagcctgggcaacacagtgggaccccatatctaaaaataaaaaataaaaataaattttaatgaaaaaatagattaatggcagagcagacttgagagacaaatggttcttgcaataagcgacagcggtattaagatgtatgttcaggatctcattggatagaggattaggaaaatttctttgttttaatgtttcttagtagacctttttagaaagaagggcagtgtgaaaataatatcctaagagctcataacggcaaatgccaaggtttgtgtggtgtgtgtgtgcgcgcacgtgtgtgtgtgtatgcatgcctgtgtaatattatgagataatacaagggagaagggtgattcatggaaagagtggacgaaggtttcgaaagctaccgagtgagaaaaggtctgatgagtatttatttaggaattatgatgtcactggtgaccttagcaggaatagaatctgtaaaatgctaggggcaaaacggggttacaggaaggtgaagagtagacagagacttccttttccaacagtattggcagagtaaatatcctgaaaatctatcctgctacaaagcacctaaaagtagtagatacaaaatgaaaaacacatttaaatgcatgcctgtgttggaaagagtaagggaaaccattggagttatcagaggctaaatgttctgggaaggaccaattcagagaattgtaagcagtgaaatcatctatgaattccaggggcctggggcttcagttgtgacacagatcaactcaggtcggcacaatgggagagttagattcaaattctggaacccataatgaattacatcttcagtgaaactgcaaattaggaaaaaaataaaaattaaaaacaacctgccctgaatgaagaaacaaataaaactggtgaattttttgagcatcttgtgagaatttataagtcggagctagtcctcaaatggccctaggttagggtctgtgatggttaattttgtgtgttaatttgactggattgagggatacttagatagctggtaaagcattatttctgggtgcatctgtgagggttttctggaagaaatcggcatttgaatcagtggactgagtaaggaaaatctgccttcagtgtggatgggcaccatcccatcagctgaggactagaatagaatgaaaatgcaaaggaaaagcaaatttgttctcctccttcaagctgagatacccttcttctcctgctcttggacattagaactccaggttctccagccattggactcaggcacttgcaccagcagttcctgggttctcaggcttttgaccttgtgctgagagtcataccatcagcttttccggttctccgtcttgcagatgaccttctcagatttcataattgtgtaagccaattctcctaataaatctctcttatatatctatccatccatccacccatccatcctattaatctctgtacaattctgactaatacaggattccctatctcaccgactgcattgtctgaaaaagactcctgccaccctagatttgaagcttccttaactgcctgacagaagcaaataattttctctagatgaatcaactgtcaacctcaaagaacttccatttataaagtcccaacattatcccagaatctaaaattacaaaatgaaagaagaaataggagtcaatttcagtagaaacaataaacaagagaatcagccctagataatgaactagttacatttatactacaaaactggtatttaaagttaaagaaaaagaataaagttggaaaagaaagtcacatacatgaatgaggaagaagtgactataaagatgactaggcagttctaataaaaactaaaaataggacattcagaaatgaaaattacagtacttaaaattaaaaattcaataggtatactgcttagcctattagacatgactgaagatagaatgacaaacctagactataaagctgaagtagttggctctaacagaacacagagaaacagagggagtataaaagcagtagagagacataaaaaatatttgtaagatacaacatatatccaaatcagaattccacaaagaaatatcagagaaatgaaagagagataatttcagagggaaaatgtctgagcaattccagaattccagatgacatgaatcttcagatttagaaagcaaaacaaatcccagtcttcactgaactgtagaacaccagtgaaaaagaacttttaaaaatccagagagaaaaacattgcctccaaagaaatatttacagtgatagctgaattctaaacaacaacaatggaaaccagtaaactgtgagatcatattaaatccatgaaaaaatgcttatagctacatatctagaattgtaaaattgtatgtcatttttagattaaaaaagatcaagagagtcctcacaaacatcttttccctacaggagcttctaaaatatatatttcagaaataaggaaaatgctttcagaaaaactgagttcaagaagaaagggtgagcgaaaataaagtggtaaatgtgagtaaatctaaacaaatgttaaatataatactcaataataatgtctaattttagagtatattaattttttattgctgtgtaacaaagtaccacaaatttagtggcttaaaacaatacaaatttattgaccttaagtttccatgtgtcatgagtctgggcacagtttaattgggttccctgatctggtctcacagcctgtgttctcacctggatggccactgaggaagaatccacttccaagctcattcaggttgttagcagaattaatttcctttaagctctacactgagggcccagactttttgctagctgtcagctgcaggcaggccaccccatcccatagaccttctcacagtatgacagctattttcttcaagccaccaaaaggatttctctccaggatgtatatgataagtaattattaaagtggcatcctatcacttctatcatataaaataacttaagggagtgatgtcccattgtctttgccgtatttcattggttagaagcagggcacaggttctgtccgcacttaagcagagaaaattgtgcaagggcgtgactcataggaggtcactttagggcgtgctcaccgcagagaaattggagaaacaaaaacaagactaagtcagaaaggtcatgctcagagttaaagcatgctaaagtccttgtaggaagtgcaaatagacacagattaattataaactgtattaagctggaaaggaaagtacaaaataagatggtaggaattaatcaaaatacatcagcaatcttaaagacacaaaacatttttaaataaaagggtaaaaaaatatattgtggctatattattatcagataaaatagaccttcaagtaaaaaagcataattcgagttagaggatgactacataatgacagagtaactctctaaattaccatctaccaaatttcacaattcaaaattgtatatagtaaatattagcagagattcctgaatcatcgtgtgtgcttttgagacacagtgcttggcaattcagaagttaaatagacaaaatcaaaaacgtatcttctcacaaaaaaacagtaatacataaaaaatgttaagaccacaacatacttgaactaattgctgtacgtagaataaagcatgaaacaattagagacaacagaattaagcacatgtgacactgaccatataagtatataagagccacataataaactataaaactagtgttaaccaatatgaaagaaatatttcataatatgtgggccacgttctctaatcacaataaagtttaaaaccagtgatgaaaacattatgaaaaagctcatatatttagaaatttaaaaacaaacttctaaataatacatcaaaatagcattcaaatggatattagaaaacgttagaactaaacaattatgaaaaattctatatatcaaaacatggaatacagataaaatagtgcagagagaagtttatagactttcagaagggatgaaaattaataaagtaatcatcaatgatttagaataatattgaaaaaataaatccagaaagcagaaaaagaagataacaaaaataaaagcaaaaattaacaaaacataagaatatggaaaattaatgaaactacctctgttctttgaagcagttaaaatctagatgtctctgacaaattaagaaaaaagggatagatacaatatcggcaaatcacaagaaaacaacttcagaaggactagaatgatagcagaatgttatagacaacttttaattataatgacaacttggataaaatgggcacatttctagaaagttatattttgcaaaaattgacttatgaaagaattagaaaacctgtgcagtcctgaatcattgaaattagttaaacattgaagttaaactatcttttcacataaaactgaagtccacagttttataataaattctgctaaatatatttaatgagcaaatattccaatttaacataaactcttccagaaaataaaaaaaaaaaagacacgttcctctttaagttgtttaatgaggccatgattgttatcttgattccaaaatccaatacaaaatattagcaatctaaatgtagcaatgcattaaacacacacacaaattactaaattgactttatccaaaaaataaaaggctaattagcatcaaaactattaacataaattaacaaaataatgacaacttataaaatcatctctttttgcagatgaaagtcaatattcattcacattagaaactctcagtgaacgtggaatagaaggaaattctcataactggcaaaagagtaaatacaaaattctcaaaggagatatcatattcattggagaggtggtaaaatcattttctttaaaggaaggaacaaaagaaggatgcccactattaccatgcatattcaacattgaactaaggatggcagaaaccacataaaaaaagaaagaataagaaaagaataaacaaaattctcattattcgtagaagatattattgtttacatagaaaaaccaaagaaggctacagacagattactcaaatgtataaaagagcttagctaagtgactaagtgatgatataagatcaatacacaaaagttaacaaacagaaaatgtcatttgtagaaccaaacatagataattagggattaatttaacaagagatgatcaatcatttcatggagaaatttttacattttgaaatatattttaaaagatctaaattgagagatacacaatgtaatattttaaatatgccaattatccccaaattaatatatagggtcaatgaaatttcttccagaaacctaaactgaattttccttgaaatttgagagtgatttaaagatttgggtagaagtggtaatgagtcaagacataaaaaatgaagtgtaacaacttaccctagcagatatcatggcttctttagtgcagaaatacacaaatagaccagtagaagtgaagagagagcccagaaatagacaatgcttatggagaaacaatatatgacagatgcagtattgcatctcatacaaaaatctgttctaaatgaattaaacaattcaatgtaaaagtcaaatttcaaaaagtttagatggcaaagtaggaaaatatctttatgactatcaagtaggaaaggatttaacaagcaaaaaaagaaaaaaaaatgagttgatgaatttgactccattaatattaagaacttctagtcaaaacacactaaaaattgagggggtagggagggagagcattaggacaaatatctaatgcatgcagggcttaaaacctagatgatgggttgatgagtgcaataaaccaccatggcacgtgtatacctatgtaacaaacctgcatgttctgcacatgtatcccagaaattaaaataatttttttaaatgagggggtaaatacacgccacaagtgaaaagatgtacttacaatctgtatcactgaaaaaatttactattcagaacttgtcaataactcctactaaacaatttttaaacagaaaatggcacaaatatgaatggaagagaaaatacaagtggccaattaaaatgtgaaaacacagttaacctcatcacgaaacagggaaactaaaattaaaaatataaccaagaataactttatatctctcagttttgcaattttttcagagggaaaaataccatgtgttgaaagtgtaaaacagtgggatcatttatactttaatggtggggatatagatttgtataatagtttttgaaaagaatttgacacgatgcagtaaatatggagatgcccatcctgttggaactatgaatttcacccctagcctagaaaaacgttcacacatggcataaagagacacagacaagaatgtttgcagcgtattgtttgtaaagattaaaccatattaaactgctgtgaaactacaaaaactgcagtttcatgtggttcaatgtaataatagcaactgagaacaacaaagttcatttataatctattcagataatataagtcataagccacagctgctctgtttatcattagaaagctcacagagctattgtgagcaaaagcaacaaacaaaacaagccacagaaacaaactaacaagatgatagaatttacagaaaatcaaaacatgcaaaactgaaccgtatattgtttagttatgtataaattataaagaaacaagagaaaagcaaaaatttgattgcccttatgtgaaggaggagttgggaagaggaatacaaatttattttaaaggcattgctaatcttaagctaagcagcacatatattttaaatatcatttatatcttatatacacatattttatgtggattatctattttaaaatcaataattgattaaatatagaagaaggtgaggaagtggaggctaacagtgcatgctactttctttgtggacactttgtatgaaaggaagagaccagagagaagtagctggagtagaaaacagaatcggaaaaggtctctgttttctgtctgagaggagtttgaatgtgttaacacactgaaaaggtgaggctgaccgcagaggagaagagggtccttgatgggtcaggtgactcagtatatacaagtgtgatggttaattttaggtgtcaacttgatcgagttaggggaggcccagatagccggtaaaatactatttttgggtgtatctgtgatggcctttccagaagagattagcattgaaatcagtggagtgagtaaagaagacccaccctcactcaacatgggcggtcataatccaatccaatgagggcctgaagagaacagaaaggcagaggaggggcaaatttgctccctctgcttgaacccggcacccaccttgtcccacccttgggcactggtgggagctcctggctcttggaccttcagactgcaggacttacaccagcatccctgcccccactcagttttcaggcctttgactttggcctgggagttacactatgggctctcctagttctctggccttgaactcagactgaatgataccattagctacactgtgggacttctcagcctctaaaatcttgtgagctaataaattcccataataaatctcctctcctctctctcaataggagaatatacatatttaattcataaggaaacatatatatatgtttccttgtgaattaaaatttcaatcatctgttgaaactaatcagtaacaaagcaagtcaggacagttgagagtggtagaagtttcaagtaattacagtgaggctggagaagagaacgattacagagcagcaataagggtttggatcgagttggagaccatgggtatgccatcacacccatttgttccttcttgccaggtatgccaagcttctcaggtgtaagagtataggaaaggtctggattgagctaagctttgcatttttctcggcgggtgctacaacaggtgcacccaggctcaagtaaatggattcacaagccatgcggtttaggcattctcaggtcaaggaaagaagacaagaatgggcagaaggacagaatgtaaacagtaaaaatgttggtggccttgatgtggtcaaataactggagtgctggaaataagacagtgggagaaatgtggggaggataaggaaggcactaccaaaagtttaagaatccaggaaagaaaactaaggcactgataaagtccagggtgaggccctgatgcatatggtgagagagacctggtgtgctggtgctggaagtgaagcgatcagggaactgtgaagcaagtttgttggatgtctgcattgatattgaaattggcctggaaaatggtggtgagaaagaaaatgatctgagggctaaggttcttgataaatgtggagtgactggggtgttggtgaacaacagcaagggaggatggtggaaggtggtaaccagatggcaagagccccaaaagaagagaagcttttgtcaggcctctgagcccaagctaagccatcgtatcccctgtgacctgcacatatacatccagatgacctgaagcaagtgaagaatcacaaaagaagtgaaaatggccggttcctgccttaactcatgacattccaccattgtgatttgttcctgccacaccgtaactgagccattaaccttgggaaattccttctcccggctcagaagctcccccactgagcaccttgtcacccccacccctgcccaccagagaacaaccccctttgactgtgattttccaccacctacccaaatcctataaaacagccccacccctatctccgtttgctgactctcttttcagactcagcctgcctgcacccaggtgaaataaacagccttgttgctcacacaaagtctgtttggtggtctcttcacatggacgcacgtgacatttgggcaggggacctcccttgagagatcgatcccctgtcctcccactctttgctccatgagaaagatccacctacaaccttgggtcctcagaccaaccagcccaagaaacatctcaccaatgttaaatcgggtaagcggcctctttttactctcttctccagcctctctcactatccctcaaacctctttctactttcaatcttggcaccatccttcaatctctctcttctcttaatttcaattcctttccttttctggtagagacagaggagacacgttttatccgtgaacccaaaactctggcgccagtcacggactcaggaaaacagtcttcccttggagtttaatcactgcgggaacacctgcttgattactcacccatgtttcagaggtgtctgatcaccatggggaagcctgccttgatccttcacctttagtggcaagcaccactttcctgggggtcaatcaccccctaccccttctctccgtgtctctatcctctcttttctctgggcttgcctccttccctataggaaaacttccaccctccattcctcctccttctcccttagcctgtgttctcgagaacttaaaacctcttcaactcacatctgacctaaaacctaaaccccttattttcttctgcaataccacttaaccccaatacaaactccacaatggttccaaatagccagaaaatggcactttcgatttttccatcctacaagatctatataattctttttgtaaaatgggcaaatgcctgacgtccaggcattcttttacacgtgggtccctccctagtctctatttccaatgtgacttgtctcaaatcctccttctttccctcctgcctgtcccctcagtcccaaccccaagcgtcactgagtcttttcaatcttccttttctactgacccatctgacctctcccctcctccccagactgttcctcctcaggtcactccctgccaggccgaatcaggctccaattcctcctcagcctctgctccccaaccctataatccttctatcacctcccctcctcacacccagtccagcttacgtcttatagtttcattccgcgactagctttccccaacctgcccaacaatttcctcttaaaaaggtggctggagctaaaggcatagtcaaggttaatgcccctttttatttatccaacctctcccaaatcagttagcatttaggctctttttcatcaaatataaaaacccagcccagttcatggcttgtttggcagcaaccccgagacgctttacagccctagatcctgaagggtcagaaagctgtcttattctcaatatgcattttattacctaatcttctcctgacattaaataaagctccaaaaattagattttggccctcaaaccccacaacaggacttaattaacctcgccttcaaggtgtacaataatagagtagagacagccaagtagcaacatatttctgagactgcaattccttgcctccactgtgagagaaaccccagccacatctccagcacacaagaattttaaaatgcctaagccacacatgcctaagccacaatggtcaagcattcctacaggacctcctccattaggaccttgcttcaagtgccagaaatctggccactgggccaaggaatgtctgcagcccgggattcctcctgtgccatgtcccacccatgcagagacccactggaaatcagactgtccagcttgcctagcagccactcctagagcccctaaagctccagcccaaggttctctaactgactccttcccacatcttctcagcttagcggctgatgactgaccctgcctgatctccttggaagcctcctggaccataacagatgctttgggtaaatcttaacagtggagggtaagtccacccccttcttgatcagtatggaggctacccactctacattgcattcttttcaagggcctatttcccttgcctccataactgttgtgggtattgatggccaggcttcaaaaccccttaaaactcccccactctggtgccaacttggacaacattcttttatgcactcctttttagttatccccaccttcccagctcccttattaggtcaagacattttaactaaattatctacttccctgactatgcctaggctacagcctcatctcattgctgcccttttccccagttcaaagcctcctttgcatcctccccttgtatctccccaccttaatccacaagtataagacactctactccctccttggtgaccaatcatgcaccccttagtatcccattaaaaccaaatcacccttaccccactcaatgccaacatcccatcccacagcacgctttaaaaggattaaagcccattaccacttgcctgttacaacatggctttttaaagcctataaactctccttacaatacccaattttacctgtccaaaaaccggacaagccttacaagttagttcgggatctgcaccttatcaaccaaattgtcttgcctatccaccctgtggtgccaaacccatatactctcctatcctcaatacctccctctacaacccctctataacccattattctgttctggatctcaaacatgctttctttactattcctttgcacccttcatcccagcctctctctgctttcacttggactgaccctgacacccatcaggctcagcaaattacctgggctgtactgccgcaaggcttcacagacagcccccattatttcagtcaaacccaaatttcttcctcatctgttacctatcttggcataattcttcatgaaaacacacgttctctccctgctgattgtgtccggctaatctcccaaaccccaaccctttctacagaacaacaactcctttccttcctaggcatggttaggtacttctgcctttagatacctagttttaccatcctgactaaaccattatataaactcacaaaaaaaaaaaaaaaaaaaaaaaaaaaaaaaaactagctaaccccatagatcctaaatcctttccccactcccctttccattccttaaaaacagccctagaagctgctcccatgctagttctcactaactcatcccaaccctttttattacacatagccagcgtacagggctgtgtggtcaaaattcttacacaagagcccgggactgcgccctgtagcctttctgtccaaacaacttgaccttactgttttaggctggccatcgtgtctctgtgtggcggctgccactgccctaatacttttagaggccctcaaaatcacaaactatgctcaactcactctctacagttctcataacttccaaaatctattttcttcctcacacctgatgcatatattttctgctccctggctccttcagctatactcactctttgttgagtctcccacaattaccattgttcctggcctggacttcaatctggcctcccacattattcctgataccacacctgacccccatgaatgtatctctctgatccacctgacattcactccatttccccatatttccttctttcctgttcctcaccctgatcacatttggtttattgacggcagttccaccaggcctaatcaccactcaccagcaaaggcaggctatgctatagtatcttccacatctatcattgacgctaccactctgtccccctccactacctctcagcaagccaaactcattgccttaactcaagccctcactcttgcaaaaggactacacatcaatacttatactgactctaaatgtgccttccatatcctgcaccaccatgctgctatataggctgatggggtttcctcactaagcaagggtccttcatcattaacatctctttgataaaaactcttctcaaggtcgctttacttccaaaggaggctggagtcattcactgcaagggccatcaaaaggcatcagatcccatcactcggggcaaagcttatgcagataaggtagctaaaaaagcagctagtgttccaacttctgtccacggccagttttcctccttctcgtgggtcactcccacctactcccccagtgaagcttccacttgtcaatctcctcccacacaaggcaaatagttcttggaccaaggaaaatatctctttccatcctcacaggcccattctattctgtcgtcatttcataacctcttccatgtaagttacaagccactagcccacctcttaaaacctctcttttcctttccatcgtaaacatctatcctcaaggaaatcacttctcagtgttccatctgctattctactactcctcaggaatttctcagggcccctcccttccctacacatcaagctcagggttttgcccctgcccaggactgacaaattgactttactcacatgccccgagtcaggaaactaaaatacctcttggtctgggtagacactttcactggatgggtagaggcctttcccacagggtctgagaagtccactgcaatcatttcttcccttctgtcagacataattccttggtttggccttcccacgtctatacagtccaataacagaccagcttttattagtcaaatcacccaagcagtttctcaggctcttggtattcagtggaaccgtcataacccttaccgttctcaatcttcaggaaaggtaaaatggactattggtcttttaaaaacacacctcaccaagctcagcctccaacttaaaaaggactggacaatacttttaccacttgcccttctcagaattcaggcctgtcctcaggatgctacagggtacagcccatttgagctcctgtatggacgttccattttattaggccccagtatcattccagacaccagcccaacttgaactgcaccccaaaaacttgtcatccctactatcttctctctagtcatactcctattcaccattctcgactactcgtaaataccctgcccttgtttacactgccggtttacacttttcctccaaaccatcataactgatatctcctagttttacctcaaaccactacccttaagtctgtcttaaagtggataatctttgttgacagggtacactccaatactttcaccctgatgaagtcctattctttacttgtatactcactcttattcctgttcccattcttatgccatcctctgcctctccccagctatctccaccacactatcaatcacactcactctctcctagccatttctaatccttctttaacaattgctggctttgcagttgctggctttgcatttccctttcctccaaaatcgcggaggccttgacttactgccaaataaaaataaaaaataaaaaaataaaaaactccatgtatttttaaataaagagtgttgcttttacctaaatcaatctggccttgtatatgacaagataaaaaaactcaaggatagagccccaaaacttgccaaccaagcaagtaattatgctgaacccccatggacactctctaattggatgtcttgggtcctcccaattcttagtcctttaatacctgttttcctccttctcttattcggaccttgtgtcttccgtttagtttctcaattcatacaaaaccgcatccaggccatcaccaatcattccatatgacaaatgttccttccaacaaccccacaatatcacaccttaccacaaaatcttccttcagcttaatctcccccagtgtaggttcccacaccgcccctaatctggcttaaagcagccctgagaaacactgtccattatctctccataccacccccctaaaatttttgctgccccaacacttcaatactatttcatgttacttttcttattaacataagaagacaggaatgtcaggcctctgagcccaagctaagccatcgtatcccttgtgacctgcacatatacatccagatggcctgaagcaagtgaagaatcaggaaagaagagaaaatggccagttcctgccttaactgatgacattccaccattgtgatttgttcctgccacaacttaactgagccattaaccttgggaaattccttcttctggctcagaagctcccacactgagcaccttgtgacccccgcccctgcccgccagagaacaacccgctttgtaattttccaccacctacccaaatcctataaaatggccccacccctatctccctttgctgactttctttttggactcagcccacctgcacccaggtgaaataaacagctttgttgctcacacaaagcctgtttggtggtctcttcacacagagggcatgacagcttttatctgaggaatgaaaattcctcatgtgggagtcatgctgtgaagctagtttatagggtacacgtagtgtgggagaataacctgacttcccttgaggataaaaagagcgttaggttctagcttcgatgccataatgttttaaaatagctcaagccccttgtcttcactcttatttttaatcttcaaactttttctagctatgagttctactgatttcttttcacttgctaacctcacagcacctaatcaccatgcatagtaaaacttggaaatatgtctaagacactggattgcactctgctgaagacaaaaaaaatctaatatttgcatttatgtccacagtacctagcgtagtgcccagaaaataaaaggtgctctatatgtttattgaatgaatgaatagagcaatattaacaaatggaaaggattgtgaaagcaatgaatgaatactaatacaaatctgggtttgtatttgtggaggagcatgtgtgtgcttcttgcatgaagtcattagagaagcaattaagataccctcgaggacagttataaagtctgatcgctggagagagttttgggcaaggaatatcattttaatccaaaatataggaaaagtcactagaaaaataacaaagcattatggaaaataccatcacaatcacttagtgaatagccatgaagagaaaaatgtcaatacagtccccactggtacattctgaaactaagatccatctaaatacctactaatgaagtttttttaattgaaaacatattttcataatttaagtactatagagtacacattcaacaaagaaagcctgtttcatagtgttggaaataagagtcctgtgaaatcaagtttattgttagaagtgggttttaagaaacctgaaaagattggtaatactaaaagaaatatggaacagatgttgtctcaagcagagtcctggacaaataatatcaaaatattgatatgaagttaatgacaaagggtgatagcattggtatgtttttttgtttttgttttttctttttgcaaaatgtgtacatgctctaatcagcagtgtacaacttctttttaatctgagaaatagctaaacaattttagtattaggtatgctttgaatttagattttaataggtcatatatttatagaaaccactagatgaggtttcagaagtgtaaatcttgctctttgctcaatggaagtgtttctcattaaacagtctgttctggtcctcgtaaataagtccgcctagaagttatgcctaaagagataataaacatcaatctaatagtgtatgtgatgcgtgagtaagtttgtaaactgtagggtactcagtgatgtaacaacattggtgtgccggatatcctgaaaagatttaaagatatataaacagtaaatagaatacacactttcctctactacttaggagatacatggaattctagaaataaacaaatcctgatattttgcctcaatgtgttagctttatttaaaatgaaaaacaaaaggaatttaagggagattaaccactgactgatgacagaatttggacaaagggtcagatctcctgtgctctgggcctccccttctcttttgccttgtatttgaaaactgtatttatgttactaacacttggtatctacaaaaaatgccttgacttttacatatgagcaaaacaaattaaaaattttaagtttaaattttatttaaactttatttatttaaactttaaaaattaagtttaaattttattatagaggtgtggactttaatacatctaacaaagaatgaatgaaataaagtttcaggtggaaaagtaattactccattagagtgacaggatgcagaatcaggaatcatattagcctagacttaaaactatatgtagaatttattcataaatattttccaataaactgtataactgatcttccccttttccaaaaaaccccacaagattttcataataaagaggttagtttgtgcagtgatgttccaatattataacttgtttaaggggctggattccactgaacatgctttcaattcttttaggtatatacccagaaatggaagtgctggatcatataataattctatttttaattttttgaggaactgccatactgttttccacaattccacattctggattccaaaatgttaagttcaaagttatacagaaccagaactgactaacccgaactgagaggctctttgggttgaatagggctggttatttacagaaggcatggctgaagcagatctattgttctgactggcccttacagccacataaattctgaaattctttctttccttcctgcccaaattaaagatttggaagtagagttgaaagcaaaacttcagaatgtcaaacccacaaaaatgttatggttttggggtatttaatcttcttagactattaaaaagatctgagtgggtatttgtttttatttgggactaacgtcagcttccaaaccagaaaaatgcatcaagaagtttcacagctgcttcaaataaattttggcttaaagaacaaaagttttaaatcaggtattaaaaaaaagtgataaagcattatatacaattatttcctaccacagaaattttggaaagctgcataaagaatccaattttgatccttaaaaattatttttatcaattcctgtctttcaagaaagatgataaaatgtagtcacttcctgcacaatcttggctcactgcaacttccacctcccaggttcaagcgattttcctgcctcagcctcccgagtagctgcgatttatgggcgtgtgccaccaaacttggcttttttttgtatttttattagagacagggtttcaccatgttggccaggctgttctcgaactccggatctcaggtgatctgcctgcctcagcctcccaaagtgccgggattacaggcgtgaatcaccacgcttggccaaatttagtcacttgtttcagctgagagaaacttccagtctaatctttcttctgcctccacctccctccccagttcacccttctgtgcatgcatagctatatgctctcttctcttcctcctactttaaaataattccaaagaatttggcttcaagaaaattatgtcccggctagtctccagtaagagtcacagaatcatttattatgcactagatgccctaattatagaacaaatgattttacagtttaagtgtataaaatagagatatatcttgatgttagaaccattttgtatactgttttacatcaattggctcaccaaacctcctgtaaatatagacaaaaatgaagagcaaacttcattgggatgttaaaatttttgaaatgagaattctttgttttatctcgagagtacagggtcacacacatagttaataaacaataaataaggaaggaatgaaaccccccgtactgatgatggatatgtgacatcttcacatgacttactcgtgaggattagctacaaacactgggtcttcccttttttaatttccttacagattgtggaccacacaaatgaaagaggttggcaactgctaagtttgctattctgtaattaggttattaatcctaaagttttttctctatgaggaaaattaaaggctgactgtttttttttgtttttaaaaatataactaagttctagccaggcatggtggctcacatctataatctcagcactatgggaggccgaggcagaaggattgcttgagttcaggggtttaagaccagcctgggtaacatagcaagacctcatctctattaaaaaagaaatacacacacagttctatatttactctccacctctcaacagggtatgttttacagttagtatcacatttggccaccctgtcaatgctgttgctattcactcaggagaaagtatatgcctacgtcaatttttcctggggctgatacatttctgttatttttccttccactgaaaaaagccattattagtgttacttctttgcccactgaatatggcagacacttggactggttgatcaacctgtatttccaaatccattcctcccccgtctgcctctaccacagtgtaataaaactcacttttccagactatctttaagctttgagcgattatgtgacacagtcctggctagtgagatgcaaagctgactggcagctgctaatgctttctgttccctctcctcctccttcctgcctagctcatggatggtgaagcagccatcttgcaaatacggagattaaaactacatgctaaggatggcagcatagaaagatgtaacaagcctaagatattagccacattgtagaatcactgcaccagaatggaggacctatctgaactttttccaatttttaaaatagtggtaatatacacataacataaaatttaccattttgaccattttaagtgtacatggtattaactacattcatattgttgtacaaccatcaccaccatccatcacatctctataagtctcttcatcttgtaatactgaacctctgtacccattgaacaacaactctgcattcccctttcctccagcccctgggaaccaccattctactttctgtctctgatttctgactgctctaactacctcagctaaatggagtcatacagtatttacctttttgtgattagcctattcatttagcataatgtctccaaggttcatccatgttgttgcatatgtcagaatttttttctttttatggctagatgatatcccgttgtatttatgtgccacattttgtatatttattcacctactcatggacacttggattgcttccacatttcagctgttgtgaataatgctgctatgaatatagatatacaaatatctctttgagagcatgctttctattcttttaggtatatacccagaaatggaagtactggatcatataataattctatttttaattttttgaggaactgccatattgttttccacaatagcggtatcattttatattcctaccaatactaacaagggtttcagtttatctacatcctagccaatatttgttactttctgcttgtttggtgtttttaaagtaaatcttagttattctaatgcatgtgaggtatctcattgtggttttgacttgcatttccctagttattggtgatagtcagcatcttttcatgtgcttactggccatttgtcttgtattttgacaaatgtctgttgaggtctttgctcatttttgaattgggttgttttttgttgttgagtttaggagttacggatattaataccttatcagatatgtgatttgcaaacaaacattttccagcattctatatgccatggtctaaatgtgtcctccccaaaattcatttgttgaaacttaatagccaatgtgatagtattaagaggtgggccttttgaacagtgattaagtcatgaggactcttcccttgtggatgagattaagtcctttatgaaaatgctggagggagcaatcccattactaggtatatacccaaaggattataaatcattctactataaaaacacatgcacacatatgtttattgcagcactatttacaatagcaaagacttgaaaccaacccaaatgctcatcaatgatagactggataaagaaaatgtggcacatataccccatggaatactatgcagccataaaaaaggatgagttcatgtccttttcagggacatggatgaagctggaaactgtcatactcagcaaactaacacaggaagagaaaaccaaacactgcatgttctcactcataagtgggagttacacaatgaaaacacatggacacagggaggggacatcacacactggggtttgtcgggggggtagggagctagtgaagggatagcattaggagaaatacctaatgtagatgacaggttgatgggtgcaacaaaccaccatggcacgtgtatacctatgtaacaaacctgcacattctgcacatgtatcccagaacttaaaagtatgaaaaaaaagaacagaataatctctacctataagatgtatttgccttttgaatcttgtaatcttatgaatccattatgaatcttgcattattaatcttgtaatcttgtaagattcataatggaaatccaacttatacatctaagattagtattcattggaacaatgtggaagtatgtatgggatgtgatcacaaagcaacattagtagttcagatttgtatcaatcaactagtcaacactatggatatagtccacctaccgcttttgaacccatccattctctattactattcatttttatccttcattctttctcacatgctttggccagtgacttgctaaaatccaaacactgtgtctatagaatttttctatctacgaatttagtcaccctaaacaacagcaatgtgttgtctcttatgggttgttttcagtgctttaaccatgctgtttctcagttaactgcttgctgaaagtgtgtttgtttgtatattctggaatctgctggccactgataaaatgggcttaagtctgacagtgtgaatgggtttcatcttttttatgcagtgtttcaccattaacataatacattcctatatgttataaatgaaattcattgaatttgaatcatataatttttacaggagattactaattgctatgtaatctgagtacgttatgattccaaggtggaaacagggtttggatggcttaggtgccttccttttactggttgtcacacactcttaccacgaatgagtgggaagagaatagcttcagagccacaggtcagttgaacttgcctgttactacctgaatgactttaagctattacttaatactatgagtattcctttcttacttttgttcagatacgaatatagtgtgtatcttgaaggacttgagatatctatatctatatatcaaggttatatataatatatatatatatcttatgaagtccttcaagatacacactatttgaacaaaatacacacacacacacacacacacaaacacatacctcttatatatcaaaaatataatgaatggcagtttacttctacgacattctttccaaagtttctttcagtccagtttcaatagtttcttattgttaacaaaggaaaaaaagaaaaaaggagctactcgctttgcaatccccccctttccactgccttacaaatgaaaaatggaaagtacctctgactggttccctcccacaaccaatcagactggttgttggccaggttttcatttacatagggtgtaaccaagtaaccaatgggaaacctctaaagggtatttaaaccctagaaaattctgtaaccagggctcttgagctgtttgctcaagcccacttccactctgtggagtgtacttttgtttcaataaatctgtgcttttgttttgcttcaaaaataaaaaatgctggagagaaattgctagcccctttttgccccttcatctcttctgccatgtgaaaacactaacatggcaccatctaggggaaacatgcccttaccagacaccaaacctgtcagcaccttgatcttggacttctcagcctccagaaccataagaagtaaatttctattgttactcaggctcaggtatttttgttatagcagcacaaatgacctgagacaccataggttgccttttcactctgttgatagtggccttccatgcacaaggtttttaagttggctgggcgtggtggctcatgcctgtaatcccagcacttaggaagctgaggtgggcagattatttgagcccaggagctgaaatccagactgggccacatggcaaaactacttctctacaaaagatacagaaaagttagccaggcttggtggcatgcacgtatagtcccagctactctggaggcaaaggtaggagatcacttgagcctaggaggttgaggctacagtaagctgagatcacacaactgtaccccagcctgggtgacagagtgagactctgatttgaaaaaaaaaaaccaagtttttaagtttcatgaagttcaatttgtctattcttttttttgttgtctgtgcctttggtgccatatcacatcttgccaaatccagtgtcgtaaagcttttgccctatgttttaactaagaatcatacttttagcctttatttttaggtctttaattcattttaattttttatatggtgctaggtaagggttcaactttattttcttgcatgttgatatccagttttcctagtaccatttgttgaaaagattgtccttttcccactgagtgttcttagcatccctttgaaaattatttggtcatatgtgtgagggattatttctgggctctctattctgttccattggtgtatatgtgtgtctttatgccagtgccacactgtttggattactgtagctttgtattaaattttaaattcaaaaagttcaagtctcccacatttgttctttttcaagattttgtctgaacatttaagaaaaaaaaaaagtccttccttatagttttggttttatattatctgctgctgaacacaatcctgacacattggtatgatgtatttttggtattgagctcaacaatatgagaaattccaaaaaacaaagttacaattgagttctgcctctctaatatgtaagacaataatttatcaagattaatttgagatcattttgtgagaaagggaatttttccttttttgttaaatgtaggtaccagaaaattgatgataatttatattcaatacctgagggacttctaacctcagagctttattgagaatgactgaattagattttcatatctgcttctgcatttaatatgctgtgatatgttattttggttgacgtatacatagaaaatctcacctcatacacaaaagaggtggaaaagagcttctcaaaagttagttgcagcgtggaatctgaaactgtatcagtgaacttttcatactctgcaacattaaaaacaatcagtctctctttccacttcaaatggatcttttacctctgaatgattttgtaacatcacagactggtcatttggaaaagattggctcaataagttaggtagttcttccaaacattgatccatcccatcatgtaatgttgaaagaaaatcatagggtttttcattttgtttttgtttttggagatagggtcttgctctgtcacccaggctgaagtgtggtggcacgatcttggctcaatgcagcgttaaccacccaggcttaaatgatcctcccaccccagcctcccgagtaactgggactaaagacaaacaccaccatgctcggctatttttttagagatgagatcttgctatgttgcccagactggaaaaatcatgttaataataacaaaattgattttatcggaaaagcctttaaatattaggaaactattaagctcatggcaatggataccagtttcccaaaatcctaattgttaccagaaagctcagatttttatcaccaacaacagagactgccagttgacccccttggagtaacaggctcactttgatcattttcaagaaaatttctgtcaaatattagatctgaagaacgatagcttcctgtcattcatcatttcaaggaagagtggtgctcaagtaacaatggttacccatgctctaaaaaagtgacagttcagcccacattaatcaacagcacaggtgcttgtccttaagacaaccatggtacttggtatgctttagcttcatttcctattgtggcatagagaatttttaaaacacatatattcaagggcagagattcaatggtaatttttcactgtttcataaggacattctgaagtaattattttaatttttaaattttttatttattttaacagtgagtatgtgatagcaaagaatacagtgataactagtcaagtttggtgccactatcttgattcatgctaaggcaccaacagtcttaccctctattgctttggcaccatcactgcaaacgtcaacacaatgaaaaaggcaaataatgttttagcattattatgaaaatagttttgactctatgggccaccaagggttcacaacacattttgagtagcactaccatatggaataccaaactgaccaacaattaaaccaaaaatacacaatatatcaagtaaagctattacctaagaaatccaagtcattgaacaatcagcattaagtgtcactggttcatgaaacatgaactcctttgctgaggtaattgtacttgtattccaaaaacaagtcatcacattaatatttgttatttgctttttcctctgatataagtaatgcatactgacacttggaaaactatgtaggcaaaaaattagctctctctcaccacccccccagaattaactgtttttgataattgacatgctttgttaatactgtaagctttcaacctatcatttaaaattctatcaaaacataacgtttggtggctgtaaaatagtctgctttgaagttaaacaattttccaactacttctctagggtcaggttatttccaatgttttgttataggcattgctgtgaacatttaatatagatacatattctggtcattattaggtgttgtcagaccttttaattttagttatgttctggtttgtgtagtaatagttgattgtggcttaaattacatttccttgataaataatctttggcaatttttcatgtgcttatttgccactcttatatcttcttttatgaatactgttaataattattgtatcctttcctcatatctttttaacagttgctttctgaaaaatttgattttgttgtatatgccattttgcgtatgctgactcactatagaactaataaatgtagctcatgggaaatagagaaaaatatgaagaaaacataatagtccctcataatcttaccactaagaggttaccactgccaaccctttagtttatttttttttcagtctttgccaaatgcaattttccataatcaatattatagattcatttagtgaactacttttgtttcaataccactgatgagcatttctgtgcattgttaaatactctttccatatcaccctttcttcttcctacaccatccacaggaaactaaagtttagattggggaaaatcaatacaagataataaataatacaatactatgatatataaggtagtaaatatataaatatataagtaaatatataaatttactgcagaactgtagtaaatttagagggcactatagaaggtcaattggagctagagttaagaaagagcaatgagaggaaaagacagcaggtgtgagccagtgacccatgtgagcagccgcaccaaggcagaagtgagcagggctatggtgggaccatttgggtttgcacgaatatttggcaaggagagcagtgtgtttggttcagattaaaagtgggagtcgacagatattagaggtccttaaaggttggcaaatgagctgctgctctctgcagaactgaaatatatttagaattacatagaacttaatggtgtacaggagaaacgcctgcttaactacaaaactcttatttatgatggaaaaataaaaacaccatatgcatactgccattcccagaaaatactgtgaaaatattgccttgttgtggctacaaattgtgtaaccccacctttggtgaatgacatatattttctaattttatgctaataatatgatagagacacaattatctcagattttaaaactgataaagtctaggtgggttgagccatctgcctgcaatcacctcatgtcccataaatcataggaaggagttcaaactcagacctgatttcatgcttgttctttatctaaaggatggttctcaaccctggatacacattaaaatcagccgcagagcttttaaaactttcaatgcccacatttccatccactattctgaatttctgattaattaatctgaagcgggggtctaatctcgatgtttttaaatgttctcccccagtaattatcatgtgcattcatatttaaaaaccgctgttagagaccacactgctcagccagcatggaccttggtgttcctcagattgttatgaaaactgtcagggctttttctccagaacttacctagttttgaattaataatttggttaatttcttgagcacaggttaaacttcccattgaaatgtattttcaagaaatgtacacgtgatatgttttctggttctttcatatgtgagaatgtctttttcacttctttacacaaggaaaaccgagtaaatatgtactttggaggagcaatatttactcaaatgttatagatattttctactctcttctggaatttattgttgcagaaggcaaatcttatgcaaacctttttttcctttttaaattaactcgtgtactttatttttttttttttttttttaccattttagagctatcatctctttatcattgatttttcttatgagttctgagacagcatctgatatttaaactctaattcgatgatagacattgtcaattccttcactgatttcaataaagactctaatactcctatattttcaatttcttgaaatgtctttaactcgcctaacaagcttcttaattcatccttgtaccttctggctcttgtttcatgtaattcatattcttttggttatgtcagatagtataaaaatacttttttatattcttgggatagtaatcacgttcccatattctgaaatatagtttcctttgttgttttcctcctcctttattcttaatcaaacaagttctgtttagattgtcaatgatgggcatgtggatttccattcatgacatttggtatctgtgggactccagctataaatagctaaaaggccaatgagcatacattctaaattctagtccaattcttagtttgtaagaattcatattgttttgattgaatatgtcaagtagtatccttgtacggatattgtctgtattgagatgatttgggatattttccttcaagattatgatttctgaaaagagttaataaatataaacttataatgcccaattagcactgctgcaaaggcttctgtgtcttggcctcagcctacaacatttttatttttaaggtctgtatctccatgatgcaatgtaataatgtattctcttttttcacccttcctcaaattgccaagttaagtatagaatgcccagttaagtttgaatctcagataaatgacaaataatttgttagtgtgagtatgtcccaaatacttacgggcacactcacactaacaaattatttgtagtcctcttttaagacttgggacatacttatattaaaaattacttgtagtttgtatgaaattcaagttcaactgggcatccttgtatttttatttgctaaatctgacaatcataagtttctctacattcctttcaagttgttttctgggagcctcagtttctaatttgtatagaaggagatgttttagtgggagtgagtgtatgtgaggagggtttggtaacacagaagtctcccggatcacttcacaaggcggtacacctgtgcagaacagtgatagctgcacagttttgtcttggtataattctggtgttcttgagtcagaggacaaatggtttggggattcctctagtttcttccagctggacagcttgttctgtggcaaggacttggcatttgtgggtcttggctgcatttttcaatccaagtgtatccatcttgctcttggatataagagttcccagattctgaaaattgtagtttgaggtggcttttgttaattttaaacgttttgcatgagaaactgggaaaggctgactgactctgaggcttttagccagaagttattggaaactcgactcctggcactatttgtgtgtgcttggactacaacttctgaagcattgtcagaggcccaaaatgaaaggggcaatcgttatttttggccaaatgaatcctgccaaaacgggatcaactgagatgtctaaatctacttttacaacagcaaggcatattctttgggaaaaggccatggagttgctggatgcaggattgtcacctaaggatgtatttcaagtgatgctgtagcttttgagcttttgcgtgtctacagatgtatgttggaatgcctcagggttgttggacccagtgttggtttttcccagtaagggacagattgttgaaggtctactcacctcttgcctgttttacagccacttgatacaacagaggcatttttaacaagaattccttcttttatgctcctctgagtaaatggtcaatcatgccatccctcacaccacttagcattgcacttagatacaggaccatctgctgctggttgtttggcaatcttcagagcatgtaaaaacaggcaaagtacaagaaaacatcatcagaattggtcttgacactcttagttcaaccagttcccagctaccagctcttcttaaataagtcatgcatttagctcagttcaaagcataaggttatagatcttgcttttgtgtaaatgtgcaaatgcttcatgctgtgttttatcttcccaaacacaagccaccccacctgctttgcctgtttgatttcttccagctggtttcccatttgtcttaatttactcccaaggtttttgccttattgacttatcaaggaagcctagtcatttattttacaaagattatctctttatggctgtacaatttgatgagcagaacacacatttggtgttaattatatttacttgggtttagtagaacaagatgatggatttttttataaactccctaagagacggggaccgccgaggaactcatgtggaaagagtcctttcttccgctactgttcatcagaggtgttgagacaagctgggatgatgccacacaacctgcaacgtgcaaccccaaaagttctttttgaacttcttacactgttgacaagctgttgtgggaaagcaaacctctggaggagaactgctagacaaaaaggtgttcatttgaaatccagaaatgggaggattaaagagttttgacctggatcctgtgtagctgaactttctcttgttccaggcccaccccattttgttttgtcccattccaaatgggttcattgtgtttgagtggaaatatactctgctgggcaaggagggagagctggaaaatttctaatacattagtgacttgtaccccagaacttcatttttcttgacctgtaagataaggtcagtaagtgtttagctggggactaaacagctgaaagaaagagatctcaaactacaatgctcttaaaaagacagtggcttaaattagaggtttgtttcttctcatgtcattgttttgaggtgggcgtttcaagctggttggggggctctgaatctctaagctattcaagagcacagtttctttccatcttgccatggggtcatacttgaggccatttttcacacatgcaagggcaaagccgggtcttggcaaattcagccagcctgcaagaaggatgaaaagaagtccaggatgagcagttgtttttcaataagtttcacacacaggagcttttgttctttccctcagatcccattagtgagaacttagtcacgtgactgtcaccacatgggaagctgagaaacatagtcttgaatagggaagacatgcccaggaaaaaagggagaatggaattttgaggacaaatagctattaaccagaaatatcaatatcaatagttgtaaaagtcaaataagataataagtgctaagcacctgctgatgtagagtattactgaggacgtaatactcaataaaaagcttttacctgccctcatttatattcttctttagagattgaaaattattagaagaagaggaggggcaattagaaacatgatgcacagctctaaatacagacaggagaggaatgggaagaactgagctgggtctgatatcatttgaaatttaaataactttcattcctgaatgatttaattaactggttacacagtggaggctgagtacaaaacaattctcctaaagagcctctctaaaaacataacaggagtcatccatttttagttataggaccatgaattgtcttataaataaactttccaacatagttctttggaaattataggtgttacataattgctagctcaatatttattgttcaaccatattcaacattgaaagtcctaagataaaaagcttaagtgtggattagactctggctggagctttgtccattgaaaaaattcatatgtgaatttctgagtaaggcactatcccaagtactttgatttctttttctgtaactttggaacaatccaaggatttggatggtacaagctcaataatacatgtgaaatgtctaagtcatacaaagtccatttaaaacttttaaagtattactatgctttaaggtcagaaaaaataaaaattagggtgtttggcaaaaacaaagttttgtggaaagtaaaatacataatagacttctattttaataactgtgcttaaataaactaatcccctttgttataacacaaaactctttaattctttgacaaaatatatacatacttatatgacttgaaggatatatattgagattatttctggttgatgtatttatgaagggctattattttcttatttgtttttctaatattctctttccccaagaaaattaatgtggggaattggagggcagaaggaacaagacttgatataatcatgcattttaatagatcttctaactacaaatgttccaaaaggcttttcatattgtctggaatcacaacaatccaatatccccactaggtgaccaaggaaaggagggttgggatgatgttgggtgttttttcaaatgtaaatctattatgtatggctccccaagatagttgtgggaacaaaattggaacatgtaacgcatccattaaaggcctcaaaactcatgaaattcattgttcatagaaacataatgagtgcaaaagactgacatttcctttgccattgtttctttctttaatgctccctagtgccccatattcctacaggaaacagctccccattccttcctcttaatggacatcaaaaggcttagaagctatttgtacatacaccatatgtgcattgtagagactgaaatcaaatcttatttcaagttcccaagtgggaattatggaggggacttgtcagggttactccaggaaatgaaggtgaaggttatcacatttattttccatatccagaaaaatctcatgtagcctatctccaataagagatttgtctttcaaagttaactctatatttcccagagagagttcattatgtttcttcaaatgccttcacactacaggaacttgagggtggaagaggaggatggaaattagcaggtataaatgaaaaacatttattcatgtagtcctacttcaaatagtgttgctattctaatctgggattctggcctcactctttaccatagcatttgttcttttctaaatctcattttctcattttccctaagttggtagcaaaaacaaatttggccatacaaagctcaatagtaatactggctcacaagtagaaaaatgtgtatcttcttgtcctttatatggtttcatttacctatgtggggggtgtgtggaaagagtggggtagagggattctaataagtctacaactttatttattctaccttgtttgagaagtcgttctttaagactttaggtgaaaagtgtttgatatcctctttctgcttacttgtctatgactcaaaaatatagtaagggaagagaaatgtgtattcctggtaattctgtctgtgaggtccatttgaatccatatttatgggggttcactggtgacaagaaagtttgatcctgatgaaatcaaatctaactaagaaatctcaatgtttttggtcaatgtaagtaaatttatgtcattgttttccaaagtgtatttcataaaacactagttcagaggcattattaataggtatcacacaaaaactagctagtctcattttttcagatgtccaagaattacttgtgaacatactccagtaagtaaaatatgaatccagataagagagataaaaacaagaaaaaatgttgagtgagaaaccagtaaaactaataaccttcttaattgttaagaggccatgcagcctaatgcctgagtttaagaaaggatcttttagaaaggagggtgtattagtctggactcatgttgataataaagacatacccaagactgggtaacttataaaggaaagaggtttaattgactcacaattccacatggctgagggggccccacaatcatggcagaaggcaaatgaggagcaaagtcatatcttacatggctgcaggcaagagagcatgggcaggggaactcccttttacaaaaccatcagctctagcaagacttattcactatcatgagaacagcacaggaaaaccccacccctgtgattcaattacctcctgctgggttcctcccatgacatggggggattattacaattcaaggtgagattttggtggggacacaaagccaaatcatatcattccacccctggccccttccaaatctcatgtcctcacatttcaaaaccaatagtgccttaccaacagtcccccaaattcttaattcatttcagcattaactcaaaggtccatagtccaaaatcttatctaagacaaggcaagttccttccgcctatgagcctataaaatcaaaagcaagttagttatttgctagatacaatgggggtaaaggcattagataaatatagctgttccaaataggagaaattggccaaaacaaaggggttacaggccccatgcaggtctgaaattcctgcagggcagtcaaatcttaaacctccaaaatgatctcctttgactccatgtctcacatccaggtcacaatgatgcaagaggtgggttccgacggccttgggcagctccgcccctatggatttgcaaggtacagttcccttcccaggtgttttcacaggctggtgttgcctgaggcttttccagacacacagcacaagctgtcagttgatctaccattttggtgtctggaggacagtggcccctcttctcacagctccactgggcagtaccccagtggggactctgtgtaggggctccaaccccacatttcccttttgtaccgccctagcagaggatctccatgagggctccgtgcctgcagtaaactttttcctggatatccaggtgttttcatatatcttctgaaatctaggcagaggttcccaaacctcaattattgacttctgtgtactcataggctcaataccatgtggaagctgccaagacttggggcttgcaccctccaaaagcatggcctgaactgtaccttggccccttttagccacagctggagcagctgggaggcagggcactaagtccctatgctcacacagcagggaggccatgggcctggtgcaggaaaccatcccccacccccaccccctgcccgtgggcctgtgatgggaggggctgccacaaaggtctctgacataccctggaaacattttccccattgtcttggtgattaacattcagctccttgttacttatgcaaagttctgcagcaggcttgaatttctccccagaaaatgggtttttcttttctatcgcattgtcaggctgcaaattttccaagcttttatgctctgtttccgcttgaatgctttgccacttagaaatttcttgtgccagataccctaaatcatctctctcaagttcaaagttccacagatctccagggcaggggcaaaatgcctccaatctctttggatagggaagaatgacctttgctctagttcccaacaagttcctcatttccatctgagagcacttcagcctgaactttattgtccatatcactaccagcattttggtcaaagccattcaacaagtctctaggaagttccaaactttccaaaatcttcctgtcttctgagccctacagtctctagaaaattccaaactttcccacattttcctttcttctcctgagccctccaaactgttccaacctctgcctgttacccagttccaaagtcagttccagattttcaggtaattttatagcagcaccccactctaccagtaccaatttactgtattagtccatgctcacactgctaatacatacctgagactgggtaatttttaaaggaaagaggtttaactgactcacagttccactggggaagcctcataatcatggcagaaagcaaaggaggagcaaagtcacgtcttacatggcagcaggcaagaacgcatgtggaggggaactcccttttataaaatcatcagatctcgtgagatttattcactattatgagaacagcacaggaaatacccgcccccatgatttaattacctcccaccaagtcccttccatgacacgtggggattattacaattcaaggtgagatttgggtggggacacagagacaaaccatatcaaagggtatacaggaacttattctagtacaggatataatcagtagcctctgtctagaaaaggaaatgcaaaccaaaaacctgtgagtctccttagatttaagtataaaacaatcttgtgcgggaatcttctctagaatgaaaatgagacctggaacctgggaatcaggccccaattaggagagaggttgctgccaggtcactatggagtcatctatgagctatgaatatgcaaaatcatgcagactgtttggaaaattgaagtcattttatatactatctgtaatttaaagaattacttcattgtgcctgattttctagagatgggattattactttgtagggtgggtagaatttctattgtctttttggaactacagacttaagataatacagccatcacagtggatttcctagaccacagttctcttagaggcagtgagtcccagagagcaagaagagcacatgtcttgatcttggctgcctgagaatcctatagaagcttatcatccttctccattccaagacacacacaaagccctataggaaatatcaagattgttgtctttggatggtgacatttcctctttggttttgtgttttttgtgttttgtttttttttttttctgaaagggtgaaaatgatgccttactttttatattaataagaactcatgaaatacatgtatattgtaaaaaatataatttactaccaatacatcaaggaaagtgaccaaaaagagttttactctagaaatgtttgaaatgtaaattgaagacacttagctaattttttagtggtaactttgataaaataggcttaggcatggttcagacatgttaagatattttaagaaatgtggtttaaaacatgcaacttttattttgccttctatttaatgctacctagggtttcatgcttaactgccccttcctagagctatgctatttcatagaagccctccacttgagaatacatctgatcaaaacctccaaacacttcaggttttctctaattttaatttttttttttttttttttttttggagatggagtcttgctccgtcacccaggctggagtgcagtggcttgatctctgctcactgcaagcttcacctactgggctcatgccattctcctgcctcagcctcccaagtagctgggactacaggcacccgccaccatgcccggctaagttttttgtatttttagtagagacagagtttcaccttgttagccaggatggtctcaatctcctgacctcgtgatccacccacctcagcctcccaaagtgctgggattacaggcatgagccactgcgcccagcccctgttatctgtttcttcaaagaaacattcaacagcatcatgaatgctcttaaattttttcagtgtatcaggaaaacaagggaaagcttattacaatatgatgctaaaaattcagattgtaatgttgacaaaaaaaagcctaccatgacctacagtaggcatgagaaaagacaaggaaccaaaaaatcactttcttctcttacactaatccttgcaaacaagttaacacagaaacagctttaagtttaacaaaagtaaatgacaaaacaagcaattgtaaggtgtgtgtgtatatataggtatatatatcttgcaattgcctgtgtctatacctatctatatatatacatacctattcccctacatatatagccatatatatattatatatatatatgtattttttttaacatatttgggatttcaaaagtttgggagagtatatattttatatatacacacacatacagaaaatatatatatatagaatataatatattctaatcccaaatatttaaatgctttgcctatcttgcatgagcaaagggataaaaatgccttctctttggagtcctagagaccatgtctccaactttcatgtcctgatgggatgatgtccttccactcctgtaagaaccctagctctggcacaacctcagctgtgtatgcttccctccgtttctttgaaattttggctttcacacagatccctgtaaacttcaaaggaaaaggacaatcttcctacttaaccaactatttgtccatctgtccatcctatgcctgccttctttctcctctttgttttccatcaacatgaccatacattgaacacctacaatatgccaagcgttgcactaggtgtttacaacatgcagtctgttttccatgctatcatcttaaatactcttatttagccctctctcctgaggagtactgcctttagtttccatgtcattagaagcctttctctacctcatcaagctcatcataccccagagtaagatggaggtgaaagagtgtggcatagtagaaagagcatgaactctgagagaattatccttaggcttaagccttggcttctctatttcctacccatgtgtccttggatgagttattactctctttcagcctcagttttctcatctactatctatctgagggtaacaatacttcagagctgctagaggaattcaatgaaataacatgtaaatttccttaaaatatgcccacagcatgggaagcatttaatgaatagtagcaattctaatatctaagtgatagctgccaattcattagatatgggcatgttcagaatggtccattgacttatacttgccccattatgtatatatgaggacaataaaaagttgcccagttgattttttattgccctcttatatgtacatgcattatgtagacagcctgctcaatgggtatttattataataatgaagtacacagtctaatgtttctcttcatttgtataagctttaagaaagccctgttttttcagcttttttggtacataaattcatggcagtttggttataatccccatcgttttgtttgattttccctgcatttcttaaattaagaaatatccatatattgagattagctgtaactaactcatggtgttccttccttttgccatttcctccctttccatcttcttgtaatttaaactttccacatcctagagtgagaaatatgagtccccagtttttccacagcttcaataagcaggctggaaaatgttttaatggactgctagaaccaatgactattagtggctttcccccatcttcctgaaggttttcctgtccaacccttctctccctttcatgtcctccacatcttatcagttgtaatgaattgaacccgtagtagcagcgctagaagagctgtttcttagtttaaatggtagtcatactattttgcaactaaaattaattttatactcttttaatgaattctttattttcctgttctgtttattttgaaatgaaaactcctaaaatatttttctctgtacacctagttgtacccagaggagacaagagatctagaaatatccttaatgcgtacctgaatattctttctatcccaatatgtacccagtttttaaaacatttttcccatatgtaagtgttattcaaaagttttcctagaaaagtcatattctgggcatgctatgtttttgctgaagtgtctaggctttgtttttgtcctgtcggggatatgacttgtgagttttcctttatctgtgagagaaagttgaccttttgtgctaattccatttcctggtgagtcagccttctttcttttgggcttgcctattgctcagtgccaactcttacattccactaattcagcacctgtcccttcttaaacaggttgttcaaacccccatgctagccccatctttgacccagtgacttctttgggtggccagttatttaatttttcaaagcctctgttttgacatgtgaaaaaaaataaaaataacattatcctagcagggcatattaaataatgcaaatgagggtagctaccaatgataaattttactaggaaggaggtaatgctgaaataatgagaatttatcttatcataaaaatttaacttgtgggcagctccaaataagtagcaatttcccttttcttactattttcctccaggaatttgggctgaaattattcaggatccattttccttcacgtatttccatttcaaaaatggtagaatggaaaggaatagaagtaaatttgaaggattttcaaagcttacttaggagtttggcatggagaggggaaagctgtcacagctattgatgaatttattcagtaactactgagtgcctactcagtgctgcatcactgtttctatatggaaaggaactatccctctgggacagtgtttccttagtggggttagcagtccaaggagcaaagcatatgtgtgtttctataagcaatggaaaaaggatactccaagaatcctatatatgtagctgtttgctgattccaagagggcagctaagactttttggaaataggaataggaatcaacctagcacaatgctttgcatgttgtaggtgttcaatatgtggtcatattgagggaaaaaaaggagaaagaagacaggcataggatggacagatggacagatgattagttaagtaggaagattctcccttaaagatatgtctctactctgccaatctttgttaaaaaaagaaaaaaagaaaagaagatatttaaaagtagagagtttatatgaagtctaattagaaggtcttgttacactctgaaagagtgccagaatatcagaatatgaaccacaagatcattattttctttttcttaactttttttttttcgtttttgtttttctttttctttttcttttttttttgagatggagtcttgcattgttgcccaggctggagtgcagtggtgcaatcttggctcactgcaacctccacctcccaggttcaagaaattctcctgcctcagcctccctagtagcttggattacaggtgcaaccaccatgcccagttaatttttgtattcttagtagagataaggtttcaccatggtggccaggctggtcttgaactcctgaccttaggcgatctgcctaccttggcctcccagagtgctgagactgaattttattgaaagccgtttctgcatttattgaggtaatcatgtgtttttcatctttagttctgtttatgtgatgaattacatttattgatttgcatatgttaaaccaactttgcatcccagagatgaagcctacttgactgttgtggattagcttttaggtatgctgctggattcggcttgcacgtattttgttgagaatgtttgcatcaatgttcagcaaggatattggcctgatgtttttttttgttgtgtctctgccaagttttggtatcaagataatgctggcttcatagaatgagtgggggaggagtcctcgccctgcaaccgacccagtttttttggaatagtttctgtaggaatggtatgaactcttctttgtacatctggtagaatttggctgtgaatccatcaggctctgggcttttgttttttgtttttttttttttttttttggttggttggtaggctatttattattgattcaattttggagctcattattggtctgttcaggaaaccaatttcttcctggctcagtcttgggagggtgtatatgtccaggaatctgtccatctcttctaggttttctagtttgtgtgtggagaggtctctatagtagtttctgatggttgttttcatttctgtggggtcagtgatatctctttcatcatttctaattgtcttaatttttttattagtctatttagtggcctatctactttaatttttttttaaaaaacaactcctagatttgttgattttttaaatggtttgtctctgaatttccttcagttcagctctgatttttgttatttcttgtcttctgctagctttggggttgacttatccttgcttctttaattctttccatttaatttaggttgttagtttgagatctttctaacttcttgatgtgggcatttagtgctatgaatttccctctccacactttcttagctgtgtcccagagattctggtatgttgtatctttattttcatgatattcaaagaacttcttgatttctgccttaatttcattatttacccaaaagtcattcagaagcatattgtttaattttcatgtaattgcatggttttgagcgattttcatagtcttgacttctatttttattgtactgttgtccgagagagtgtttggtatgattttgattctttttacatttgccgaggattgttttatgtttaattatgtggccaattttagagtatgtgtcatgtggtgatgagagagtgtatattctgttactttccagtggagagttctttaaaggtctatcagatccattggtacaatgttgagtttaggttctaaatatctattaattttatgccttgatgatctaatattgtcagtggaatgttagactcccacagaataatagtgggagactttatgtctctttgtatagtaggtctctaagaacttgctttatgaatctgggtgctcctgtttggtgcatatatatttaggacaactatgtctcttagtagaattgaaccctttaccattatatactttgtctttatctttgttagtttgaaatctgttttgtctgaaattagaattgtaacccctgctttttgccgttttccatttgcttggtatgttttcctccatcccctttattttgagcttatgagtgtcattacacatgagatgggtctcttgaagacagcataccattggatcttgcttttttatccagcttgccactctgtgcctcttaaattgagcatttaacccacttacattcaaggccagtattgataagtgtggatttgatcctgtctttgtgctgttaattggttattatggtggcttgtttgctttacagtgacactggtctgtgtgtctttgtatgagctggtagcagtctttcctttctatatttagtgttattttcaagatctcttgtaaggcaggtctggtggtaatgaattcccccaacatttgcttatctggaaaggatcttatttcttcactgaggaagcttagtttggctggatatgaaattcttgaagatgatgtttttctttaagaatgttgagtataggcccccactctcttctgggttgtagggttttagctgagagttgcactgtctgatggggttccctttgtaggtgacctgccctttctctctagctgcctttaacattcttttattttgaccttggaaaatctgacaattatgtgttttgggcatgatcttcttgtggagaatcttgcaggagttctatttcctgattttgactgtttgcctctctagaaggttggggaagttttcatagatgatatcctaagatatgcttttcaacttgtttgctttctccccatcccttatagggatgccagtgattcatagatttggcctctttacataatcccatacttctcagaggttttgtttattctttttcttttttatttatttttgtctgactgcttcgtttcagagaaccagtcttcaagttctgagattcattccccagcttggtttattctgctgttaatacttgtgattgcactgtgaaagtcttgtattgtgtttttcagctctgtcagacttgttaggttcttttttatacttgctatttcattctttagctcctggaaagaagtctatggattatactcaacctacactccagttaaaggaacatctacacacagaggtgagaaagaatgaatacaaaaactttggtaactcaaatggttagagtgtcatatgttctccaaatgactgcatcagttctccaacaagagttcttaacctggttgagatgacagaaatatcattcagaatatggataagaacatcattgagattcaggagggaagcaaactccaatccaaggagaatgagaatcaaaataaagcaatacaggagaagctttcagttgacccagggtgctctgtccagggagttgccaagttgccacgggcttgatagctctggtgggggatggctagaggcccaggcctgaaagacctggagatatgggatatgggaacaagcacccatgtagcagtctggccacttttctgtaggtctgcttcagtatgcttggggccccctccaatccctagtcacatcagattttccagtacctggaggtatcaccaatgaaggctgtgaagcagcaaaatggcaatctggccctctctctgggagctctgacccagagaggtatgtgcctgctgctggcccaaaggcacctgtaggaggtggctggagaccccagctgggagatcctgcctagtgaggaggaacaggatcagggacctgctttaaaaagacgtctggccacattttggtagagcagatatgctttgctgggcatttgcttcagcccctggttgcctagacactccaaagcccgatggctggaatggctaagtcacccaaacagcaatgatggtggcccaccccctctgtgagctccatccctgggaagttactaatctctgttggccagagaacacctttaggggagaggtggctggaggcaccccagttgggaggtcctgtccagtgaaaaggaatgagattggggacctgcttatagtagtagtctggccatgtttggtacagcagttgtgctgtgttgggggatcccttctgcccgattggcctggattctgcaaagcctgaaggctggaacagctaatgtacctgaacagtaaagatggaggcctgcctgtccccctgggagctcttccttagggagttacaatgctggtaccagtggctggccagaattctaagctgtgggtcttatcttgtgaggtagcatggacttggggcctgcaggctgttgctgctcagccccctgaattcagcctcttttctatgggtatgtacagggttctaacctcccactttgctggagctgcagctacttttgctggaaagcccaagtatctaaggctccagtgattccacgcatgtctgagtggttgctctgccaagactccatgtagctctgtcagactgaagtccctggtagactgcgttcacaaggatatctcctgtcccaagggttgcaaagatctgtcaaagaagcatggattccttaggtgggggagggtcccctgtctccgtgtttctcccagatgggctttgtcctgtcttggttttctttgttctccatgagtcaagttgtttccttgattactccctttgtgaatactaggatgtttcagttgaaggtgttgtatttactcacccctcccgtttctctccatgagagctacacacagtagctgcttctagacagccatattggccatttccctccattgttttcatctagaatccaccatctttaaaaaatgagttttccttcaactgtgcatcattttattttcaaattgagcctatttctagcacttaatatttacacaattacaattcatttcacctatgagtcattatatttatctcttatgtgtatttatacccgttctaaagcttggttttatggtctaattaaattaacgggatatactttataaataatacttagggaagatgatatagttagaggaccaggattctaggtctagccactaactagctgtgtgaacttagacaaatcatttaattttatttaattcagaaaaatatatgaaaacaaagtagctcaatctcactgctcacataactacttgtaaagaaatacatgtacagagtttgttcttcttttttatcatttcaggaaatgaataacatgaagtgaagtcttcatctccattcccaacagtccccattctacttgcagaaaggtaaatattgttcatattttgttatgaattcattttgctatgaattctttacaaatcagcatactaaaagatgtttgagtatttcctaatagatgcagatcctaccataaaactgtatgcatataatatttttaaagagaaatcattgttttagagaacatttagggagtaaagagtacgtgttaaaatttctttgaaatgcttatctatgactagaagcattgctttcttctactctatacagatagtaaatttaaaggcacatttggggacaggattgtgggttttctcaaataaccttcttaaataggtagagaaagcacctctagtcttggttttttagagaaatttttaatattatgttcaattttttaaggcaaataaagtaagctgggatatgatttttatttatcaaggtaattattttccctaaagtttaaagaaaacttgaaggaacaaataggtgtagctggagcaagtttattgaggtatagatacaccacaccactaatttcatagtgtagacagtcctctcagaatggtatcaagagttctttgaaagggcaatacagtttccgaaagccctacaggaagacctgggtagtgacaatagtaccatctcttctggaaacctcactctgaaatgaattatactcagggcaaaaagcattcttctgtatttgtaggtagcctaaaatgtacatcacagctgcctgggctaattttatagggctcgtggaggctcctacatttgctattcacaatggcaagctgagctcaatatttgaacaaaaaaagttaaatttaccaactgtaggatttatattctcagaacaaaaaaataaatgaaacctttaagggagcttagaaagtacaaccataaagaaatagtcatgagtcatttcttcagttaaaccagcatcagtactcaagtatgattactatattagaaaaatcatctttaaacacaaagaaaacttctgcttgtgtatattcatgatcaccaataaaaaggttctaccaaagggccagtcacccaggtgttcatgtacatacaacagcatatcatgatggacactagaagcctcgccctacagtctctgctcttaggttccacctctgaccctcacttgttgggcttatcttcggcaaatctttagcctctctctccctaaactgcatcatctgaaaaatagagatgacaatagtacttggctcactgagttgttatgaaaattaagttagtacatgtaaaacccttttctggcacatggtaagtgcatgtaacactgttctttttcttattcaatgtgtatataccaagggaaaggtttaaataaaaacattaagttaaaataatttattcaaaagccatgccactgttaaattaatacagtcaaaactacaaataaaaaaagaacatgcaaaatattttataatattgtataaaggcttatatgtgtaagcttaaaaacccttcatttatgaatcaatttgtgcataaaaattgtatacatgcagagacttgggccagaatggatattgttgaattaatttcaaaaatacgttttacagcttttccaaaactctttaatgaaaagtcagcaagaagataatgagaaaggaccaaacagatgttggcttctgctgaaatttgccaaacttttacagcatcattatgatagctttccgtttaggtcaccacagtttaaaagtaagtgggacatttggatctagaagagagcagtgatgattaaagagttggaaacccaggcttaagaggaagggaccatggaaatgatgttggttggccaaaagaggagaaggctgtgggtgccttaattacagtctcagtatatatataatacaccatgtaaatgaacagatgttgttctgcaatgaaaatagaacaagatgggagcactgtggctctgatttgagaaccatctttgtctataaagagttgttgaataactaaacctctgttctctcaaccaatatctattcatttcctctatttttataccatattaagtgctaacggttgataattcacatatttagacatattgcatggaatatgctctataattgtattgcaggagacttggtgacctatacgcattagagcatgggaaagacaggaaactaggttggtgcagtgacacattttggattcccacttccgtctcacaaggatgcatgagtatcctgagaccaccacagaagatagctaggtgggagtctgcttgttgatacatcaaccaaaaggaccgccctgggggcaagtagagtgcttcttccagctcaaggaattatgcggtgagcaggctttccttgcaggcccacctagctcccccagggaggacattccaataaccagttttggattaccccaaaagacatctatctatctatctatttaaatggtctttcctgtaaataacacttcacttctgataccaaatgtgtagggtttatttccagttcctagcagacaccaacttggtgtcctaaaatgcaattaaattctaacactatctatcagaaattagatcccacaagattgtccacacttcacatgccaatagcaagtcccagcctcctgtacttctgactgaccagctatacactgggagtttccataactctcatctcagtttcagtaatttgctagaatagcttacagaactcaacatttactcaatttaccagtctattaaaaatagtattttgttgagaatgtttgcctctgtgttcatcagggatattggtctgtagttttcattttttatgtcctttcctggttttggtattagggtaaaactggcttcatagaatgacttagggaggattccctctttatcttttggaaattggtaccaattcttctttgaatgtctggtagaatttagctgtaaatctgtcttttttggttggcaatttttaaattaccatttcaatcttgctgcttgttattggtctgttcagagtttctatttctttctggtttaatctaggagggttgtatatttctaggaatttaaccaactcctctaggtgttcacagtagccttgaatgatcttttgcatttcttggtatcagtgataatgtctcccatttctaattgagcttatttggaacttcgttcttttcttggttaatctcactaatggcctatcaattttgtttatcttcaaagaacaagctttttcattcatttagttctgttctgatctttctttgttatttcttctgctgagtttgggtttgttcttgtttctctaattccttgaggtatgtgaccttagattgtctgggcataaagggtatccaaattagtaaagaggaagtcaaactagcactgtttgctgatgatacgaccatatatgtagaaaaccctaaagacccctccaaaaagctcccagaactgataaatgaatttaggaaagtttccagatacaaaatcaatgtacacaatcagtagcaatgctatataccaacaatgaccaagctgagaatcagatcaagaactcaactccttttataatagctgcaaaacaaataaaatacttaagaatacacctaagcaaggagatgaaggacctctataaggaaaactacaaaacactgctgaaagaaatcacagatgacacaaacaagtggaaacacatcccatgctcatggatgggtagaatcaatattgtgaaagtgaccatacttccaaaagcaatctacaaatttaatgcaattcccatcaaaaaaccaccatcattcttcacagaactagaaaaaaaagctaaaattcatgtggaaccaaaaaagagcccatatagccaaagaaagactaagcaaaaagagcaaatctgaaggtagcacattacctgacttcaaactatactataaggctatagtcaccaaaacaacatggtactcgtaaaaaataggcacatagatcaatggaacagaatagagaacccagaaataaagccaaatacttacagccaactgatctttgacaaagcaacacaaaaacaaagtggagaagggatactgtattcaacaaatggtgctgagttaattggcaagccaaaggtggaaaaatgaaactggatcctcatctctcaccttagacctgaaaccataaagattctagaagataacatggaaaaaacccttctagacattgtcttaggcaaagacttcatgaacaagaacccaaaaacaaagataaataggtgggacttaaactaaaaagcttctgcatggcaaaataataataatcagcagagttaacagacaacccacagagtgggagacaatctgcacaaactatacatcttacaaaggactaatatccagaatctacatgaaattcaagtcagcaagaaaaaaaaaaatcccatcaaaaagtgggctaaggacctgaatagacaattctcaaaagaagatgtacagatggccaataaatatatggaaaaacattcaacaccactgattatcagggaaatgcaaatgaaatccacaatgtgatatcaccttactcctgcaagaatggacataatcaaaaaatgatagatgttggcatggatgtggtaaaagggagcacttttacactgttgttgagaatgtaaactagtacaaccattacggaaaacagtgtggagattccttaaagaactataagtagatctaccatttgattcagcagtcccactcctgggtatctacctagaggaaaagaagtcattattttattattatgtgtatacaagtatcttttaaaagatacttgtatacacatgtttatagcagcacgatttgcaattgcaaaaacatggaaccaccccaaatgtccatcaatcaacaaatggatacagaaaatgtaaatatatatgatgaaatactaatcagccataaaaggaactaattttaaggtggatctatgtcacagttcaaattcagtgttcagtgacttattgcctaaatgtacaatgatctatctaatctcttaaatgaggccagaagagtgagctggtaaaaagagggctaagatcctccaagaactgagttcctgttccagctctgtcacttactatttgattatcaatgggcaatttatggaatctgttttaaatcatgggcactgagggaataagtgttgggcaccaatagcatccactatagaagttactcaatatcttccctgaaagcctttgaacatagctaggcctctaaatagtctgcttaaactccagttcttttggaaaatggcagagaaaatgattatcagattttaagtctatcaaaattccattcagcattgaatacatataaagtataaggtgagttacgaatatatccaaaaatttgtattcaaaacgtaagacaggaaatgttcatttttataatttactcttataaatcagtctcagtaaggcagctggggttctcttcctgtctcaaatattgagcccaaaattttcccagctttgtgacagtattaggttcacaccaactcttttggatgccttcctctcaaaatcaaattcaatatagagggacagagactgagaagcctaggatgagccagaaagtttgtgattggcacatacttgcctggggcccaagtcaccagaagtcaaaagtttcctcaggaaataatgtgttgtcaaatggccatcctccagtcaacggggcctgttaagtcaaaaacacatcagtattataaagcaccacacacactgactcatctagtctcaagatatgcaggatctaaattattatatcccttttactggtatggaaaccatgatttaaaacagattacataaattgcccgttgataatcaaatagtgacagagctggaacacaaactcagttcttggaggatctcagccctctttttaccagatcactcttcttttcttctggcttcctttaggagactagacagatcattgtacagtcaggcagtaagtcattgaacactgaatttgaactctgacatagatctaccttaaaatgaagctaaggcaaaattgcaaagtacccactttttattagaaaaataatttgattgattgtaatttcttttgttttctaaacccgagtgttcacctttcttttctcctgtatccctatggccctcaatcaaataacattggaataacatttgctaagtgttttgttatctgttgctgcataacaaattacccccaaactgagaagcttaaaatcatcataattatctcacagtaattatctcacagttactctgagttaagatgccaggggtagtttgactgggtggttctgactcagggtaggtatctcttgaggttgcagttaagttgttggccagggcaacagtcacatggggctagaggacccactttcaggatcacgcaagctgttgttggcaagcctgtttcttgctggcccatgtctgtccatctccattcctcgccatgtgctgcttgagtgttctcaagacatggcaggtggcttgccctgagcaagaaatctgagaaagagaggtcaaggtgtcagtagctagcattcttttacaacctcatctcagaagtaacataccatcactttcaccatattatttgatcccacagaccgacgctggtatgatataggaggtgacttcacaagggtgtgaattctaggaggtggggatcattgggagtgccttggaggctggctatcacactaagaagcatacaaatgtaggggcaatttattccctctgttgcttctcagaggcagaacagggcatatggaaaggggatgttttttccatgtgtataggtacacaattcaatatacctattatgtcatctttattagactgagctcaaaacagatactgacataggattgataagacattaagatcccaagagctcaatctaaaagaccaaatataccaaaatatataaatcaagagaagttcagtaagagctcaaaaaagtataagggggttcatataatgatggtaagctgctgtacacttggggaagaacaagacacaatacctaggagaagtggcatttcaaatgagtagaatttcagagtaaagatcagggcaaagagaaatcaagagaaaggagataaaagactccaaggagcgaaactcaccaagaatctttgaatcagaaattctggtaatcatggcttcacaactatggaagtccagcacagaaaactagttgcatgtagtttgatataaaagtagctatttgtaaagcctctgataggagcatacccaaaaacaaggaagaaaaagatgttagatagactcagcttcctgctgagtttctccagtggcttcccattgtctgcaataagttaatgcatactccctagcattaagaccttcagtctggcctgaacctttggagcctcattcctaaccagcatcctgcctccaggcccccagtgatgccccagcctaatcgggggaacccacccccaatatttcaacgtagtttctttctgttttccataagtgtcggccggctgagaaataaagtgaaagagtacaaagagaggaattttacagctgggcctctgggggtggcatcacatatgggtaggactgtgaagcccacctgagctgtaaaaccagcaagtttttattaaggatttcaaaaggggagggggtgtaagaacagggagtaggtcacaaagatcacatgcttcaaagggcaaaaaggagaacaaagatcccatgcttctgaggaaacaggacaagggcaaaaccagaaactgataagagttcaacaaagatcacaaggcaaagggcaaaagcagaattactgataagggtctaggttcagcagtgcacgtattgtcttgataaacatcttaaacaacagaaaacagggtttgagagcagaaaactggtctgacctcaaatcagggtgggggtttttccccaccctaataagcctgagggtactgcaggagaccagggcatatttcaatccttatcccaactgcataagacagacactcccagagccaccatttatagaccttccccccaggaatgcattccttccccagggtattaattattaatattccttgctaggaaaagaatttagcaatatcttccctacttgcatgtccatttataggctctctgcaagatgaaaaatatgactattttgcccaaccctgcaagcagtcagaccctacggttgtcttcccttgttcccttaaaattgctgttattttgttctttttcaaggtgcaccgatttcatattgttcaaacacacatgttttacaatcaatttgtacagttaacacaaataccatagtggtcctgaggtgacctacatcctcagcttatgaagataacaggattaagagattaaagtaagacaggcatcagaaattataagagtattatttggaaactgataaatgtccatgaaatcttcacaatttaggtacctctgctgtggctccagccggtccctccttttggggtccctgacttcccacaacacagcttccccatttccttaccccaggacacaccaggctgggtcccagctagaaaggcatacttttttacccattctgtttattctgcatggaatagcctgcacatctcttcttcacaccacttcctccttacctttccacattcaaaggtcacttggcctagaaagatttttctgactctcttctgggcccgtcttcatcccagctgtaacatcatcactataaatgcattgacatctggcatggcatatactctacgtaattgattctaaaaggaatattcaaatcctacaactgaaggcatgatatagtttgacatcttttttcccttggaaaggaaagtaagagataagttaatggtgccttaaacttgatggaatttactcatttgcatatttactccttccttaagactcaaaacaccttctggtatgaaatcatttattttatatccccattgcctgtcacattgccctgtataataagctccccatgaatgtaggaggctgatccttaaatagctaaaggaaacatcacttctttctacctagttccaggaagggtgaccctgattacccatgtcatttcatttaaaaaggtcagcatgaggtgaatgaaaattgtgtgacatgttgactttgttacatcatttgacctaaaaactatgacctccttcctttcatgtcatgtatctccaaatctttctggaattaatctcaagttttcaacaatggacttagaactctaaatatatacagttgataaaatgcccaatcaatgaagtcaggcctgaagtctaagctttaatatttattagcatgtgacctttgttggttaaccatcctgaaccttagtttcatcttctgtaaaatgagggtagtacaactcacctgtcagggtagttgtgatacagctgcaatgactggaggagccccagggtccttggtctcacactgatttagctaaaacaacacagacacacatggagtagttttaaggagcagaaagtttaacaagcaagcgagaaagcagcagctcccccatacagagacagagggagggaggctccaagagagaaatcctgtgtgccgcagaaaaatggtcagttatattggaggctggaggaggcagtgtctgatttgcatagggcccaggggattggtttgaccagctgcatcattcacgtagcccacagaaaaacctggtcctcccaccttagtcttttaatatgtaaatgtgggctgccatgacgtcctgaacatgttgagttatctggaggtggccatgacactgggcacaccttgtgataagaggaaggtgggaattgccatattgggtagacccagtttctaatggcctgcatttgcatatcaaagcttactggtctgggccttcaagctgcctttctgtttgaaacgaaatggtttgggggttgcttcttcttacaggaaaattaccactgagaacctttaccctttctagctgcctaaaaattatttcttaataactcctgtattagttgtaaagattaactctattaacaaatataaaacatctaagatggggcctgggtatagtaagatattcagttaattttagaccactgcctggcacataacagaatgaacaacaaaaataatgagaagagtctacagggttaggtgagcaatgtgggcttagaaatccattccaacatcatattaattgggcactgaggtaattgcccaagttaatgatgtcaaaatgcaatggacaacaatccttgtggaggatttattctgcttgagtttctctttctctccgtgtatgaagtttgaatctagttttacctattgttttcctattgactacaacatttttaccatgaaaacatggaatttataacaatttgaccatgtatttttcctcatattattttggggaccagactgttgctttgcttccaggcattgtaatttgacatgtactctacaacaatctttagcccccattagctcttagtgagactatttcctctaaacctttcccataggtttcacaactttcttttgaacgttctccaaaaactaaatccttactttgtttaaccatatttccccttctcttctattgtgcatttctctatgttgagaagtctttgagaaagcagggagtccctctgccaactgatcctatactaggataggcatgggtgatgtaggccttctacaggtcatttagaactatgggagcagggcagtaggtagagcacagaagaaaggaattatgaaatgtcagagaattaggggaaaagaagagcaacaattctgatttgttgccatgcaaagacggagagattaagatcggaggggatgttccatatcaagaggatgaagtgaagggataaaggtccagtttacacaaagaagtttaaaagccagatgcaaaatcccaaatcttcatcatatactgataagccttaccacactagttggaaaggaggttctagacatcaacatgggaagaggtggaaaacccctttgatctttcataatgtagaaacagaatcccagaacaataaaacagacaactaatcctactattttctgatcttttggctcctctgaatcattttataaacttagcttctctgtgggggcctaatccttgtcccaatagtccacgtggttgaatggctgcctgatccaaatgctttgatcataccggagtcttggagtcttttctaccatttttataggcacaactttcagaaatactttcttcaaaagccctgtgctttgataaacaggtttaagtgctataatcaccaggcatttgaatgcagattaattcataaacccagataatagatcttgttctgtcatgttgtttttagacaaaagttgaaagctttgaagaatgtggagaaactatgaaattttaatagccttggggcacagaaacttaacacaaagaaagaatcgtcattcattcaaagagtattcatggccttggtggaaagattgatgacaaattctgtgattaattacagttgttgaagaaagttagaagaaaaaaggcaccaagagttcttgagttaatcaaagacagcaatttgaataaatggtcctaaagtccacagtaattatttcgtcaaatgaaccacattgttactttgaattgtaagattttaccttcatcctgaaaaataaaaataaaaaataaatgccttggctgaacattattgatttgatagggaaagtatcagttattttcctacataaaagggactcatgaaatctgagggttgtgatatttaggttttcttgcctgagggaaggtcatttcacagtaacctccagaaaaaatgactatatattatgattagtaacttatccataaaaaggataatgatatcgttttgctgtgtgtcctcatccaaatctcatcttgtatctcccataattcccacgtgttatgggagtgacccagtgggagataattgaatcatgggggcgggtctttaccttgctgttctcctgatagtgaataagtctcacgagatctgatggttttaaaaatgggagtctccttgcacaagctcgctctctctttgcctgctgccatccacataagatgtgacttgctcctccttgccttctgccatgatcgtgaggcctccccggccatgtggaactgtaagtccaagaaatctctttcttttgtaaattgcccagtctcaggtatgtctttatcagcagcatgaaaacagactaatacaaataacgtaacaagaacaagaatgaaataattgacatgaaggactcacctgaacaattacaccaaaagagcatcttcttctttctctaatctacacaaagcccgtccacaacaggccaattctatcagagacaaggctgatgggaaggttcagaaataattgcagttttcctcctcacatttctattgaatcttttggagaatagaaaaataaattatttattacaaggcaggggttctcaagccctagaccagtacctgtccgtggcctgttaggagcagggtcacatagcagaaggtaagtggcaggcaagccagcattactgcccaagctccgcctattgtcagatcagtggcagcattagattctcataaaagcatgaaccctattgtgatctctgcattcaagttatctaggttgcgcactccttatgagaatctaatgccatcccccatccaccctggtccttggaaaaattatctgccatgaaaccggtccctggtgccaaaaatgttgggaaccgctgttgtagtaagttttcaataggtaacttgcattcaacagcttgtggttatagcttcctgtttggcagaggaaaaggatatctctatatatagatatacatatcacagatcttagaactttaaatatcaactgtattagaacttgactactgagcttgagcttgccaccattcttaaaatcatcagctctactgccatgctgttttttacatttatatattataacttcatctttaataaaatatatatattagctatttttcaatgtggattttatgtggtaagtgttcagatctaagaatgttatctgtttcccaagtagcttgtttttcctgagtgaaaatttatgaaccctacttatgttaattaaaattatattttaaccttactagatctgtgctatgactagaaaatagttgttaacataaaatttctcccaaagtaaatggatagtttaaaaaaaaatccagtaaagtactaagtcatgaaaactatattttcttgacacttttttctaagatgcataacatgctttaatcttttataaaatataaacattctttcataatatatgaaggaattaaaacagtgcattttatgcacttgaaaccaaaagttcccaatcttcctgctcgttaaagaatggaaattagactgctagtttttcttacttttttagcaacgtaactaaacgtgatttggatattaagtctcattttggataatcaaaatacataagcatgtgtgtgtgtgtgtgtgtgtgtgtgtgtgtgtgtgtgtataaaataaaacttacaaaatatgtatgtgtgtatgtatatattaagcttgtgaagtcctaaaagcctggcagagtgggagagacatgtagctccagtaccagtaaaacaaaccacatggctaattaaatgtgttctattgatctctccactaaccgctgaaaaatacatacagattttcagttaatcagctaatagtttggcattctgcgtgctatatctttctcacctattgttgtgattaactctatgattttaagcttttatttgtagatttgcactttacagacttctaagtccttgaagcaagcaaataaaaaaatgtagctcaatgagaacactgcaagttattgagaacactgcaagttataaaagtggtccaaggagtttcactattttttccttgcaatgtcagaacaggatgaaaagcaaatttgaggctatgtttctttccctggaagaactatatatatagttgacagggaccccctctcttttcacccttgctgacttaccacactgtccaaccaagacttgctctctttcccaatcacttcttcacgaacctctccctgaaaaagtagaggtgaaatgtaggtattaaaattttcccaccatttcagaaatcacaactcttcctaagagaaggaaggaaacatgaaaaatggacaaaaggctgatctagatgtgcttaatttagcagtcatagaatgggaactccgtatttgtatattttatatagttatgaatattacatagtataggatgaaaattcaataaataaatgtatttattaaataattatttatttatcaaataaatatattagccagttcacttattatcaactaaatattgaaccatggtgaattgatttaggacaaatacagaaataaaataaggatatttaagccaaacttcattcaactctgttgtttagtacagaaatatcatgatttgatgaaacaagttgttttcaaatatagttttacatgatgtgaaaggtatatcaataaaatataaactctgggtttattatttttgacttatgaatgctaactaataatttatctttttacttaagtaataataattttgttaaaaggcctggtttggctgtaggcaaagaattgattactcggagcaaaaaaaaaaagtgatgtgttggctctcatcactttcctataactcatgaatattcacattttccagaagattactgcccttagtgatttgggctcttccttttcaaatctattgttatatgtattatttttcttttaattaaaagaaggcaatcaagactgtttaactcagtttaagaaaaaaaaaaaaaactcttgccaagtttcttgaaccccattgtatacatgcaagcttaagttagaacaaagacatgacattattgtatggagtctagtaaatgcttctattgtgtcttcaattctcttcctaaatgacattctcatttacttatatttgtctctgtcttcacaggttgcttacactgaaaatcagtttattttcccctggtgcaaagaacagtcgtttctccaaaactgaagctggaaattatctgaaatatcaggtcctccggaaaagggacgtgaagccccctttgtaatttctgcattagcgtgctctcctggcaagcaggaaacctcatcagagaagtcagccaaggaaagtctttaaatggaaattgtgcaaacgaggagcaaatgcattaaaaagttgctgacgggcatgaaatgctttgatgtgaagacggaaaactccaagcaggaaggattttaacattttgaatctgattgactctgtggtttctcagcacagttattccatgggctaaaataaatgcagaaatggtactttcagaccacagctgcagaggggatcgtggtgaatttcaatgaaaatccatttgaatcttgaggttcagatcttaaaaaagcaaaggacatgagagaagtaatattgttgcttgaaatttcattgcttatatctaaaagaaactcctatttttaagagaaatgttgaatctttgcaacgtggtagacgctcccacaaaactttctcctgaaataggagataaatgttggaaagaggcaatgtattgagtatgctgatagaggtggagttcagagacaggcaagcatacataagagtcaggatgtttttcagtattatctttacaaatgagtttcttacagtggtcaatgacaaaccaatttcattcaaagcttgcttcaataggcaatggtttgatgccaatatgttagctatttactttgaccaccgtatgcattaaaaagaagaaaaattaagaatactcaagcagaacctccaacttagatagcactttccacaaaaagtaatggagggatagactgaagttaaatgggatcaggtatgtgatgagatctcagaagtgtttgcacaataatgcagatactcattttaaacagagtcataaggattggaactaataaaaataatagaataaaataccgatcaagaatgtgtcctcctgcgtatctgggttttgaattctggctccacagaacttgtcagatatatgacattaaacaagatacttcaacattctgtgccttcattttcttagctgtaaatagagattttactagaactctataagattatcatgagaattacattaatatatgtaaagctttagacatagtatatggcacctagtaagcactcaattaaatgttagttaccattagtagcagtgtagaattaaaaaacaaaaactgcaaactgtaagttaggcatctggctctgcaaactagtggaattccccagaccttattctggccatctgtaaaatgaaagggttgggctagatcatctctaaatttccttccaacttaaaaaacattgttcaaaaacacattttaggagtacgcaaagtatttcagcagaaggcgatgttttagcagaatatttttaaaggcacttaatcactttcacaaaaaatgtgtttcatggcttgtacttcctcctctatcaactcctgttgggacttcacttgctgctattccaccgaagtggctccagtcagggtcacaggatttctacgttgtcaagtccaatggtcacttctttaaacctttggtacacccagtagcacttgacacatctgaatctgattttttccttctttgtccagtcaccagcctttttttttttttttttttttgagagtctttgtcttctaggctggagtgcagtggcgcaatctcggcttactgcaccctccacctcccagatttaagggattcttgtgcctcagccgggtgccaccacaccaggctaatttttgtatttttagtagagatggggtttctccatgttggccagtctggtcttgaactcctgacctcaggtgatccacctgcctcagcctcccaaagtgctgggattacaggcttgagccaccccgcatggccgagattgtctttttaataaacattttattttactcctctacttaaaatcctgaaatggctttccatgacgtttgtgatctagacacttttgatcttattttctaccatctcttcttgttctttgcagtcccttcagccacactggccttctttctgaacttcaaacaccccaagcttattccttggattggttagtacctttgcttagaattttcaccttaaatcatggctggctccttcttggcattgtttcagtatatatgtctcctcctcagagaggcctccctgattaaatagtacccacttcacttagtctaccttgccctgtttcatattcgtaatgaaacggtcttatttttaccatgtctatctccctcaaagaaagtaagccccatgagaacagggatattatctagctcaatgccaaggacaggtcctcaataaagctatgaaggaaaagataaagaagccagttccccttgcatcatgttcaaagtgttctctgccttccctaaattttaatcacccttattgtcagtcccacttatttgatatcacacatcatcctgtattattatgaattttttcctacacatatgtcttttttctccaatcatatgatacttgtgggatgagactatgagacatttcaggtgtctcagaagtgatgagcccttgttcacaattattcactaaatgtatgttaaaatatttaaagggagacaaattgactagtaatttacaaaaacctaaattatgactggtcaaaaggaagaaaacaaaaaagtgcttaaatgtttcaatgaaaacatgtccatccaatggtttatattttcctaggcagtgggaaaagaatgagagttggacttcagtttttaagtgggcaacccaaattgttttggttctttaaaaaaattggtttgttacttatgttaggaacaatctctctctagtctaaatagagatctaaggaaatgcaatctaaagaaaatctagtcttggttgaatatattttactttacattttacataccttattacagcgagtactcacaggcaaaagttccattgtatacattgaagtcaacaatcatttgtcttttctggacttgacactctgccatgactccccaccattgtacttactggttcaaactccttagcaggtcctaccagactgtccaggattaagtctttattcacaccttagtcttacctcttattctgtctcccttcaagatcctcttttgtccaatacccaacagacacacattcggctctagacacaacaaaaaaggcaggccccctaatgaactctaccactatcccctctacactgttttctcttacacatcctgatctcttccccacctacctagttagcctggtttactctcctctattaggtttttgccaaactgcaattacttttgcaccaacctaatcatcttctctagcaggccttccctacccctgcctaccttcttgcccagattgaatcaggccccatctatggattctcatagtacctgtgcttacccaccataaagcacatatcacatgactgaaatttccttacccaagatcaaataaatgaatagcccaattcatttttttaatactatgctataatatgaaggtttatgctcccccttcaaattcatatcctgacattctgatgcccaaggtgatactattaggagacaaggacttctagtgctctgttgttcctgatcttagatggaaagcattagctttttaccactaagtataatattaagtttagatttttagtacatgctctttatcaattttagaaagttcctttccattcctatttttcttaaagttttaatcatgaatgggtataaaattttgtcaaatgctttttctgcattgattagtatagttatatgatttttctcttttagcctattaatatggccagctatcttagctgattttcaaatattgaaccagccttgtgttcctggaggaagcccatggttctgccctcaataataaaatcagtgcccttagaaaaacagcctgatagagcatgtttgcccttttcaccatgtgagtacacagttaaaaggccccatccataaggggtgggccctcaagcagacaccactagcaccttatcttggtctttccagcctccagaacagtgagaaataaatttctgttgtttctaagttaccccatcaaagacattttgtttcagcagtcagaacatacaaagacaccctataataccaaaaacaggcaaaaatgtacaaaaaatgaaaggtttaggccaatatcctttatgaatatgcatacagaaattattagcaaaatattagcatatagaatttacaatatataaagagaattatactccatgactccgtgaccaagtgaggcttattctagggatgcaaggctggttcaatatttgaaaatcaatgaatgtaatcaaccatattaacaggctaaagaaaataaatcatatgattaatcaatgcagagaaagtattcaacaaaaattttataccccttcataataaaaactcttaaaaaaacaggaacagaagagaacttcccaaaattgataaaaaacatttactaaaaacctacagctaacattatgcttaatggtagaaagctgaatgctttcctccaaagatcaggaagagtacaaggaggtgactcttgccactcttattcaaaatggggatagaagtgctagtctgtacaataagtcaagaaaaagaaaaggcagggagaatgaaaagatcctaaattaaaacataaaactatgaaacttgcagggaaaaagcacagaaaatctttgcatctagggctagacaacttttagatttgataccaaaagcatggtccaaatcaggaaaattgataaattgtgcttcatcaaaattaaaaatcttttgctctgtaagagatcctgtttctctgttaggacaatgaaaagataagctatagcctgagataaaatattttcaaattacatatctgataaatgagtgcataaagaagtcttaaaaactcaatagtcaaaaaattaaaaatccaattagaaaatgggcaaaaatcatgaagaataattttgctgcagatggtgtacagatgacaaataagcatctggaaagatgctcaacatcattaaccgttagggaaatccaaattaataccacagtataattacaaagctctcagaatggctaaaataaaaaatagttgactacaccaaatgctggtgagaatgtggaaaaattggatcactcatatgtttctggtggtaagataaaatagcctggacactgtggaaaactgttttgcagtttcttaaaaagctaagcatgcaaacaccatacaactgcactcctgggcatttgtcccagaaaaattaaaatattcacaaagaaacatgtacatgaatgtttatagcagtttcattcataatagccacatacagaaaaaaaaccatgtgtttcttaatgggtgaataaaccatggtacatctataccttggaatactacttgtcaataaaaaacaaacaattgctaaataaaacaacctgagaaaatctccagagaactatactgagtgaaggaagaaaaatccccaaagattacacactgtatgtcatttatataacattcttgaaatgacacaatcacagaaatagagaatactggtcactaggcattaaggaaggtgtggaaggatgtagtgatgggaggaaatgtgtatggctgtaacagggcaacagaggcatcattgtgatgatggaagtgttctgtatcttgtgtttttgaatgtcattatcctggttgtgatattgtacttagtagttttgcaagatattaccactgaagaaaactagttaagggtacacaggatttttctgtattatttcttataagtgcatgggaatctacatttatctcaacataagtttcattttaagaattatatattttctgaatctttaataatgtgtcaactagaatttaactgggtatatttttatgatagaaatctaccttaccatgccctttgtcacttgagtaatcatatattacatgactcaaaggcacagaaatccagtaagtaaagaaaaaaggtgtctatttatctggagacagggtctcactctgttgccccagctggagtgcagtggtgctatcatagctcactgcagcctcaatcacctgggctcgatctcctcctgcctcagcctccccagtagctgggactacaggtgccaccacatccagctaattttttattttcagtagaaattaggtctcactctgttgctcaggcaggtctcaaactcctgagctcaagcaatcctcctgcttcagcttctgaagtgccaggattacaagtgtgaaccactgtgcccagtcatggttttttctgttgtcgttgggtttttttggttgttgttttgtttttgtttttaagacttgcactgtcacccaggctggagtacagtagcgtgatcctgagacactgcaacctttgcctcccaggttcaagtgattcttgtgccttgccacctgagtagctgggaccacagctgtgtgccaccacgccaggctaatttttgtacttttagtagagatggggttttaccatgctggctaggctggtcttgaactcctgccagcctcattttaaaacaaattttctaaccaaaaatatactcacaggttgaattcaatggcccagaaaaaaagtgaaagtataattgcctttataatacagtgcaatagaccatagaatatttaaatctttaaatggtttggcatttccattgaattgtttatattctatgcagacttgtattagtgttaatccattagcaaacactaaaattatataagtgctattaattttattaggaaagaaagaagtgtacttctttcttctgatatgaatcatggtagcgcttggatgaacattagagcctatccagcacaattttttcaccttaagaggaaatggaagtagttgaaatttaaatgttgcatcaaagatgatacagctaatatccagcacacaaagcctcctacattgattcttagatatacttagaagtcacaaatgcaaaagccttttactattgttacaaaacacagcaaggagatatttatattctgtatcgtgtaaagtcatcctggagttggggatccagcctggaattgctgggcatcagggacagtgaagttgtgcaagcatgtacattgtctaacgcatgctcgaagttatatttatcttcaggacatccgatttgactcacgttcattggtcctatatttttatcggttttaattaactatgtcctttagcaatccttacctctatctttcccttttgcatgtgtcagggtaatctcaagtataagtcacccagagaggaagaaaatattttttgttttatcttatgtttgtggctactaatagcagtattaaaaattaaagtacaacaaaatatataagattacagaatcctaggaaaataaaataggaatgtgaaaacagatctaatgaggtattaaacctctagcagagagcccccaatctcttatcatgtttctttaagtcattagaattgtcctgcaggctaaaaagagcttcgttctgatgatggccccaaatgcttttttctcccaatgatgtcaacttgcaaagtttggcacgttctcttacaacattctaatgtccattaatgacctcttaatgctaattggtacacattataccatctgtaaattttaacacatcatgttattttcaacaatacttgtatcttcatcctattctggtatcagataaagccaaccaggcaaaggaagccatcttaaagcaacactggtgtgattttgctcagtctgagcaagagattctttgctgaaaaaaactacacctagatgggtcgtttaattcaactttgtgaagacactaaaggattgataatggcaaagcaggttacacaaagtttactgcctatttgatttaaacaattatttaggtgtagataagaaaatacaacttacaatgggtttgtgggatatagtttagaatttgctctaaagaatctgggatgactataaccagggccttggttccagtctagcctggagtcccttccttgtgtcatccaagttcacaatttgtctttgtgtgtttggtgcagcttcagtcacagttggggataaattgggattcaatgttcacattctgaatatgggtccttgttatatacaaaaatgtttctaaatctgttattggtaacacagtaaatgaattggattaggaggtcattattaacaggtctgacatctgtgggcctgtctagcagacaggatgcaaacagacaacagagagcctcaaggaaacaacaaacaaaaatcaacatgaaacaaaaatatctggccataaagatgcagaagatgaagactttcggagtagacttgtaaattggagcgaacagtgggtccaggcacagtgggagccccacccacaccccgtaacagtccttctaaccttccccatccaacattcttgcctaccctgacagggaaaggactgcagttaagggtccagtcctactgtgggatttctcctgggagcgcgctggtcatgagaagtgaatagagtttctcttcattccccacgaagagagaagagccccaggggtcggtgaatctgaaggatcagctgcagcagtcggaggagaaggtagagaagggcgaggctgacctacacctagacagaggtgcccagctcttatgcgagcagcaacagggacctagagccagcctgacgctcaccccaatgcacacacaccaatcacctgcggaggctttctcctggatttcctcctaatccaagatgcaaggctcaaatgttaaaatattaggtattgctccaaagttgtctcactgcttagaaatgcctgagacatcctgcagggggccgacctcctctctcatcggtgctctcagcccctctgctctctccttccggttggtgctctttgagcagctaactccactttctgattatcctgaagtgaattcctagttggaatccaggtggaaaaaaaatctaacagccaaaacgtggactccttaaggttttgtgcatacaagtgatgtgaggatgaatgaaaagaaaaacatttatctggtaactaatgtttttgtttgtttttgttttttgagatcgagtctcactctgtcgcccaggctggagtgcagtggtgcgatctcagctcactgcaacctcctccttcccaggttgaagcgattcttctgcctcagcctcccaagtagctgggactacgcgcacgtgccaccacgcccagctaatttttgtatttttagtagagatggggtttctccatatgggccaggctggtctcaaactcctgacctcgtgatctgcccaccttggcctcccaaagtgctgggattacaggagtgagccaccatgcccagccactaatggttatttttttaagagataaatagcaacgactattttttgtgagaagctgtacttgatgagttcttactaaatttaaatatagaaagtattagctcatccaatatagtaaatcccatgtggacaataagtagttcagaaacagattaatcacattgaaataattattaacctaattcttttaaaattattaataaccattaatattctcttttaaaaattcatggtcaggcgcggtggctcacgcctgtaatcccagtactttgggaggccaaggtgggtggatcacttgaggtcagaagtttgagaccagcctggccaacatggtgaaaccccatctccactaaaaatacaaaaattagccaggcatggtggcatgcgcctgtaatcccagctactcaggaggctggggcataagaattgcttgaacccaggaagtggaggttgcagtgggcagagatcatgccactgcactccagcctgggcaacagagcaagaccctgtctcaaaacaaaacaaaacaaaaatgcactaaactctttcataaccattctatacttaattctgatagcaataccactgggcaaatatttctattcttaccaatactttctacctcaggaaactgtgtgttctgtgaaagtaaagatcttggaaaactttttgtaagtctagactgggtgcctaggcttagtaaagcattcagcaggtagttggtagaaccagtagctgaaccaaggacttgaaagtttattattcagtttggagattagaaaatttatcagctacaaatactgtgaagactaattagtaataagcttgacattttactaaatgccataactctttgtatttcaacttccacttttattcttatcagctgaataaaaaatttttgattccttaaagataaaactaatgaatatttctatattaaccataaaaatattaacattctgcaaagtaaggtttagaatggcatttcatcagaaattaaattgagccagttaatgtgagaagacttttatttattctgtatgtatttttttttatgtaggaaagaattcagttagcttaaactcttattcagaaaagtagaagaacattgcatggtagatccagaccagagtttatttcttagggaaatatgtaggtgtaaaggttgggatatctgattaacaattcataaaccttttgcagaaatccctatcacttaaacataggaatacatttgtcattccttaggacttaatatttacattaaatgaaatacatttgtctgtttttccttgttttttattattattaatctcttggttctagagagacaatatggcacaactatttcacattgacctaggatggctgtgcctttggacttcataccaggctgtcctatgattcattaagcattctcagccattctcaggaaaggattttctgcttctccataaccaagcattcaaaagatgctgacatgccacagtcctcacacttagattccatatctatatcactgatgtggtcctagaaacttactaataaccaaaatttacagatctaaatatttgttacctttggccacaatgctgctctctacccagatctgtcactgtcaggacctgagagtttattcaaatagttgaacagctagaaaggtggtaccacttgttagattgctttatagcctccaagactatggatgaatagttttgaaggaatgaaccatgagtctcctcctggcaaatcttaaactcttatatagttgaatggtatttttatattggccataaaagtgtcgtctaagtagtttttaaaaactttattggaggatgtcgtattttaggaagtatttgaataatagagagtgttttcaaactggaagaccaaagaaggacataaagaaaaaaatggttccaagaacagatgtaacttgaaaaaagcatctgaagctggagtcgaattatcaggcaaggactgtaaatatatttatctaagacaagtggtctttgatgaagatgaggaatttataaattaatagagataaaaaattagttaaaacactctaaacccttagtactttgaataagctatatgcattccttttagttttgttatgcatagcattgaaaagaatggaatgaaaggagacatttgaatgtatttaagtatcatgaaatgatacttgtagtgcttctaaaatagataattgttttatagtataagtgacagaaaacaaactccccaaatagaagcatgaaatccatttgaaatagctaaatcagccaaaatttgtattactaacttgaaatacgttcaatcattttgtcaagcacatattctctttattttcttgacttggatatttgaaggaagatgtaatccatatggtttttattcttttacacttgaggtattaaaatggggctcaaactaagtattcacatatcaagagccagttatttctcttaaaacatctcttttcttggtgaaagtaattcacactatattatagcccaaagttgttaattcatacatcaactcctagtccagaatacacatattctcttaacatatcagaagatgtttcaagttttacaaacagccatccagcacaattaaagataagttcttgccttgtctgtcactattaatgaccactacaagccatgacaaaaatcataaacaatcattcctatttagctctgaatttcaaggctcagtacattttattatatatatcctaggatatttcagatttagaagttcctttatgcctcttattcagtttttataattttatttttatcaaatatagaggatgctgccatatgctctaaaaggcaaacaaaataaaaaacaacacaaaaccaaaacacataactatttatgagtataaagcctcatctaacactatagtatcccttgatttccagatcagcttgtcttgttcattaaatttattttatttgcaatgggttatgtcattcccctcctcaatagatgtcttcattgccattttttgtaggaaaaaaaaaaaaaaaacagagaaaagaagaaagatcacgttgcagcactgggagcagatatcacaggcttccttgccaacagacttcccgaaggcacagttggcacattgtctgagatgacagacaagatgcaagggactcctgtgacccttacaggggaagcttctgctgtggctggtaggatggtagctttaactcatcctccataataccaaatgtcactttgtgggggtagccttctggcattgacacttgtttttgtatgccatagttcaaagtaccacactacgaaatagctccagaatgtgccttgtaacatttagtcacaataagggcatttacattcttcccaaatatcctttcaaaaaaaaaaatcagtagattcacactcttgagtgagatgcaaaattgcaaagggttcaagatatgttcttggtccttagaacagaaaacatattcttcttgtactctgtttagtgagttcagttaaggctattagtttctgagctgttttataagccaggagtcggcccactgctgtctcccttgactatacattcaataaatagaatgtgattatacaaaactaaattttccagaaccattattgaaagtgccataggaacgtctaattaataagaatactatagaggaataatcaggatattacgaattaaatcctgtccctccaaaagatacattcaagtactaagtcctggtacctgtgaatgtaacctaatttggaaatacagcctttgcaaaggtatttcgtttaaggctgtactaaattgggggaagatgctaatccactacgactagtgtctttatcaaaggaaaaaatttgtacatagacgtggaaacagggacacagaagaaagaacattatgcgaagacagaagtggagatcggggttgatgctgccacaggtgaaggaacacctgggctacaagaagctggaaaaggcagggaagggttctcatctcaaagtctttgaggcagcaaggccctcccaacaacttgattttggacttctaccctccagaactcagagagaacaaatctctcttgttttaagctacacagtgtgtggtattttgtggcactccaggcagctagaggaataagtctttgaagcttgcaagggagttctggtggtgtatcacagtgtccacctcaatggattaatttgtagtcatcaacataaataaatctggatttttaaaagggatgaagcgtgttttctgataaactaaaatctctatgttatatagaagacgcacaatcactaatgaagatacacttacacaacctaagtgccacaaagaatcctcttccagaaatatccttccaggagaggccatctctcaagcctactatttgttacactcttcactgtaaggattgcataacctatagcccactgaatgtgaagaacatgtgcaaaatcctggtatttcaattgttagcgcttttcaggtatggctttataagacaagcactgatgacaaccacttatattcaatacaaagagttttgtgtttagccacttgagaacagggattactttagatagatcttagtattccaataaactggcacagtatccaccacatagtgagtgccaaaaatggttgaggaagttgtagacattaaatatgtgtaagtggttggttaaacatgagggagataacctgtaactgaaaaccgagtaaaagtatttaatatcaggttggtgaaaaagtaatcgtggtttttacaattacttttaatttacattactttatatgtatgcaaacaacatagtttgcaaggatattcacatacattatttaattttcaaaacaacagtgtcaaatagatattattgtgttttatggacaggaaattgaggctcaggtaatatcaagtgaaatccccaagatcatataattaataaatactgtaaaaacggtagaagtgactcacatttccaatctccatgctatctcatatactctaattgcctcttggggaaacataggctggaagaagaccaggcctcattgtaaactctcgagtgcccagaaattatttacttcaactatttctatcacagtttgtccactttaaatggggtagagattttctgaaacctcctttctcatttgaacaatctgagaatacatgtgtttaggcttaaatcataccagaaactgtcaggcagaacagtccctttgtaagcccaaggattatacaactttagttgtataatttagttgtatgattatacaactaaaattttaaccagatacagtcccaaatgaattatgttaattcactctattatttctctttttaagattacagaaattttatgccaattttatctacattatgctgcaatattctaaatatccctaattaaataccaactattttgatgaaatattttctttaaagtcatcatttattatcatctgatatgaaaaccattcctactagacactggatgctttaactgcccagcatctctctaatatgaagtaacaggtcctgaactctgcccctaccagcatgtccttcaaaatcatcactatgggaggaagcataagaacaatgcagctgtgtcttctgggcccaagcttggtgaatcccagtactttcctaggaatctggaatttggacctgagaatcagagatgtcaggggtcattcaagctgcatcacataactgcagtgttctaggaaggaggtccaggatgcctggctaccaaattccctgaagctcgtcgtcttaatataaagttgcttgtaagatattctgaaagactagccagaaataaatcagccaaaaactaattctgagagcataagcctgaccagaataaaatttaactacctcattacaaatgaaatttcaaaactcatttggacatttcataatgaaacccatcatctatagtacaagccatgctatggatgacaaaaaaattaataagtcacacttaacactattgaactgtatacttaaaaatcgttaagacagtaaatttcatgttatgtgttttttatcgcaataaaaatttctttaaaaccatcccccaaaagtaatatagaattaacatactagttatgaatatagtatttatccagatgaagtttcctctttccagttgatgaggatttaaatttgttggtcatgacaaagagatgaggctccaaatgtggccctgaataataataaattgtactcttgaagaaattgatatacactagcagtgatgtgccggtcaaagtttaacaatcagctctcaaacaataaaaaagctctgattttgtagcactggtcagtttccatgatataaatattcccatcatggcctatttcaagctatttatgtggcgtcagtcaacacagagttgtgaagagatgcagacaactggctctcttgagagggcttcagcataccacgggggtcatggaaaacaaaaccaccccagatatctcctgtgtcatttcatttatttcaggctcaaaatgtattgatgtaaggaaatgagcctaacaagtatgacgtggctactgtgtgccagacccatttaaaatgatctaattttataatgttatgtataccactgaattgtacatttaaagggtgaattttatggtatgtgaattatatctcaatttaaacaaatgttctgtataattcctcatcacacaattgactatatttcaggaaagatttttttccatattaaaaaaaaatccttttaagttcgcccaaatgaaagattgcagacagtgaaaagtcattatctttttcatcatgggcactgttgttacctgaatgcttacctaaattgcatgctgtagcagtttatagtgttcacctctggggcacaagtaacaagagggtaacttggaagtttctcctggtagcttaatgttagggtgcagtctgtaaacctgtcagctctttgcctttcataaaaactgatgttggtatttgtagaaggttattggtcccagcaagaatcacagtcgataactgttccagttgtgcttcaaaagaaccaatgatgttatagaagatgagagcttcaatttttatctgtatgacaatttaaatatatttaaccattcttttagaaaattatattctcattattaaaacaatgatgcaagttacaatactaaaatcataaaattctggactgaagaatgcctacaaatttattctgacatatttcttttatagacgaaaagagacgccgggcgtggtggctcacgcctgtaaacccagcactttgggaggccgaggcgggtggattatgaggtcagaagatcaagaccatcctggctaatacggtgaaacctcatctctactaaaaatacaaaaaattaggcaggggtggtggcaggcacctatagtcccagctactcgggaggctgaggcaggagaatggcgtgaacccaggaggtggagcttgcagtgagtagagatcgcgccactgcactccagcctgggcgacagagtgagacaccatctcaaaaaaataaaaataaaaataatagatgaaaagagaattatctaataataacccttttctcttcaaaagagaactagaactagcaactagagaactcattagttacttgaaccctggctccagcttcctcctcaccaccctgccatgtggcattgaaattcagaacgttttcctaaattcctaccttaatttcccattccagaaacagcagacttcttcaatgaaatcttctctgttttgtacattttcagtatagtagttcccccttatccacggttttgctttccacagtttcagctacccaggacaccatctgaaaataagtgagtagaatatattaagattttttttgagagagagagcatattcatgtaacttttattataatatattgttatcattgctctattagtgttgttaatctcttactgtgcctaatttataaattaaactttatcaaaagtgtgtatttataggggaaaacatagtatatatagtgtttggtacgattcaaagtttctggcatctactggggatctgggaacgaatcctcctctgttatagggggactactgtacatctagatatttacatcattaagaaacaatgcttggaacatactaggttatcaagagttaatgcatatctttcaacttaatatgattcggctctgtgtccccaaccaaatctcatctaaattgtaattcctacatatcaggggagggactagatgagagatgactggatcatcgaggtggtttcccccatgctgttctcatgatagtgagttctcaggagagctgatggttgcaaagtgtggcacttcctcttgtcacacttgtgtaaaaggcacctgcttcccctgtgccttccgccatgattgtaagttttctgaggcctcccagccatgcttcctgttaggcctgcggaactgcgagtcaattaaacctctttcctttataattacccagtctcaggtagtattctttatagcagtgtgggaacagaataatacacaactctcaatttctcacttctaataatgaaacttacaacttatgttgaatctagtgtccacagtttcaactataagtttgatttcatactattcaatatatatgaatacacacacattaacatatatatatatctacatactacctcaaacagttgtttttgcactggttctgcctttaaaggtaattggcggctgggcgcggtggctcacgcctgtaatcccagcactttgggaggccgaggcaggtggatcacctgaggtcaggagtttgagaccagcctggacaacatagtgaaaccccatctccactaaaaatacaaaaattagctgggcatggtggcatgcacctgtaatcccagctactggggaggctgaggcaggggaattgcttgaacctgagaggcggaggttgtggtgagctgatatcgcaccactgcactccagcctgggcgacagagcaagactctgcctcaaaaaaaaaaacaagtaattggcaataaggtataaaagttgacagtgttacatgctagtcagcaaaaggaaaattttagattccaaccatatcatcaccaatatagctagtaatagtggctaaacttcctggagcactacatttcataccttaaatgattgtcataattttaaaagtaggagctcttattaatcccattttttactcaaggaaattgggaaaaagaaaaggtagcttgcctactactacatgttgcagcccaaccttgaacacaggtagtcatctctacggccttgggcacttcatatgaggtctacacagccctcatcaatgaggtctaattagccccaccctaaccttttacagttgcaaggaatgctttctgaaaagcagatgaagtactgggggctaaggaggagtgatggagatgccagagaacagaggctcctacattccttccttctctccctcattccctctcttctagggatggaattaatgtccatctgcccctacagtccacaaactccttaggagcataactataggactttacggtattcggcattgtatctccagcatctagtataataccaagcacataataggcatttgatatttatggaatgaatgaatcctttcaggttttgagtgttaaatgaaaatgcacaggacatgaagaatttgccacaatatctgacatgttctaggtgcttaataaatattagttactgttattctactgttcttatctactgttactattatttgtctatagaataaccttaagcagagtaaaggttctatttcattgctccattgtttattttattgatcccctgttacctgatctttaaatgggtcccattttattcacagaacagagtcaacatgagtgtgaggacggtcattattattctcaacacacatgcaacaattacttttcaatgaatttttagaagtgaaattgctgggtcaaagtgtatacaaaattctaaggcttttgatttttataaagagaaccacatttttaaaatctctgataaaagttaatcatcatgactcaaaatagatttgccaatctattaccctggaataaaatgattcaatagaagagaaaagctatttgcacaaggagatttctttcaactcatttcaattgtcaacaaatacaaaattactgaaacatccagcaataaggtactgtttaagttactatacatcagcataatggaatattatacagccattaaaataagtctaatgactatatagcaacatggaaatgacagaaacatggggaaatgtttgacactaatattaagtgaataaggagaacaaataaacactgaaagaaaattttcaagactaaaaacagtaatgatgagtcatctttttcttttccaaaagcaattgagagaagtgaccacattctaataagccttttatgtcagacaggagtgggccacataaattggatcattctgtgaaatcaaaactaaggttcactatttttaaacctgccattaacgtgtactacatgttagttggcaataagtattgtaaagtaattaatttaagatgttaaaaattgagtttccaacaaattagcgaaactgaattataaattcattcttctcacatctattgccatcagccttttgtgttggtatagcactttgtgttaacatagcagtcagaaggcatggatggtatttatagtgtaggctattaaaatactgtagtaatgcaatgaagaatatccttgttctaatcatctttctttctaggaagctggttacagcccacttgagttctctttaccacctctggtggggagagcatggggatataagtcctttctatttctgcttaattatcaatggctcaatcttaagtccaggcaagaggcttttgagcaagtatcaaaaagaagtacttaaattctgagcatggagccattttgaaagttggatatccttgtcaattacctaacatcttcaagtcttcacgtcctcagctacctatgaaaataataccacctaatgttatatagaggctgtgtggattaaatgagagaatagggcaatgagcctgccaaagagaaggcactgccatgttcatgccctcccctttctatgctgcaagtccatagcaaatgctcctcagtggctcttaccgctttcaggtcaaggactctgggaattttagggaatctaaggacccactatatagaaaaaaaagcagacccactcacacaaaatgcagcacatgatttcaagggttacacaaacctcagggaggatcttccatggactgcctaggcttccacagatcaatggttaggaaatccttggtcagtacaaagtccccagggaggaacagtgaaaacaagtgtggaaaatcacaagaacaaagagagtgggaggtgaaggattgaaggaaaaaaaaataagtaaaagaagataaatgaaaaatggaagaaaggaaagatgtggaaacttggttcgggaagagagaatatgtaagaatatggacccatttgcaagccattgtccctgttgtggccttagaaacatttgacaacaaaatgtaccctaatcctaaatataatcaaattctaaaagccaaattgaccttccagatgttgagggtgaataattaaagtcagtcctttcccagccccacattcagtgcattatactgatgaaggtttgcttttgtgcttggcttcactgctttagaattacagaaccaccatttctggaggcttctttgaaccacattcacaaacagattagcttaattatttactgctttcctaactcagatgaaatggttctgttaagggaaaaaaagttactcccagaaaagacaagacaatatccaagccaagtgagagctctctgctgggtctttgctgccctctttgttgccgtttcagcccagattcaaaggcacatttctggcgtatctgttttcctgctcttctcccttccctattgttagccttcccaaataaaggaagagggcctacttcaccatgcaccctcagggctggagtcagcagaccccaatatagtggcaggtctcccgtcactctcacatggccttgtttcctgcctctgggcataagtagaattttctgtcagtgaaaccaccagaatgggattttaccagggttcatacttcaacccagtggttccccaccagagaccattttgcccccagaagtcatttgcaatgattggaaacatttttggttgtcataaccagtgaagaaagagaagatggaatctggtaaggaggggccagagatgctgttaaacaatgcacaagacagccccctagcccccaccacaataataaattagccccaaatctcaataatggcaaggctgagaaacctaactccaaagttagaatatggacatttgagagagatgtttccatccgtaattctcttgcctcaactcacaccaccacagtatttgtctaatgtgtctttctctttagctacacactcaactctcttatgaacctcgaaacttcatttaagtgggttctctaaagaaaacaatatagtatgcttccctattcttatgagtctggtgcctaggaagaaagatgactgaaataaactccaggaaggaatccccagtgccacttaagaaccaactgagttcgaaaagatacttaatctctttgagcctgaacataataagacagtggatcttgcaagggtgttgggattaaacaatatctatctgtgtctgatccagtgcttgttgaaataggtgctcaataaatgctattaatacttaatatcaatcgactccaaagtgtattgtacatcataattaacctgaggatattgttagaattcacatgctcaggccccatccccagaggttctgattttctatgccaggaatgtttgtctagcatctgcattttgtagaagacaccaggtggttctgatctacctaatccatggatcacataggacaaacgctgttgcccaggggttggcactgaacttccccaaatattctgaaacagacacactggttccttaacctccagaaaggtggcaacactgggacattctttcttgcctcccttttctctagaatctaagtttcaggataattaatctgatgagttatttttcccaacatgatgccctcctctctctctgttagctacagactcatggatgtttttatctcttattctgaaaagaaaatttggccaaatgagccagcagataacaacttgggaaagaggaactgatatatgctgacttacccttggagagtatcacggtgtcaaaaaaaaaaaaaaaaaaatctggctttagtgtcaaacagactggagtttctatctgagccctgccctttgcttaccctctgagcctcagcattcttaggtgtaaaatggcaatgcaaacacctatttcctccactagcaggtgttctcaattaactgctctgcatgggttggtcattctgggattagttcctcttgtatatggccaacaatacaagttacatatccattcttccttttttgctaccagaattccagcatttagtgaagggagggagacagcaatgtacccagtttaaaaaaacaacatccttcatccttatttgcagctaggaatggccatatgacataattctgaccaagaagacccaagatgaattcagctgagggtttctaggaaagtagtcttttctgtccccttcttgttgctttctccttttcttcctcctcttattattattcctctttccactattggaatgtgtgaggctaggggtggcgtggccaaattgcatctgtgatgacgaaggtccatgctaaggatgatggaacaagaagcctgagtccttggtagggtccgtaaagcagctgtatcagccttatactgtccacccctagacttgatgctacttgacaaaaataagcctctgtttaagccactgttattgggtttcggaatacatacgacaaaacataatctctaaccaaactactgcccctggaacagaagtgcttcatcccagccagaagatcactggcactggcaacatccagcctttctaggttaagcctcttgtttttgtagctctcctctttgcttggacttttctaacttggatctgccccctggaatactgtgctgcaaactggtttattgggtgatttttttctacctgctgtttgccctaaaaatctttgctctatttttctttctgaactcacttatcttcctggttctgatgtcatttttctgccagaacgaaatgggtatgtccctataaggaaggtcttcagagctgagattagggcatgcagtgaattgcaaaggagtaaaatttaaggaggcactcactcgcaggtcgcaagtgaagggttggtgtgttaagaagttgagtaagtacctacttaaattgcctcacaagcctcatcctatttgccctagactgactgtcctttccctctacacctgtccaggcttgtccccactaccgccttcaagttcagtgcctttccaactgaagttttttactactatctttttgtgaaatctctatgatggatacagtgtttatttaatgttatgcaatagaattgaaaataccagaaagcatccgacatagaatacatatcattacttttgtttcagctatacagataagtatgaggtgtacaagtgcattactaggtaaaatgtaatactctaaattatagttcaataatttttttcaattctttttcctggcctatcctccgcctccatccaggtgtctcaccttctactcaccatacaagctatctactaaatttcacctgaaaacttagcttacataagcttatataacatttagcatatattagctacaatgagcttatgtatgtgctgctatgtaatgtccccagccccccaaagtctaatgttgttcaaaattatggattccttcataaaggtatggaccaatgtatcacgagtacttaacagcttatctttactgtttatattataaaagattgttcaccttcttatgacaattaatatttccacatgtattcctttgaagaagtggacttgataattttagagttttgctatcacagtgtaggtcaagcctgtatttttatgttaggagcttttgggaacatcaacctagattttcaaaattttctctctgaaagagccacacctcaaatcttctaacgcttgaggtttctcagctctgctagaaaacataaaaggtatctgaaattcttagaaggactcaaagtaacaggaaccttgatttctaccgtttagattggcgctaaaatcttcacaagggcttattagggcttacgttatctattccatttgagaagctaagcatcacacaaagccaataaaaaacctaggagacatctactgtaattctatgtaacgtatgaaacaaatgaaatgtattatctgaaggatacagaccttaagactacaaccaagatgaggaagaaaaagtgtatgtaattgaaaatgcagcaaatatatcagagttacccaaatagctgatagaaggtaaagtacatcattgcaagatgtggcctaattgagctaatttatcacttttgcaccttggcataccaaaggcaattatgtccacacaagtaccaaggacaagaagatgcaaaaattaagagaacatttttaaaatttggatttctgatgctcgaagccctaattaaagtgttgtccactccctaagtaacaaatgcttgctgtacctggcatattttaggctctcagtgaatgtgtgtagaagcaatgaataaatatttgaacaaggatatgtaaattcagatacatttctcctttattttttaaattttagagacagggtggtcttgctatgttgcccaggctggtcttgaactcctggcctcaagcaatcctcccacttcagcctttcaaagtgctgggattataggggtgagttaccgcacctggcccagatacatgtttgatccttcatatatagcaagctaccaacaacaatttctggatttaaaaatctaaaagtattcataagagtatcttttccattcatttgcaatcatattggaattcaggagagtcaggttcatatattttttattcatttatattattccattaaaatgctatcggtaactaattgctctgtagaaagtaattgcatttgaagccatttgtaaaataagtctttcatctttcaagcaacaatttgttttgccaagaataaaactcttaaacacaaacacattacaaatggactttaattatgttccaaatgtgatttctttgcttatgttatttctatgttctgcatttgtatgtaacttgtactttacgttgtttctcttctttgttctcatgttagagaatttgaaaatgtggatgatacaaaaatcattatcatagtgttcagtggcctggtacacctacgacccccaaatttaattcaacatttatccagcatgtactaattgctctgcacgcacattaattgggaacctatggtattctagatgcttcacgacataaatttattagatgcctcctattggccaaggttcagagctgaactacatgctgttcctacccacacaaggttcacactaattaatctaccatcatatataacatgtgaaacaaaatgattggctattttactgctgtttcccagcttccagttgaatatttagacagttcatcttgagaagcttgttccatttgtccccaagctggatggttggcattgtgttcaaaatgttcttgggctaagatcatgcaagccctaacaagaaatgagttttccagaatcgtcaacatgaaacggcaagtaattctgtgctcacttttagcgtgtgaaacctcaaatgtcatttttctagttctctgggtttctgtctgccactgtgtaaataaaggggttggcaaggtgatactgactactcctccagttcgcattctatagttctatttagacagctcatttgatcactggacatttctatgtaagaatctatgaaacaagcttgctggaaccaacctcttaaaaagtccctgctctacaaaagattatcatgtccacccacagacaacaggaattcttttctggtcatcaaagaatgtattctccttgtttacagcagtgcatgtcatctctggtaacaatgatgctataaaggtttccaaagatttgcagcaaagtgtgacaatttgtgcaaggactatgcaaaaggcttaagttctatatgcatatagggttatttccatctctatttattgatacacatgcacgtctatatgtatttatgcccatatgtgcatagcatgtaatgagttatatatgcatagtgccaggactatgctcattttcacatataattctcacaacaaaccccaaagtgtttgtccagttttccaaaacaaaaaactgaggttggcttatagattgaacataatttgcctaaacttaacagtgagaaagtgacggagctataaagtcaagtttatccaactctgaaggaaggacactaaaaatttacattcatataaatataaggatttcacatgacataagttgttagaaactggactggtagaagattgagaattgtttcagtaagaaatatgcaaatcctgtaggcattaatttgctcctgaaagtctaccatccttatgctcatagagaagccatctatacagtaaggcaagactaaccagaactggaatacaatcattaagaagcaacatataaatattgctaagcttaccccttactagcaaggatgtcataacataaccacaacaatgtaatggaaagttaacatctaggaaagcattagcaacagcttaaaacacataaaacaattatgatggttgcctcacttccgtactttctttagtacaatttatggcaattcacattccacatgttctaacaccagtacacaaaataatggcgaaatctaggtttgtgaaacagcatatatacattgcttctttgttatttccaatatacttatataaccaaaattagtaaattactttaaataattatgtccagttaacttcatactgttggtatccccaaagcatcttgagagatgcaaacaatgctattaaattaacaaggagcaggtttgcatttcgctatgtaatattttagtgctaacataggatttccttagtaccctgctacaggaattatacctatttattctggggccagagaatttgatgtatatttaatgttagcctaagaaacataaaatatagtccatacgatatctaatgtgtttagttttctatgcatttgtatgggttattcatagagatttacctggagataaacattgtattaaaacatatgaaaactttaagttaaatgttttgctttccaagttactgaactggtttccaaaggactttgccattcagaaggatgaaatatataaaacacatacataacccttttaatatgaagtctaatcagaagggtggtagtatatttgtttctataagtaaaaaattgtggtccccactgatagggacaggagagagggaaatactgagtagacgaatgctaccaggaaagaccccagccttaagcctggaaacccacagtcctaaatgagaacaggcattcttgttttcacgcccaaaaagttgccttctggcctactacacccttgatcttgtacccatataaaccccgaaccccaagctccagaggcagatgagcagatgaatggcagagcggcatggcagagaaggagagtagagaagaagcatatgaacaccgagaggagtttggctggggaccgtcagagaggagatcggccactggacaaccaaactccagggtaagatcatcttcccactccattccccttccagctcctcatctatcccactgagagccacctccaccgctcaataaaacccctgcattcatccttcaaatctgtgtatgacctgatccttcctggacgctggacaagaagctgggtaccaaggggagtccactaaattgcttaacacttaagccgtctgtggactgcagagctaaaagagcaaatgtaacagtggggcttcaacagtcacaggcacccagccctagatgctgctgtggggccaaagcccaaaagcgctcaccctagttcgcacacctgcccatctttgtgctccccctcccataagggtttgagctagcagcagccaaacagagagccacatccctgtcacacgtcctgtgaggtggaccaggaaactctcctgtcttactaccagttgttttattaggtggcctctagcaggtggctcagtctttagatcagagtttctcaatgagaggcagaggtacaataggggatctgtcacattgctttttcccttgccaggtattttagaatcttgagattgaaaagagtagggcatataaatttttcaaattatattgagcattttaatagattttcgaaaacaaaaatattcttataacaatacagactaaaaattggtagaacctcaattgttggcaatattcatagattttatgatttcaactagggggtagaagacataacatgtccaggaggccattccatttttattttcactagccatggacatacatggacttactttttttaagaaacacaactttagatggcttttaaatcagctctaaacattctcatgctctgtgacttacggtttaggcactacaccttgattcctgaatatactattggattataactgagctgttttgcttttcaccctgagttttacaggaatttgagaatgctggtcagacaaaaaagtacgttgtactggagattcctgagatgattctaaaaccgtcctgaaaaacagtcatacaggagtagattacaaagacaacacctgctagggaaatatatatctttgagacatcttctgactaataagtctccctgtcatttgaaaatgaaaggaaaatgagatctggaagcctaaaatatcacaaatgttttggcacctaatattttggtgtgctgggcctggtctgactcacaataacctgcaagagtgtattgtgtacatctctacgcaacagcttgaagtcactcatgataggaatctttatgccactgaaattagcaaatgccacaaatcaagcctctcacctctacccccaaagatagttgttaaacatttagtaacatttatggaggaatgaaggaggattccttaaggatatttgtttttgagttttccatgtaataaaaatgccatagtttatggtttgtttattcaataactttctcaataatgtttatgaaggggattttgttttccacctgaatgagaaggcaaactgaagcatatctgaaactctgcatgtagttgtgcttcctgtcctcaggggagatggcataaggatagagatagagagcttcttgacagggacaacacacagcctgaaagagacgcctgagaaggtgctgggagtagtctcctctatggaataaggcaggcagcaaggtcaacaggtgccaccttactagggaagaaaatgtaggaagagtgaaaggaacttatgaattcagacaatgggtatcagcttacaggaatcattagcctgacaggtagtagtaggtgattcaaaaaaatttaaataaattaaaaagttgacagaggtacaaaggaagcaacatttcaaacatatttctcgtctctgaggagggtatttggaataaattcaattctcttcataaactatgcttttcttgccaaaacaaaatagatcacagctcttatccacgcaggaattcctttggtttgtatgtagaaaggtagctcatcctttcaacattatccagaattaaatgtagcctttataacccttggaaataacaatgtaacacttcttcataggtgagtaataaatgactttttccaaaatcaaccatcaaccacaaacacttggcttgcctagtgttttaaaactggagaatattaggacaggcttataatggcaaatattccagctcacatgcccacacaaaacctaactgtgcttttagggaaaatgaccaatatgagctcaaggacagtattttgttctatttaatacattgcaaaaatcatctcatatctgtaaaattatgtactatttctctctctagcttaatctatatcctgacctatccatgcaggagaactttctgttcccattaaaatcttatagagaatataccttttgaatgaaagtgaggtggggaaataagctaatgacccatgggttatatttctaaggtcttagcccagagatgacagagtacaggagaggttagctccagttggtatgtaacgaagctagaacaaagtaaggccaaacaacaaagccgatatgtgtatgcaggctgctaaaaatccagtgatcaaagcaatttaatgcttgggccccaagtgtttcctgttggtccagtggctgatgacacactgtctaataggatggcaacagggaaaattagtcctccaagtctccttctgttgggaaacaagattactctctctggatttttcagttccatctacagtgtggttctcaaacatgcctgtacactggaatcccttggggagctttagaaactaatgatgccttggccctagccccagagattctaatgaagctgttccaggttcagcctgggcatcaggatttttaaatgttccacagttgattctaacaagctaaagctgagttgttgattctgcggcacaaagagactaagtagtgcttctcaaattctacccttgtaggtctgagtagggtctaagattctatatttctaacaagctcccaagtgatgctggtgtggtccagaaacaaggctttgattaacagggctctagatcagcagccacaatgaggttcctgaagcagcaacaatgtcacgtggaaacctgtttagaaatgcaaattatcaagcccaaccccagatatactcaatcagtcatggggtggggcaggtggaagagtagcaaactgcatttcaacaagccctccaggtgattttggtgccagctaaaaaaaccaagggtcagagcggtattattcaaagtgtggttatcagagcagcagcagtagcattgccaaggagttcataagatgaattcaggatttcaggccccaccccaaacttgctggatcagaaactgcattttaatgacatcccaggtggttactatgcatattaaagtgtgagaagccctacagtcttggcaaatttcctcctcaaaaccgttgcccagaatgacagataaaaaaccactcatttgaaaaaaaaaaagcctaacgacaacgttaattataattgtaatatctggtaggtttctttttaattacaaaaagccccacatttttacagtgacaagttttaaaacatggaaaaacctcatcaaacaaatggaaatcacatgtgatcccaccaagcagctaaaactattgataactttattcttccatccaaagaactgtttctaaagagagaataaaaacaagttattgaaagagacaatattatcctgctccaacagacacttggcaatgtttcaactgaaactttcacctatcagtgtaacttcccagtgggttcacctagcccgctgcctagacagacctgatttatcaagacagtggaattgcagtggagaaagagtaactcacgcggtgccagctgtgcgggagaccagagttttattattactcctgtctcctgtagttaaagataattttgtgggtaggggcttgggaagtgaggagtgctgattggtcaggttggagatggaatcatagggggtctatgtgaggttttcttgctgttttctgttcctgggtgggatggcagaactggttgagccagattaccggtctgggtggtgtcagttgatccatccagtgtagggtctgcgaaatatctcaagcactgatcttaagttttataatagtgatgttatccccaggagcaatttggagaggttcagacttttgcagccagaggctgcatgacccctaaactgtaatttctaatcttgtagctaatttgttagtcctgcaaagatagactgatccccaggcaagaagggtggggggggtggcttttcaggaaaggactattatcgattgtgtttcagagtcaaaccatgaactgacttccttcccaaagttagttcagcctatgctcaggaatgaacaaggacagcttaaaggttagaagaaagatggaggcagttaggtctgatttctttcactgtcatcatttcctgagttataattttgcaaaggtggcttcatctttagcccaatgtgacaaaaatacgagtctcttgtttagaataatgttggttactgaaggagataccatgacatcggttcctgtggtcatcttgggaataaaaaacctctttgccatgtttgagaatgttgaaaccaagttattttgttctaagttagaaggtcagagctcagacttaaaaataccagccagtaatgaaaaacagagcggccgcatttaggttaccagcagtgaataaattcccagatagttgaaacaccgctgtatactggtgacctttaaacgtataatgagtaaatagtttggggggaaaaaaaggaattcacatggatctcaaattgtattctctttcaatctgtaacagatcagcttttctgttagaggtcagattgttaaaattttgacaaatttggctgcctagaacatctatggccttagctgtcaaatcagaagcctagcaaaagaaactggagctagactggtgaaaactaaaatttaaactgttgctttttgatatgattcttgctttagaaagctgtcaaggtattcagcaagtgtgccaattttcttaaatgagtctgaacttcaagacccttcccttacctgggtgaatatcttttgcatcaaatcccaatgtaagaatgaaactacacattgggataaggagctggaacaaatcatgctgtttctgtacaaagagaaaaacatactggactggacacagcacacagtgatgggaagtagagtaacttgaaaaccagaagatgaagagtttggagggggagtcagggctgggggttataatagaaaagacatgtggatggcaatgcctgtcaaagaggcaccaaggagaaggggattgccaaactgtgttaggaaaaaggtcactggatctgttagaacctgtggaactggttaattaccttataatcaatataataaaattacatgtgtggctatttgattatcattaccccattgcaaagaaatacaatgttaattttcttagttttcctcctaatttggaggacatgtttgggatggtttagttgaaaaccggctcatatgacatgtataaaattcactgttagaaaccaaaactgaggtggcctcaaaggcttggtaacaactgattaggagagaattgatattaatataaaacattatgggccaaaaaaaatgttaatataaaccctaacttgtaagtcccaagagtaggttttgacatattactaagctctatctcacatgggtaactttatccaaagaacttcaaaggcaatagcaggtacatatttatttactatggttaatatggaaactacctagtataaaattagagaagtctggaagggtatattttgcaaatggaacagaaatatcacactgaagttggtttaggtaaatttatcgagtcccctctataactttgaaaactagaaagtgtattcaagaccaaaaagaaattaaaaaagggtctgtcacagcatcactttgctgattttgagtattctgcagaataccagtgtatgtaacccttaatagccaggaagcgttgcattgggacttctgacccaatgttgtaggactttctccttagttcagctaaaaacggagtccttgtcatatgaccatgagagattaggctctcagacactttgaagagaaaaatggaatgtattgggcaaagagggaggaaaaaaaatgggaaacagtcctgccagctggcttcccacctcacagattgaatcccagattccacctggaacaagagaggccaggctcctcccctcacaaacagtgcaaacttcccaaggctccaccccagtgcacactcctcccagtgcacagaccagaagaaagttctgccaagaggccctttttacttggctgtcttaccaacatggcagtacacttggttttcacttacattcttacatctctgccatgttaatacaggaaaatactggagtccaaataggaactctccaggaaaagatttcttaagggcaaaaaggagaaatgcaagcacttcctacttgagagacccctaacatagtagcctaccatattagctttgagacacaagagcgagaagaggattcctaagaggactggagcagcagctgagatttccaaggtcctccagttggctatagtgacagtaaccatttttccttacccagtggtttttctcaacttagctacacattagattcacccagagagcattcaagctaaaatctgatacccatgtgttaccctaaccaattaaataaaaatctctgtagttgcaacccagacattaatatttttaaagcccccttggtgatatcaatgttgagccaatgttcaaaaccactgccatggccatttcccagaaataaaagttaacccagagaactatagaaagctttatgaatcatgcagaataattatcatcatgatcatctaaggctccccaatagggcccttcaattaagttcaaaattggctggacattgggtcagatggggaaaatcaactaaacaaaacaaaattatttgatggaaatttagctttctgccaactgcatatttgagtatttgtggcccaacttcaaatgaaaacagaagtgtatttttttttttctaactgaatcatggtattcacaatatacagcttgactaacagtgcttgtgggcaaccaagcaactttagagattcctttttgattaaaagtacactgtggacatttacttaattcatttccagaaaaactctggaagctgggcttgattcttgcattaaacaatctgtggaatttgaagagcaacccaaaactctctaaattttaattttgtcacctctaactaaaataagtttggactgaatgatctcaaagatcttttccatcccttgacattctgattcaacgatacatagttttctcctctttccaaggcatttgccctcaaatcacttagattcatatgatgatactatttattttcactagttaggctgcatctaaatgacaaagagttgcacaataacttgattcttttgcatggcatgcaatacaataagtatcaaaaatgctaagcttttcacaaaggacaacacaaacattaagcaccatccatccattaagtgtgaaaagacatctccagtagaggccaagagaatatttgctttcaaacaagacatcacttctctataaaaattattgtcttaggaggtactcactgaagggaaattgctggccctgggggcagagatgtgataagataatgatttctattctttcatttcagccaaatggtaaataagtcacaaatgaaataacgttggcactattaattctcaaaagcagatttagacagagacttcaataagcctgaaatcagcacttaatttttcattttctcttttctgggaggcttcaatggaacagttttaattctaaatttaagatatgttgccaaaaactgattgaaaaaacatggtgcttgaataagatgtttaggtaggtttaaaaaactggatatgaacactgcttcaaagggaaatgagttttacactacacatttttatccttttaatacaagactcctttcttttgattttggaacaacttgatacctaaaaatatatactttttggtgttgactcaatagtttaagaagtataggtcaaagtttagaattttaagaactgtatttcaaatggaaatagtttgcatagttttaacattctcttttctttccccatttcccttaataatattggatttaaaagttatgctgctttctgttttcatatcctcagacacggatgattttaccatttagaaattcaaagaaaaaatgttggaagtggtatgtattttctaatctatatttttctaagatttcaggtaacctctttccatttgagtgagcacattttatctagtgtttctcaaaatgaaattacttagattcaagtagattgatatgaatattactgagtaaagaattcttttacagacataaggtcttaagatgccaaatgaagaaaacattccttttccaatttattcctactgtatcttaaacaggctactgactagcacagaactacatgaaactgaatctccaatttgagttgtggtcaccagttttaattattctaacctaaattgaatccctttgaaccaagtttgttatagtcagaactaggctgaactaacttaggttggattgaaccactttcatcaattttctcttggtcttagctttgtccaatgcctgcctgtagaatgagacatgcctggaatgaaatgtctgtaacaatggtatattggtactaaaataattggataatactgaaagtgggggttaatatcaattatcgttttgaagaaaggctatgtaaaatgtaagagatgatcaggattctgggatcaaaagtcaagtcaggaaaatacacagttggtgcttacagagctagagccagggaagatgaatctgaaaatggggaatccaagaggtagaagaaaatacagcaaggaagttatattggtatgatctgagcatacactgggatttttttttttttttttaagcaagctgtcttggagatgtgaaagggcaggaaagggccaggcttctaaaaaaagtgagttaaactaaacattatccttgaactcaagctgagaaaataggtacaaaggcttacctggcagaaacctgctacaaaatgtgggtcaaagtggacttttcaaatgcactcctgtgttcagtgtccctttcgctccccggatactatatctctatagtcttggaagcctaaacgttctggtttcttagtgactgtgggaggtttcaaggctacagctaattaagagagtcttactgagcaaagtcagcaagataatagatcagtcaacataaaacaagcctagatacctgttcttaacattgtggcagaactgggcaaagaagagacagatgtacatacacctgtgatgtatgtacatcaaaccaaagatttctcccaagtgtggggtgccaataagagtaaaatggagtaaaccagagattgtatgaatattttttctttttttttttttttttttttttttttgagacggagtcttgctctgttgcccagactagagtgcaatggtgcgatctccgctcaccacagcctctgcctcctgggttcaagcaattctcttgcctcagcctcccgagtagctgggattacaggcacctgccatcatgcccagataatttttgtatttttgtagagatggggtttcaccatgttgttggtcaagctggtcttgaactcctgacctcaaacgatccacccgcctcagcctcccaaagtgctaggattacaggtgtaagccactgtgcccagcctgtatgaatattttttctaagcaccagacaaaactgagatccattgagcaaagcagagaagttgtaggtggtatctgtaacacctatactcccagaagaagggtcagttctgcttgagagtatagaaaaatttgtaagtaattacgcaaattcctccaaatattttaatgaggtcactctgaaataaagacataattataagcccagggttcaaaatagtagttttgattatgttatacagccaaatgcttcctgtagaagctgctgttttgtctgagatcaataatgtcctaagaaacggctgaactagaccctctcggtcaatccatcatcaggacttgtgatggaggggacttagagttaacagtgattctgacagtatcatttcccaaagtacttgggaatcaggaatacatatagtttctcaagcatacttgatccataagcatctgaaatacatttaaacttggttccgcaaagcaagtcatggcataggaagggtgacaatggccttgccatgcaggtggcccttcactgtatgttgagttctgtggctttttgagggcagctcttgagctctgccagataatgttgtcatgcagtctgtacagtggcaccaccatgcctgctgttttctcatcttccagtaggtccaccaatactgaggcttcccttacaactgtgacattaaaaccaatttaaaccagctaggactatttgagagaagttcatttaggtctgaaatattaaactaaaataactttagctcatccttaagagccaatcctagggttgctgttatttaatgaataattacttttgaagaggttttgtagactatattgctgaaatctttcctcaaggagagtagtcactaattctgaaatgaatgaattagaaaacagtcaatgcccaaatctccaaatggccttattgctttctcccactgagcacctctgatgaggcctccctttgaggtcttatcaaattctcccagatttcaagatctttctgaaccacaattactcttgtgtgtcagttttgatatatttaccatctgttgcctgtttatagtgaatacatgcatgtagtactatgtatatacagtgtgtgactactttacaactgatttggtcaaatgggaatcaaatgaaggtgaaattttattcaaggatatatgtttaatttaaatcattttgcttatgacataatcattgtaggttgattaaataaaatgattaacctacttaagaaaaagcttgttcattacttaaatctcaatgacatcaatttcatttaataaaagtttttcatttatttacaggactgaaataaaaccctggtaaaactagattttaagactcaaagcagtgtaggccattcctattatacagctgataatgtggagaaaaatcagatctttaagtacttcatatatatatatatatatatatatatatatatatatatatataaaatgaggtgaacattataattttgcaatatgaattggcactggcacagaagtgatttaaacaaccggctttacaaataaggagactctcatgtgtttaatgatttcttttttaaaaaaatgagaataagggctaaatgtaaaatttaggggcttttgctaagttggtttcattttaatctttccctttaccaaaataaactagtacaaagaaatgcaaatatttgagtatgtgctaaaataaacattgcatcaatcatgtttgaggaggtacagaggtaaggaggtcaaccgcctgactggaaatgatgggtggggacatgatagggaaaatacaagaagggaccttcacggccaaaacctcagggctccgctctcctgaaatcaaccatatgggagcctcaaagttcagaaatcactgccaacagactcctagcctaggaggaaaaactgagcttgaagctcagttgctgctcacagtagcccccaaagggtcccagttaacccctcatttattagtctaacaattttattatcttagctaatttacatattgtattttatgattgtatgttgctcttcaagctattatttttaaactcaattttattttctttaatcttcagtttctagttttcatcgttggctctctaacgtttatcatttgttattaattcttggcttttactttgccattttatagtgctcattttataccactttatcttactgtttatgttatcttggttattttatcatcttctttaagatgttacccaacttttataactggcaagcagaaatattggctaaaggcaggcatctgggaggtcagtccaggccccaagcaagaagaggtggaagatgttctttcttcctaggggttttacaacatctcttccagatctccacaactgattcctaaattcccttcctagacacatcatttcattgtgaaatcagtttgaaagaaggatgtgaccactatcatggaccctttacactaggtaaccctatcaacacaccagccccagatatggccgcagcataaggctaacatccatagcacacattaagagcttaattattgtggttaccttctctcatgaattagccaatccatttaatgaaactggggaaaacttcatgatgtctatcctataaaattgttgaaatctaggtaaactctgggaacaaactgcactttaccagaagaaaagaggtcacaatcattgggaggagaaggaagtccaattcaaggagagaaactggccgacattctccaggcttagtcttttgttttcctctataatgaaatggtttcattctttttctcttgctacttaaataacaatcttttggaaaactcaaatgacataaaattctaagaaagaaagtaaaaacatgatatcccaccccccgagataccacgtttaaataatcaccattaacattttagcacccatcatttcatgtagttccctgtgtacaaatacccacaggcatatgtccttttagatttaggcacatgtcatttagataaacaaactagttgatgaacttccatgtacagacatatgtacacatacaaagatacacatatgtattagtaaggaatggctagcagtgatgccactataatgcccaaaaataaatattatctttttaggtcagctgtatttatgctcaaagttatctttactcctatattctggctgaggaagaggttgttgcacttgtaatggcaaaaggaaaaagaatatggtgacactacttcactgagacccaggcaagagttgccctgctctagtccacactctttagtctgatctggccttcctctagtcatgtgcctctttatgaagagagcagtctgaagggctaaaggtcatggcttctctgagtccatttatctattcccattccaatgtacactctgctgcaagtcctgtgagcgtcagaactcctccccaaataggctctgtgagggcccgcttctaagggcaggcaaggctgtaggagcatgtacccattaagtccgagagagagccaagggttggccgcttccacagaatgtggatggagtttgaaaatggggtttggagtgttttcaaaaatgagctggagcccttcttggtatggaacagatagaaatcaggggtcctgctttctttcagaaggatagtgtttaatgcaacttaataaatcatagatttcccactaaattaaaatacatttttacatataatcgtttcttgattctctgttctgccccactgatgtattttttctatgcttatgccaaactatactgatttcataagtagttctcatctatattctaatattttgtaagacaattctaacctcatttttcccaaaaaatattggtgatccttgaggattacttttttcaaaaaaatttatattattattattttttttgagactgcgtcttgctctgtcacccaggctggaatgcagtggagccatcttggctcactgcaacctctgcttcccgggttcaagcaattctcctgcctcagcctcctgagtagctgggcttacagacagctgccactaggcccagctaatttttatatttttagtagagatggggtttccccatgttggccaggctggtcttgaactcccgacctcaggtgatctgcccacttcagcctcccaaattgctgggattacaggagtgagccaccacgcctggccccaaaaattataaagtatcatttttggaaattgagtacagaaaactctgttggcattttaataggaattgcattgtatttatatgtttataaaaatagaacactgatatctttataatattggtacgtatttccatctaagaatataatatgccttccaactatttaaaattattattttttggctcacacctttaataccagcactttgggatgccaaagtggtaggattccttggggccaaggagttcgagaccagcctgggccacataaggagacaccatcttgttgaagtggcagaacaggagaggaggaacctgggtgccaatggttgtcacatagggtaagttcagctgtgagaaatggctaactgaaaatagcagtggcttaaaacaaataggaactcctctctattgtataaatgtagtaagtcaagggctggtaaaacagacccacaaccgttggcacccaggctcctcctctcctgttctgccacctcaacaagcagcctgtggccccatggctgcttcagggccaattatcatgttttaattctagaaaacaagaagaagaaaatggaaaaaatcaagggcaagtccccttcctggacaaacattgccaaaagatgcatatgctacttttgcttgcattacattggtgagaacttagtgatacggccatgagtaaatccatgagagtctgagaaagtatttattccgggaaatcatgtggccagctaaaattgggattttattatctttaaagatgtgaagaacagatacgaaggacaactggcagttacttctacaagcatctactctacggacatttggatttttatcccttaacatgttcattgtaatgaactacactgaagaggtttcccaatattgaaaattcttgcattcttagaacaaaacttcatcatattgtatgataacacattatttcaacagatctccaaaatataaattaccaactttgacccaagaagtagaaaacatgaatagaccaattaccaaagattttattacacttgttaaaattcctcgtgtaaaaaaacagacgaggaccacttggttttctgacttagttccatctatatatcaaaaaataaaatagacaattcaaatgtcatttaaataatcccagatcataaaaaaggaaatattcccaattcattttattattttaatattcaaaacatgttagagttctaaaaactctatttatatgcacattttaagtaaaataataataagatccataataaagcattggtttgggaaccaaaggatgcacccactagaagtttgtcagttgtcctttatcattgataaaaaaaaaaaacagaaataaaaacaacaactagatctcctgaataccagtgggttgatttaaggcatagctacagatgtagagagctacaggctctctaataatctctggagaagtgaaccctattccctgaatttttattatattatttaacttctataagcctccatttataatactggagtaatagtggtcttgggacaatttaataagataatgcagccagacataggggctcacatttgtaatctcagcactttgggaagccaaggccgaaggatcacttatcttgcacccctggctataaaattccttgcagtaagtgctgcaagatactaagttcccatgcattttaaaactgaattttctgttttctgctttgattccttttttttttttttttttaaaaaaaaggactttgtatgtcttaatagtcatactccttcaacacagatactagaagattgtttgatgtctgatatcaattgaatactataaattgtaagttctatatatactaggcaccaatctaaatactgacttctttcaaaaaatctcaatagaagaatccttaatgatgttttccaaaactacacacatagatgacttacatgatttgggtttagaggtttcttttacgggtcattttcctagaactatatgaattaactcgaaaatcatctagtctgtgagatttagaaatacaacaatttgaatagcaactaatagaaacatattttaagtaacaaaaggagttacagaaagcttaataatgagcttctttttattatcaccctggatatatttcttaggccacagttgaagtaactatctctcactgatcttaaaaagtttcctcctactatacttgggcacataagaaaaaggtctcgagcatgggagttaggatggctgtgatggatcaagggactctccacaaactacctttgaatgttcagtgaattctgtactgacctattaagagaggtttctgctctcattaggatccagtaggtttcaggtgcaactacccctctactttactcttccacctcccagagaactctgccaagagccatgttaagactgctttcttctttaactactaatagtcttgattataggaacagaaatttattgtaacatcaatctcatggaaaagtgaaagtagctaaatatatttacagaatcaagatatggctgagttgatactgaatgatgggggcttcctctttaactgttcaggttagaacaatttatggttgaaattactttggctgttgccatgatttccagcatattatggtaaaaagaaaaaatttttatttcagttgctcattcacttttcatgaatttttttaagataaagtgataagctattttaggggtatagtggttcaccagaagctacaaggatattgaaagaagaagggcatgtaaacaaattattaactctgaaaaaaaagtgaagacacaaaaaaaccttttattaaaggcacctgctgacaggtatttctgaaaatgtgtgaaaataatgccttatttatttgcttgtgttatacacaaggaaataggttttatctagtcatgaagcatattaaactgccactctcccccctcctgtaaacattccagtgtctcattaacaatggcaccagaactttatcttcaaaaagctttttctattcatgtggaatattttatggttagatgcccaattaatctgctatagtttagctttgtgaggttcaaatgtctgtttcacttagctgtttacttctaaatgggccagagctctttaaaatttaaagagtaagaggagaccttagggatgtacataaggaaaaatagcatgtcctctaatatactgatttttaaatcaaaataatataaatgattattcatggaacaatttttcttctacatacttgaactacacttccatttgccttaaatatatggctgtgctccaagttccaacattttttcattttctatgttaaagtttgcttcttcatgacatttatacccttcaaatatttataaatgctaccatgctcttgattctctgcatttaaatctgattcatactttcatggatatgtggatatgctgcaataaaacagaagtcattaaatgacaaggcaccaatctctttttgttggtaggttctaaaatccttcatctcattccaacaaggaagcttttaactctatcaatttctgatcattaactctcatctttagttttttatcccttcaaatgtgatgatcatgtactctaaggcagcttggcagatttacaatatgtaaatattgagagagtgagactccatgccaattgatgtaaacaataaatgcacagcgattattttcagaaacagatgcagggaatgtccacagatgtttggagtttagtctcctttaaaatgttctatttgagtaatgatgtaaataaacaagtatcaatgcaactaaataatgaagacatttttctgttggttatgctaacaccatgctgcgttctcccaagttgtgtgttttaagtgtatttttaactcccagatctggcattggccaaaaaactaagtgcaaatgctgcttattaaaaaaataccaacatgtggatttctattccagaaaaaatgcttggtctatgttttccaaagtgggaaattataactttcactatcagaaattctatctttaataaattaatatcccactgcatttcccctcaaaatataaatatcagtatctagttcttggattggaagtatgatatgaactaaatttcatgaacccaaaatgtttctaccaaatgtttttatcagctaattaatctacacagctaacaatctacaaggattgaggtcaggttgttgagaacttctgtatagataaaaaaactaattcaattgtgtgcacatgagatatggtatattcaaaattagatatcaaatgaagaataagtagtcattggagaatcagcctttgaataaactggattctgttatttctactttcaaatcacagttagggtaagctaccactgctgcttacagatagctaaacctaaactcacttgtcaatgttaatagcatttttgtttatcagattttctacacagtttattatattgtttgcaaataaaaaacagttttacttctttcttttaaatatgaagtgttgttttgccttattgcactggataagaactcccgtaaaatgttgaataggagttaagagttcattttctgccttgtttctgatcttagacgaggaagcatttaaccttttacctctaaagatgatattagctacaggattttcacagatgccttaaatacactttcaggtaacaaagttttcttcaattcctagtttcctgggaatttttataatgaatgttaaattttaccacgtatttttctacatccatggagataattttataaaggatttttcacctttgttaattctgtgaacttcattgattttcaagcatgaaaccaatcttccacttctgaaataaatccaacttgcccataatatcttctctgtatattgcttgattctttgttaagagtgttcgtacctatgttcataaaggatattggcctatactatttttatgtctgtctgattatggtataaagggattgctgacttctcctggttatccttttttaaatgtccctaggatttgtagtcactcatgtttcatattagtaatttgtcttttctcatttttctttatgaatacccctatatatttttaattttattgatgttttcaaagaatgtgcttttgtttcattgatatttaattaactaattttgatctttattgttttgttttgctttttgagatggagtttcgctcttgttgcccaggccggagtgcaatggcaaagtctcggctcactgcaacctctgcctcccaggctcaagtgattctcctgcctcagcttcctgagtagctgggattacaggcgcccgccaccatgcccagctaactttttgtattttttagtagagagggggtttcactatgttggccaagctggcctcaactcctgacctcaggcaatccacccaccttgccctcccaaagggctgggattacaagtgtgagccaccccacccggccttgttttgttttttacttattttgggtttaattagcccttctcttttctagcctacttaagtatggggcttagagagtttattttatacttccttctactttttgtttgtttgtttgtttctgagacagagtcttgctctgtcctccaggctggggtgcagtgacgcaatcttggctcactgcaacctccgcccccatcattcaagtcttatgcctcagactcctcagtagctaggtttacaggtgagtaccaccacaccaggctaatttttttttttttttcccagtagagtcagggtttcaccatgttggccaggctggtctcaatctcctggcctcaagtgaaccagccggcttggcctcccaaagtgcttgaattacaggcgtgagccaccgtgcctggcctacttccttctcttcaaataaacatttaaaactgtaatttttaatctaagcactgctttagctgcatctctcaaaatttgatattctgtgttttaggtgtcatttcattacattttttattgactttgtgatttttcttcattgaccttgtgttgttttaatgaaaagtgttgtttaattttcaaatttgaaggtatttcatatatcttttggctagtttttttccatttagttgttgtgatcagagagcaaactgcatgattttactcttttctatgtgttaggacatatgttatagcctaatacacattctatcttggtaaatgtttcatgtgcacctgaaaagcatattgtttatcaacagacacagaaaaagcacttgagaaaattcaatacccattcatgataaaaaccctcaatagagtagcagtacaggggagtttcctcaagttgtttaagaataactgcaaaaagacctacagttagcatcatatttaatgatgaaaagcttttcaagtaaaatcaggaaaaaagcaaggatgtcctctctcaccactccttttcaacattgtcctggaaggtcttaactaatacaacaagacaagaaatgaaataaaaagtatactgattggaaaataaaaaataaaacttgcctttctttcatagatgacactattgtctatgtagaaaatttggagggtggggtgcggaattcacaacaaaaagcctcgtggaactaataagcctttgttgcagggttgcaggatatgagattactatacagacagcaattgtttttctatgttccagcaatgagtaagtggaatttgaaattaaaaacacaatagcacttacactggcaccaaaaaaatgcaacaggtataagtctaacaaaagatgtacaagatccatatgaggaaaaataccaaactctgatgaaaaaaattgaagaactaaataaacgtagagatattgcatgttcatggataggaaggctaaatattgtcaagatatctgttctttccaacttgatctatagattcaatgcatccccaataaaaatgctagcaagctattttgcagatgtagacaaaccaattctaaagtttatatggagaggcaaaagactcagaatagtcaaaacaatattaaaggagaagaacaaaactggaggacttacaatacctcagtttgcaactaattctaaagctacaataatcaagacaatagtgttgaaaaatagacaaacagatcaatggaacagaacagagagctcaaaagttgacctatataaatacagtaaattgatctttgacaaaaaagcaaagacaatacaatagagaaaagatagtcttttcaaaaaatgatgcttgaacaaatgtaaatacacatataaaaaaatgaatctatatacaaactctatacccttcataaatgttgacttaaaatggaccacagacctaactataaaacacaaaactataaaattcttagataacatagaaaaaaaaatctagagggcactgggtttgatgatgacaccaggtttgatgatgacaccaaaagcacagtccatgaaagaaacacttaataagctggacttcattaaaattaaaaatttctgctctgtgaaagacactgtaaagaaaagaaaaagatacaccacagactgggataaaatatttacaaaaacgaatttaataaaaaactgttatccaaaatatacaagaactcttcaaacgtaactataagaaaacaacccgattaaaagatggaccaaagactttaagagatacctcaccaaagaagacatttagatggtcagtaagcgtatgaaaagatgttccacagcatatttcattgaggaaatacaaattaaaataatgagatactagtacattaatcagcatgaccaaaatccagaagactgacaatgccaaatggtggcaaggatgtggaacagtaactttccattaagggtgggaatgcaaaatgatatacccactttggatgagagtttggtgatttcttataaaactaaacatactcttaccatatgatccagcagtcatgccaccatttagcattgtcagtcttctgacatatgatgtggatatttaaataacaacaaaaagactgggaagatagaaaggaagatttaatctaggaagttcatttttagccttaaaatactgagtagcttacaaaaagtcttctccttttttcttcatagtgaatagtttttatgttaggatgattttattgtatatgcacaataatgctggattgcactgactcatccattcctaattttgagtgtgtgaagatcttgatgttgtgccgtgcagatccagatgtcaggcattttgccatacttgccaatataggcagctgattataattattcactgccattaaattgctgctcaaaaattttcccattcaagttgatgaatcaagatgttgtttgggctaagcttttcccaagaaaatgctttccaaattcctaatactttgacctcaagaatatttaagaaaaaggctggtgtgatgtatgcatgggatttatagtaagtctattagagatagatctttttcaaaaggaagaactgtcaaaccaaaatataaacataggcaataatgagattgtaacccaaatgtcagttacacaacaccccattaatttcacttatcctttcatctccaaacaagtccatgggttttgtaaatataaaaaataaaaacctccccatgttctctacccgctcatatggcatggggaaggagggtgaagatctttatatctgtggcttcttgatctagaattctgctttcacacttgctctctctcttctgttccaacctaaacttgaaacaaatcttctctgatttctacagaacaaataaataagcaaacacagtaagaattcgagggattatttgtcgggcgcgggggctcacacctgtaatcccaacattttgggaggccgaggcaggtggatcacctgaggtcaggggttggagaccagcccggccaacatggtgaaaccccatctctaccaaaaatacaaaaaattagccgggcatggtggcaggcacctgtaatcccagctacttaggaggctgaggcaggagaattgcagtgagccgagatggcgccactgcactccagcccgggcaacagagagagactccatctcaagaaaaaaaaaaaaaaaattgagggtatggtagactttcttaaatgattcctggaatagagcagaaaagagttcatgttccagccacaaaaatcaacttcaaatgaaataataggtatcatctatcttaaaatttcatttggttacatccccaccaggcttgccactggcctttcactttatgtaatcctagctctcatcatcttgttggtttttctctccatgcttcattttatacattctctcattgtccttctccctctctgaagaagtaacaggttctttcccggtctctcatagctataggcactgtctgccttttccccagaaccttggtgccagccaataccaaagctctgggaatccaacttcctattggatgggctcttgaagtaacatttccaattctttctaagaagaattctggtgactgttgttaaatatgtacatttaattttattttattataatctcagtttctcattatggaagaggtaagagaacattatccaacattgttaagcacctactatgtatggaaggctaggcacacagcactgaccttggtactaccgggaaggcagcttgacctaacatactcaagaaattctaacattttatcttcagtagccctttagattgcaaacatgacattttcaagaatacgacataaaaaggtttgcaaatatcctttttccctgtaatatgttccatattaaggggccaaatttgccaggctcatacaagaaatgtctttctcctcttttgatgtgcttttaaaatttatttctgctttagtaacaaaacaaaaaagtcactgaaaataaaaatttaattccattcttttaacaagcagctgtcagccatattctttaataggaagtgaaggttggaagattttagtggagaaggaaaagttacatcaagtacaagaaataggccaggcatggtggctcacgcctgtaatcccagcactttgggaggccaaggcgggtggatcacttgagctcaggagttcgagaccagcctgggaaacatggtgagaccccagtttctattaaaaacacacaaaaaatagccaggcatggtggtgcacacccgtggtcccagctacttgggaggctgagctgggaggattccttgagccggcagggtgggggttagggggtggggaaggtttcagtgagctgcgataccaccactgtactccagtctggacaacaaagccagaccctgtctcaaaaaagaaaaaaaaaaaacaggtagtacaagaaacagtctttggtcttaggagaacatttatgtaggcatcaggaaaaagtcaagagttcacaagaacataataattgttaaggactcactatacaagatgctacaaaacacatctaaattgttaaggcagtatcagaaagaatacccagtgtggaatgaagtttgacctatagattgaatctctagctggcagctgaaacttgaaagtattatatgtgtatgactactatactgacccaggacgatacgtgacttaattgaaatatgatagtttcatccccacaattgtcctctaaaccttattcaataggagcagtttcctctagcaccaggtcaaagactgactcttggataataaacagtcttacagtcactttaagtctttagctctctgcgtgctggagccagctcctacaagctcagtagagccgattgtggttgtttctgcccaactccacgtttaatgatgtcaaattaacagcttcaggtaggttataacttccctatatacactgccagaagtgctaaaaattgaggatgggaagaggactacttttgtggattttttttttttttttttttaagaatcagtttttcagcacagcactggttccatggcaaacaaacatcccttagccccaacaatttttagaagtacaggcaaatcccaacattgctcttctactggcttcattaccagcagcagctagcatcttttgccctttaaatagacctgttgggagccacactaccaaaagcctcaatgcgggagcaacatatgaaattgcccaagtatccttggaagcctcatcattaggtttgatgatagggagcaggcaccccgcctccaaggtgtatagctcataacatagctttctccaaagataccttctcccctgaaatccactctcttccaatccacactctacctcagtcttatatcttccatctggtgaagggtccaagaattacggaactgatgaattctacatttaggatctgtcttgtgaaattcatctctattttttcttggtatcttgctcaaaattcaattttaacattctgtttcaagaggtcagcataaataatgtcaaagagaaggaaatcccatatatatgtatatatattttctgtttgggaggactaccaaaaataagctcaaatgagagaatacatcaatcttgtattttgtggttatagttgttattgttgggttgtttttgtttctttttatggcaaaggtagtcaagttcatgggttaaaactcatttaatttggaaagaagaaaactacactaactggacaccaccctgtgctaggccctgtgctaggctgggcagcacttcttatacttaatgtgcaaaggaagcccctgggggggtccatgttaaaatgctgattttcattaggtctaggtagagctgatatttttatttctaacaagttcataggtaatgcccatgctgctagtttggaacttctttgaataacaacgggctagagaatatatatatacacatgcacacacatacatacatatacatatataaacatatgcacatgtatatttacacatgaagattcaagaaaaaattaaaacaattccatgagatagatgtttatcattatctgtatttcaccaatacaaaaactgcaaatgaatgaggttgacttgcccaaccacatagataaatggcagaggggattcaaaaccacatttctcttcccttttttcattagttgacatagcatccagaagttgttactgtttttaaactataaactgtaatcaggttaaaaaaataagtaacaatgttgaatttctttttctcataatgtgattgacctccccattttagtaactgttcagattctcctatttcatgtccctgagttttaatggatttaatcaaaactattttcaaatactagttgctagtacatatagtctacccacgaaatatcttctagatgcttggtccatgactaaatggcacaagtgcctgtattaagagaggtattttgtactctgcaatgatgtatctgaccattcatgttctctcattatactagctagtcttcaggctttttcattatgctatttagtgaggagatgttctaaaacctttactgactctcttcatctccttcacttataatgaatttgtacagaatgctacagccaaggaacacaaaagctgagccccaagaaaaaaaaaagtgattaatgtggactttccctaaacagatggtattaacaacctcagcctgcaaatttcaattttaaaagataacagtctaagtccctgatagctcacaaagtaccttggttacatataatttgtttgtacaaaattgaagattattagttaaataatgattcttttaatcttagcatttacacaagtatttttttcaattgttgtcattgctacatagactcaatcccttggtcttttcctttaagctttttaaaaactaaatgaaggaaggaagacagaggacgtgagtcacatgctaacaaaaataacaaaacagtgttggccacagataatttcctgaaaccggtatgagaaggaataagctatgtgaaagaaaaacattggcaagccattttgtgaaacagtaaaatttccaaatataattgaaaagagaaaaatcttcccaagcaaaatacccatttccaagcctaaggcaacaaataaacaaatgaagggtggggaaagttcagccttaatattaaaaaaaaaaaaaattcaactttgttttctagatatctgatatgattgaggagctgttttaagaaaaacaaagaaacatgtcagtaaaatttccttttgttatatatatattatgatatctatatgagagatttaataaagtgttaaggtatgctgggttcattgagttttagctttggaaacatctccttggataaatggagtttaataatcggaactctatgtaatatatcaagagacccaaaacaaacacacagaacatttgattagctcaacagctgctaaaaatcattttgataaaagtcagccccatttctgatttaaaatttttgttagcatcaggatgaaaaaggatgttatttatatgcaaaaacattaatctacctaaaacagctatttgcttgcttaagagaggaactgttaggcagcccatacattaaaatctggaatagacaaaggatgctcataatcccagtattttgaatttttctaggattttcaactattatcaaaatataaaggaaaaagaattttgctagtctacctagaaaattcaagataatcaattgaaaagttattagactacataagaaatttcagtaaatcagatagacaccagataaaatcaaaagagcaatcactctttggcatgtcagcaatagctggttaaaatataagatagaacaaaaatagtagacaaggacgacaaatatatagaaatagtctttttaaacaaatgagcaagaaccatgaacgtcctttctgagttattcatttaaacaacatgaacaaatggtgaaattttccctgttcatggatgaggaaatcgactattattaaatgttagatcttttcaaatttataattgtgaagcaattacaccaaaatgtcaagggggcttcttttgaaatatttctagatttaatgtgaaagaataaatgatgaagagttaagagcattttgaaaaggaagagtaatgggagaagagagtttagcactacgaaatattaacatgttatgaagctctaacgaggtgaagagcacggtactgtcaaatacgtaagaatcaagaaagtaataaatgaggccttccaaatgaatgagaaggagatttgtttgagaaacagttccgaacaattccaaaataatgatagtaaaatgtaaaaaaacaccaaatattataacataaaaaataaaattaaataagcaaatttgtcactcacagaagaaaaagaaaagcataataagctcaaaaacaaaggaacagattactagatttaaagatctaaaattttttatttctgcccatcgtaaaacctcagaaacctaaatagtaaaaacaagctggataaaatatatacaagataattcaactaagagcatgaactgaacattcagaaaaataaaaatacatatggctaacacaaataatgttcacctttaataatcaaagatatagtaaaatttaaagaaaatggcatacttttagttctttaaaatagttaacattttaaatgataggcctagccaataatacattctttgttcttatgttttctcaggttgatttggaagttaaccattcagtaaaactgagctgccaagttgtaacgaaagcaagtctcgtacaaaattctcccacacttacagttatataaacattcattaacaagcaggcaaaaaacaacctgtactgtagtttcactgaaatgccagcattgtccttttaagtgatcagccgccccaccaacataaaaaaataactgaaaccaattatgacagccttccagaagcagggcctagtaccctgatagttagctccagacaacttgaaaaattcataaatcaatgggtggccacaggaccatttagggatcaagccttgggcactattttaagggtatggtaaggcctcactggtttcttattccattggcatataaatatgcagaatgtctctaacatgtttttaaagaaatcatttctcctgaaaacttaaaattttgccaagcagtgaaattatcctaatttataagtcacccacttcaccaatacaagcaaatttctgctcaatctgctaatttccatacggattgctaattgaaacacaaaaaacagaagcacttctgttagcctcctgtggaatatggacttcctgatcagaactccagctggctttctttggacttctgtactattgattagcacttgggtaattgcttaacctaaagagatctgcataacctatataaagggagttataaacattgaataccagatgtttactcttcttccacatgattcctcttcttacccttgtattttctatgcattctgtatttctatggagatgactggaagttccgcacagttctggctctattcacagttcaggttacattcagcttaggtccatcaacacttattttggtaaatcacagcaaatgtcaaattcttcaaaccaaaagaaaatccccagtctgtacagagtgataattatttctttttatgaaaatttcttacatactctgctgaaaaagattatcctatttttatgtttttgatggtagtctagtgtttcataatctcaaacttatttcaacagccttacctcattgctcccagagccaaacaaggtcaatgagtagtcgttggcaagatactctgcattgtttacaatgccgcagctatttgcaatgatacctgcccatgtcgccatcaacctcaggctgcctgcatctttgccagcagccgtcagtggagagaggaactagtacttcaaaggtctcagtacggctcataaaagagcagggggttgacccaagccaagatgaagattgtatatttgtcagttatgtttgactattttgacaagctaatccatagaaactcaagataactgagaggaagtctacatttaatagccccagagaaggctacagataaatgtaaaagaaaactaaagatctccaggggaaaatacttagtatctcctccccatcgtagaagaaaaaagggaaacaagccaatagtaccacttatgatttaaagaactgaccacatataacaaaaatgttaaatatccagggaacaaaagtgaaaaactgaaggagggaaagaaaccaagcattcaaaagagatgatgagtaaggcggtgacaagctaaaggcactgcaagtctggggcacactgagtgtgagaagaaactctgaagggtttaacaggaaaccaggatttccaggaaactagaagccagttgaaaattgatgcacatttcaagccatttcaaacaagaaaagggcgaaattaaatatgggttcaaaggacaattatacatccaaaggccactgccccaacaacttggaaatccttatacacctagatgagagttcttttgcaattcctagatactaaaatgttatccaccccagtagccagtacctggctgcagagaacgtgaagctattatcagattttatgcttatacccaacctgtttcaaaaacaatataaggttccctacaacaataaaatattgcaacatgagaagagaaataattcaggcaaaaagacaaggcagagcttatgaaacgaagccaagaaaaaataacacacaaatctttaccaaaacatctgataacagtagttcccaatgttttttagtatgaggtcactttttctaaaatcagaaattttcatagatcaccctcaaatgacaatatgccccccacagccatgatacccaacaattctatttacacaagtagacattgatgaaaaatgcaataagctacaataaattcagttatgtgaaattgtattttatgaatcagaagtgtaccgatatgaatagtaataaatacgtaaatattattttatttcataacaatattggagatccttatcaattcatggatctctgcaaaaaccctaatgccctgatttagccattctatttgttttctaaaaatctttgcatcctgtgtcttcacaaatacaatggaagttttaacggaaattcaacagggaataaaatgtgccattaagacctattttacaaactaccaccaaaagaacttttgcttggggtctgtggaaaaggccctttatgtcttcaattatcagtttcattatcttcacaaatagacagccccctgcccaaacctccacaggtacacagtgacacccaatttcatttaggtacagtcatgtgactgttagtcaatgagatgtacacagaaatggggtgagcaaatctccacaaagcaagcgctgtgtgctttgcctccacttttcttgctgggtagaatgcagacaatactgacaaggatcatacccttgggcagcagaggaaaatagctggatggaacctgggactttgtgaattaatggaaattctttattaaaattctgactattgaagttctttttagaatagaacaaactgtttttaagccattcttaattttgtatttttgctgtcacatgctttcagatagtaatttctagttaatactgtctcttaactatcaaaagtgttcagttctaatattcagtcttcactactcctagaaaaatcacatacaatcagaacgaactttacttcctgtaactttgcagtctcatttcttgtccttgtcattagttctttctctcctttccctgaaaccttagacactaactctgataccaccttgcgggtctcatcttgattatgccttacggtaatttgggcttagctttccagatctcgtatataattgatgtgtgcgctgggatttgttttcaatagaactgggttatttttctgtatatttcccccattttttttcttggtttttacctttgttttactggagcaaatcttcaggtaacctccttacagaagtacataagagaaagtttctgaaagtctgaaaatagctatattttaccatcacacttgattgccaagtgactaagcctagaatttttctcagagcttcaaatgcattgtttcattgcttctcagatcttgtattgttggtgagatgtctgatgtcaatctggttcattttaacattatgaatcataaatatggttgtgttcactacatcctaattataaagttttaaaaaaatttcttgtgttctgaaatttcagatataaattttttcagcatcctgggaacccaatgggcctaaagaattctggtgctttagtattaaaaacttttcttgtatatttccattgctaacttcctcccactccaattccctctcttatttcccagaatattaggtcaatgtcaagcttctgggattgaacctctatgtttatctttttaaaatttttttcttttgtcttttttctcttgttctgattttcttagtttcatcttcgtaactgtctgaatttttgcaattgcatcttcaagacaaaatatcttattttgttctccattgttcttttgtacttttctagtcttatttttcgatgcaatatcctctcaaattttcaagctaattgcataactaggttcttttaacattctcctttttctgaattatctgtttcttctaaagtaaatgttcttgttttagttattttgtgctgctggttttatttatgttttttgttatctttggctgtcttcttatgaagaagaatagtggactgggttgattttctaggatataaattatgagtcccctctgctgttatcttttatttcatggtgaggtctttcaaacaaatatgggtggaccttgtctactggcaggcttcatattggcgagggcaataaaggaaaatgaatttaggctgaagaggggacagagcctccaaatgcagagatgagggctttattcccggaagacctaattttatatctgtagttcttgatgtctttggagaagaggctttagatttattttgttgttactctttcatcttttctttttaagtgttaggctgcctagaaatgcatgagctccacccgtactttttaatgagttttgatgcaactatgtaaaaattgttattttttggcttctggagggaacaatgtttagacaccttttaagtgcacttaaaaacattaagaagtaaaaataaacatttcaaagagctgaacataaatgtcatcacagatactgccactaatttactgattattgatcacaggaatccatcctgagccagaggaacagcagcacatggtaaaacacaaacagtccaaggtgtacaaaaaagccttcagaacatccacctgcagactgaacaccacatgttatagttaggagcatatttggggctttgctagttacaaaactccattgggttttcataaatacactttatactcaaagccactggagtcaaccatataatgacaagattgtctggaactgaatgtaatttattcatattgtttgcaaggggaaagtattgtacttaaaataattatacttgtagttttaaaggtgtttttgggtatcactatatttcactcagaaagagtaaaagcagaaacagaaaaattttaaattggtttcctgtataatatctatgcatatacacacaaaactctgcaaatgtgttatttttacttttctttttattttttgagacagggtctctttctctcacccaggctggaatgtggtggtgtgatcactgctcactgcagcctcaacctcctgggctcaggcaatcctcccatctcaacctcccaagtagctgagaccacaagtgtgtgccaccacacccagctaatttttgtatttttttcgtagagacagagttttgccacattgcccaggctagtctcgaactcctaggctcaagtgatctgcccacctcagccttgcaaaatactgggattacaggtgtggaccactgtgcctggccaaatgtgttatttttaatataaatccactgtttattttaggattcctcaccccctgaatttaatgtgattcatttaccttaggcaatgacttatttgtattcactgacaggctgcacagtggaaaaaggtcttcagagtgactaacaaaagaccacatccatctgtctaccccagtataatacatgtctcctagacatttttctctatccctacaagtaagacagaggtacaatcctatgactaccctttcactctttaattgatcaaatgagaaactttctcttcatggaagcattaatgaaggaaattcaaactgaattcatcatgtccaacaaacaatccatctttttaaattgagatataattcacataccataaaatttgcccctttgaaggacacaactcagtagtttttaagtatattcacaacgctgtgcaatcatcaccattatctaattccagaatgttttcatcacccccaaaagtcactcccatatctattagcagtcacctcctaatctcctttcccactccccagaccgccccatccctgtcagccatctctgtctctattgacttgcctagtctggaaagttcatctcaatagaatcatataatatgtggtcttttttgatcagctttttatttcgcttagtgtaatgttttcaaggtccatccatgttgtggcaagtatcagcaccacattcctttttattgtcatataatatttccttatatggatatactaccttttatttatccattcatttgttgatggatacttgggttttttccatcttttggttactatgaatgatgttgctttaaacatttgtgcgcaagtttttgtgtggacatatgttttttttaatttcccttgggtatatgccacctaggagttaaattgctgggccatgtggtaattctatctttaactttaagaaaaatttttaaagcacatttaaaactttttactgtatatactgagtggaataattttttgagcaacattaccaaagagaaaaaaatgttccaaacataaataagtctcattatgacagaactttgtaaaagatgctgtttactttgtttttttttttcaatctggacaacagaattatgactgtactatgtatctataggtaataataccagaaaggcatagggctttataaggaaaaaagtcagtagaaaatgcttaaatgcttacttagaatctgaagatattactttgaaatacctaagattactcttagtatttgcatatgcttatttatcacaaagtatatacaatgaagtcttacagtcaactttcaattcttcctcacacaatatgtagtacttattctagaataactacaagtatagtctgtccttgtctgaattttttttttcttctaggttctgctgataattctcagtattttatgtctttcttgtcctgagccatgtttcactgacaaataacatttccagagactttattctctgtgtctttcaattgcttagatttcactttaaataccagaagtttctagagaggattctttttctcattaggcctacaaaattcttgctaacataagaaaggctgttcacactctgttaacatggcgctggagctgtgtaaattcctttttgttgagcattcttctttcagtgggtctcagtcttggccattctgtgatgaaatgctgttttagcctcttggtgagaagactgacgtacagaatgtgagcccagctggaaacatccttcacagtactgaaatacaagtgccaagtccaagtactttctgggtaacatcacctaccctccctggctgtgaaagctcagagataagagtttctagctgatcattttgcagtggattttccttccttaaaaggaaggattttttttctaaagaaaaaatcttttctgatttttttctaaagaatcaaaatttatagtttaaaaaaaaaaagtacagaggaaaaaaatttaaatacttttggaattgaatgtttcccaatcatttttttaaatgttgtcttcactttttttcttctttaactaccaatgcccatgtaattttttttctttcatgaggcatcagtattccttgcctaaagacagtgtgtctaatgagtgactagaatcaggtaaagaagaaacttctcctgtcttgaaggaggcgtgtctgttggggaggagaaaggagttttccttgcttgctatacactgaagactgttcccttgccaagtatactttcatcgtcttagataaatcgtaattgcaaaatcgaaggagaatttgcagactttactgtgaatgaccttgttgctgctattctgtggtgtcaatgtaacaacatagacagactttacaaaatatcattttttactttacttttttacccctgtaggctttacaaaatatcatttttttactctacttttttgcccccgttatcaaaccaagggtaaaggagtcatttactttggtgacacctacaggcacattcagataaaaacattctcaaccctcctttgtaaccaaaacactctcattggtccagtcaggaacccctgtgtggattctgaatggtagttagtggacatcatctcagattcatttgagtcttaaaatacatcagtttgtctccaaaagtcatcttcaaatgttgagaaattttcatttggctatttgggtttgatgctgaactacaacaatgtaaatgtcttcagctggcctatgcctcattccaccagcataaatgttgccttttacaggccatgactggatgagcagaaactgctgaagtctctctcaccaaaatctctctcacacacgcccccctgctaccatcatacttcctgggctatagaagctgaacctgttccaagatgtaacaattagataaaatgatgaactcctcaaaagtggcccggattcccagtgttggaagactatagaagaccactgggattgagtaaccttgaaagaagttcactcagacaagctgttcgcacatctgagtgatcccagtgcaagtcaaactgtggggtggcaggtataacaacaacaggcaaaaagagcagaaggaaatgggttcaccagaaagtgcaactcctgcagcaaggaaatgaccaggaaacccacgatagtgccctattaaagaaagagcctgccatgacagagagcccatgacagccaagtaagctctacaaacagtaccagctaagtacatgagactctttttgccttctaggtcttaataggtcttaatcctctgtcccatctagccctggaagatccagaggcacatcaccaccatgacatctttcatgtcagaaggatatggaacaagaaagagaggagagactcaccacacctcttgcccaaccttctaggtcaggcccaaaagaaagggaaaagctttaaacttgatatcacaagtttagtttagaccagactgcgcttttaatacctgaaaaaaatgaaactgaaagtgaccataaaatatcatgaggaaaaaggaaggaatatctaacagagaggtttgcaaaagtggtaggagaaaaatgaagctattttctaattttatactgcggagtctagcccattaggttgttgatccagttgggattttactttctaatatctttttagtgaacaaagcaggtaatattaggcattgctcaagtgaaaaatatattgcgggggggaggatttttttgtccatgttcaaaattcaggaaaatatcataaagggtatatctatattaaagtctatttaccttgcttatttatagttgcaaatttacataaaccccatttaaaattttcttccacatcatgtagaattttgcctctgttcaatgaggacggcaaactgcagggacgtcttctatggactcttattttgcccccttcaacctgacttttgatcctccaacttctccttgctcagaagcgaggttttcaatgtttgacccagtaaaatttagtatcagtagtctgaagcatctgcttctgtgaaggctaatttatctttgctgaagacctcatgagtttcttatccctgaccctcatgaggaagttcccatggtcagaacgcactactgtgtctccaaatggctttcctaggagactgtcttgcttgctgatttacactgatcagacatgaggattctgaaacttcacaaatatttatcaaaaggatttacagatgcttagtttttatagctgcttgttgatgcaactgccacatcagctgcctaaaaaataaaatgggttactcatcagacagggacataaatgatgaaacacaaaaggcccactaataaattatacaacctcctgtggaccatggcacaatgaaggcaaggatccaagaaaaggtttcttgaattgttttttgtccctggcagggtgaattaggttgttcaggtaagagtcatgaatacaagaatagggagggagtgctttcaagaactgatttattgataggaaggaccaggaagtggtgatatttgttgcacaaatatctccttccttgttctttgccatacacaaggactgaccacactcctgagtcacccaatagctactgctttcttgttcgcctgtctcccatctttccagcttcttccactatgactcaggcaaccctccagattcaaagacacagtggatggggtagagcgatttttgtgtgtccttttctctctcctgcatccctctgagcacatcattgccttacatatcaccaccacaagacaggaaagccagggcccatccagtgcccactgaaggtggctgaatatacctggagcacaattctggcctggctggaaggtgaagagttaacaacaggaataagcaaatctgtccattcctgagcatgtccttctcccatcctcccactctgtcctttactccatcccaacggtcttcttaaaaggcacctctagggaaaaatcactaccaacatctctaaaccaactaaactcatcaagagggtcatcctcacacatattactgtctaagcaactatcgtgccttgggtaacatgagcttaaagggagctgcaatacagcatcttaggggtataatcattaaaagaaaaaaatatgttgtattacttcattttctgttgcttagcatatgaaaaactgggtaatttatacagaaaatgaatttatttcttagttattccttacctgaaaaatccaaggtcaaggggccatatctggtgagaaccttcttgctggtgggcattttctgaggaatcccaaggccacacagggcatcgcatggtgagggggccgagtgtgctatctcagggctctttttctcttgtgaagccaccagttccattcccatgataacccattaaaacccactacccattaatccactaatccattcaggagggccaagacctcatgatccaattacctcccaaagacctcatctctcagttggaggtgaggtaatcaccactatattggagattaaatttcagcatgagttttggaagggaaactattcaaaccataaaaggtgtttattggaaaaagcagaattattaaatcaaaaataaaatttgagagtaagcatataaaatgttctcatacagcagatactagaaacaaaaacaagaggaaaatcattaagaaaaacaggtgacgatgttattatgaaaaaccaaagattgaacaaaataatagattgcctatcatgttacatacagctgaagaactggaagattaagtagaagaagctcgccttgtcaaaggtggctacagtgtattccccaaagtattgcttaatccatctgaaataattttcttttcattgcaatccaatgcaatctcttctttccaggaaatcacttatttattcttgttattcaaatcacagtcaaactaccttcacctccaattcacattattgaactggaaatataatataccaggacctagcatccgcattcagacagaatattacctcacagattttagattttgggtaggttgatggtgggtgcctgactacatttgtgtaaatagtgtcaatcctggtgattgtctctaatccaagatggttttgtctccaaagctagcaacattttcatttctaggaattgaaatcaccactggtcaacactctatctttcccacaagccaccccccgcccacacacctcagaaaatggcagacacattgctaaatgaataaaatataagtcccttttcatctgatactgttatatagaatgagatttgacatgtttaaggaaacatctttgctagtgttaaaggctcattcctcaaaaatgaaacacaatggacagttttaagagtttgaaatattcattttttaaaatatcaggcacataaatcaatttgaacatgtttgaatttatatactcttttggtttggagggaaataatttgtaccaggactatgtccaagtcctacatatagcctcaatactggtttgaaatgccttaacaggcagggtctcacaacctcagccccaccacccaggtactgcaggtgttgtcacgagtagctgttggaattacaaaaatatttttccggaaactacagaatgtcaagttatgcctttgaaattgtggcatcagatacaatacatagcaggaattctcaaataaaaaatgtcgtattcatttcattcacagaagtttattaaacacttccatgggccaggcacattttatataggaaacatgcccatagtcattaaaataatttatttggaagaaagattttaaaggaggaaaatctcatacttcagttgttttaaaatcacaaatatgacagcactggctttcaatgcagttaattttagtccctaattcacagataatgatggcaccttaaacatggaaatgtttttctccagaagaaactctgaaatggactggaaaagtactgaaatacgtatcttgtgtaagcaattaataggaaatgttgcaaatcaggatcagatttgtgctgtccttttgctttttacagtaaaatataatttataatccatgtataaaatgctgcttttgctatgcatggacaagtggatagaagaaactactcagtcatgtgatgcttctaccaataaggcttttacaatatgtacattctatatctcaatgattgatacaattttggaaagagaagagagaaaataaggatttaattagtctgtgggttgagtaacatccaaggattaatacctctgcttgaagaaagggataattttctgatgacatcattcattacaacatgcagggtataaagagaggacacttcagtcattagccatgccctatgaaatgcagagacaactgcttgcctcatttgctcatcatcaagttttggcctttaaagatgttcaaaactgactacttaaggcatttaaaattaaacacttagcctcgacccccctcagttggcttaaaatcttaaacttcttctatctggcaactaaaaatattaaataagaaatgtggctgggcatggtggctcaatcctgtaatctcagcaccttgggaggctgaggtgggcagatcacgaggtcaagagattgaaaccatcctggccaatgtggtaaaaccccatctctactaaaaatataaaaataattagctgggcatggtggcacacaccggtagtcccagctactcgggaggctgaggcaggagaatcgcttgaacctgggaagcggaggttgcaatgagccaagattgtgccactgctctctagcctggcaacagagtgagacttggtaaaaaataaaataaaataaataaaataaaaaaaaaaagaaagaaagatagacagacagaccagtttttaaaaggaaaaatgtggagacaaatttaaaccaacttaacataataaacacaacctaaagaaatgaaaagaaactgaaagaacaaaaatgaataaaaattaaacatataacagatataatagagataatcaaatgcccaaaggctgatttttaaagaatagaaaattttttaaaatcacatcatcatctcaatagatgcagaaaaagcatgtgacaaaatcaagcattcctttaagattcagaccctcagcaaaattggcatagaaaagacataccttaaggtgataaaagccatctatgacaaacccacagccaacattacactgaacatagaaaagttgaaagcattccccctgagaactggaacaagacaaggatgcccactgtcaccacttctattcaacactgtactagaagtcctggccagagcacccagacaagagaaataaataaagggcacccatactggtaaagaagaagtcaaactgttgctttgctgatggtatgatcatatacttagaaaaccctaaaatctcattccaaaagctcctataactggtaaataaattcagcaaagtttcaggatgccaaattaatgtacgcaaattggtagctctgctatacacaaacagcgaccaggctgagaatcaaatcaataactcaatcccctttaacaatatctataaaacatataaaatacttaggaatatacctaaccaaggaggtgaaagagttctacaaggaaaactacaaaacacagctgaaagaaatcataagataacaaaagcaaatggaaacacatcccatgctcatggatgggtagaatcaatattgtgaaaatgaccttactgccaaaagcaatctacaaattcaacgcaattcccatcaaaatgccaccatcattcttcacagaactagaaaaaaaaattctaaaattcacagggaaccaaaaagaagcccaaagagtcaaagtaagactaagcaaaaagaacaaatctggaggcatcacgttatccgactgcaaactgtactataaggctatagtcaccaaaacagcatgatactgttgtaaaaataggcacatagaccaatggaacagaatagagaacacagaaataatgccaaatccttacaaggatttggcctttaaagatgttcaaaactggctatttaaggcatttaaaattaaacacttagcctcgacccccctcagttggcttaaaatcttaaacttcttctatctggcaactaaaaatattaactaagaaatgtggctgggtgaggaggatcacgcctgtaatcccagcaggttgggagtaggggactaactgatcttcgacaaagcaaacaaaaacaaagtggggaaatgacacccttttcaacacatggtgctgggataactggcaagccacatgtagtagaataaaactggatcctcgtctctcaccttagaccaaaatcaactcaagatggatcaaagacttaaaactaagacctgaaaccataaagattctagaagaaaaaatcattctagatattggcttgggcaaacccttcatgaccaagaacccaaaagcaaatgcagcaaaaacaaagataaatagatgggacttaattaaactaaaaagcttctacatagccaaggaaataatcagcagagtaaacagacaacccatggagtgggagaaaatattcccaaactatgcatacaacaaaggactaatagccagaatctacaaagaattcaaacaaattagcaagaaaaaaaacaagcaatctcatcaaaaagtgggccaagaacatgaatagacaattctcaaaagaagatatacaaatggccaataagcatatagaaaaatgctcaatatcactaagtactagggaaatgcaaatcaaaagcacaaggaggtactacctcactcctgcaagaatggccataatttaaaaatcaaaaactaatagatgctggtggggatgtagtgaaaggggaacatttttacactgtaggtgggaatgtaaacttgtacaatcactatgagaaacagtgtgatttaagattccttaaagatctaaaagtagatataccatttgatgcaggaatctcactactaggtatcttctcagaggaaaagtcactatacaaaaaagatacttgcacacatgtttatagcagcacaatttgcaattgcaaaaatatggaaccagcccaaatgcccatcaacgatgagtggataaagaaaatgtggtatatatacaccatggaataccactcagccataaaacggcatgaaataatgacattcacagcaagctggatgaaattggagactattattttagcttaagtaattcagaaatggaaaaccaaacatcgtatgttctcactcataattaggagctaagctatgaggatgcaaaggcataagaatgataccatgaactttgggggactcggtggggaaagggtgggaggagagggaaggataaaagactacacattgtgtagagtgtacagtgcttgggtgacaagtggaccaaaatctcagaaatcaccactaaagaacttacccatgtaaccaaacaccacctgttccccaaagacttaccaaaatacaaaaagatggccaggcacggtggctcacgtctgtaatctcagcactttgggaggctgaggtgggtggatcacatgaggtcaggagttgaagacaagcctgaccaacatggtgaaaccccatctctaccaaaaatatgaaaaattagctgggcatggtggtgggcgcctgtagtcccagctactcaggaggcctaggcagcagaattgcttgaacctgggaggtggagcttgcagtgagccgagatcataccactgtactccagcctgggcgacacagcgagactctatcttaaaaaaaaaaaaaaaagactaaaaataaataaataaataaataaataataaagttaatgaggctgagaaaccagaaaaaaaaaagacagactccagtaagattgaacaagacgaccagaggaaattcacaaacattggaaatgaaacgagggacacagtggcaaagattgaaagggtagtctgaacaactttctatcactaaatttgaaaacttagctaaaatgaataaattctttaataatttaacaaaatcaattcaaggagaaatgcaaaaagacactgaaacacacaagttaataaaatggatcagtttataataattctacaaaaaaacacaaagactaaatgacatgacacgcaaggtctaccaatcattttaaggtccatataatattaaccctagaaacattaatcgagaaagtagaagagcaaggaatatttcacaacttattttctgaatctagtagtaaaaacttgatcctaaaacctgagaaggtttctaagtgaaaggaaaattacagtcaaattcattctgaatagagatgcaccaaaatggaattctagcaaaccaaatctagtaataaatacaaaaggcaaaacatgttgactaatttggttttatctcaagaatggaaagttagtataataaaatcaatgattcaacacattaacaggttatgggagagaaattacacaatcatttcaacaggtacagaaaaagtattagatgaaatttagtacctattcatgatttttcaagaaattcctggaaaactcagaatagaaaggaacctaataaaatatttctacagaagcctgtggtaaacatggtacttgatgggaaaatgtgaaagcatttccttcataagagaataaacaagaccagcatgcctgctattattccataaaaagctaacaattgtacagtactgatgctatgccaaacagggctctaagtgctttgcatttaggcaatggatagagaatgtggtggggttcaagactctgacttaactttctcagaaatgcaactagcaactaattttctggtgacttatggatactactagcatctctagaagagctgcttcaagcgaacactaccaccctcccaagaatctctgcagtgtaaagtgaatcttgttgtttattgtgcgagattaggcaatgcaatatttctgatgaaaatttgaactctttggaattagactggcttcattttctgaaaacagcaatagtgatctactttacagcagaacacagagaaaatctgtctgtgtgtggtcagtactttctggtcctttaaggaaaaacaacatacaacactaaaatgttgtacctcccactttacagtattttaaaaaggatctcagaaaagatcatatgtaaacacaactggttaaatttaagatggtcaaaggattggatattctgaattttttttttttttttttttttttttttactgtatcccactgcctgcctagccccagaaatacaaggaactcagaaaagaaagggagggaagaaggaaggaaagactgattcgataagctaaggaaaagtaaagcaacaactattcctcttcaattttatttaaccttttataatacttgatatttcagatgctgggaaatgtgtcatattcagtttgattcaataaatgtgtgttaagcacctacgattaggcaccgtggtaggcactgggtatagagatgaagaaggcatgagatattccctggagagatgtgaggttaatggaaattggaagcatgtgtatttccctccaggcaactaaaaaggtgctttgcagacatctgaacacagatcaagagacactttcaaaaatatgaacactgcatgtaaaaagttgaataccaaaatgaattttctgtcagcatcaatacaacaaacctattcctggcttatgaagagaaagaaaaaggatcagactctaatacaaaataatttgaagaataattaaaaatatgactgatttgaagaagaacagccttatctacattcacctggtcatttggggggaagaaatatatgtatatataatgtactattacaggagactgccttttctaaaaagttggttgttttgttgtcaatgtcgtttgagttcagctgcacatattggattggtgacatgaccctgagcatagcaattcaggctctgaccaaacagagctgtcatgaccaaaatgataatcaattaccaaggacatagtgaagagatgtccacactggactggctgcaggacgtaacagagagggaattctgcgaagttagaagacttgttggttctaagcctaaataatagctaaaatgtatagagcccttattatattccaggttgtatgctaaacccttatagatattatttccttttaatctgatggtttagatttgggcctgaaaaatgcctatatgtaaactcaggccataccattttgctttctgctcatctgccatggcaaagtctagcgttattggcatttagactatgtaattctttcttatgggggactgtcctgtgcgttgtaggatgtttagcagtatatccccagcatctagtagatgccagtagcagaaaaaaaaaaaaaaggtttcagatgttacctaatgttctctgacagtgaaaattgtctctggttgacaatcactttaacagaggaatacttattatcttgagaaaatgtccacaatgagctaaaagatgaaaggagaaagctccaaagcactatgacaaataggcctgcccactcccctcccggctctctcctcctctcctacctagcacctcttttatacacacatatgcatagtaacttttttaaaaaggactgaaaggatattcaccaaaatgtattaaaattatttgggatggtaagattataggtttgtttgcattcattgatgttgttcgagttgaacttgcattccttttatcataaagaacaaagacagtagtctctaataaacatcactaaatgggcctccagcatctacagaacagtgtctacttccaaagcaaaggatagtcaatgactaaggattgcaatgtaaatatcgaaattttctaaaaagagggctcccctaccccacaatactgagcgttcgctgcagggattaaggaaggttggcatacatggagaatggatcttccctattatgcatgtccccctcgccaagccattggcctagctgctcaggattgtttgaaaacttaggattccaggtggaattcgcccctagtcaatttggaacaagtaaacagaaaaccaacattcctgtggtactctgcttaacaaatatactcaacaggagtgtttgtgtgtgaagaatgtggaaagaaaataagcaatagtcacttaggaaacatatggttctgaaaaacacaggaaccattccatttccccacatttaccaggcctcaaatgtacacacacacacacacacacacacacacacacacacacacatatatatatttccagagaaatctttagttggtaataaggccatttgaagaagcaggcccgaatgaaggaggtcccattcctgacttgcaggagatccttgggactcacagttagacccggtaggatcatgttaccaataagatttttctgtggcacctcaaggtgaagttctttgagtattgagaatgtgctgctaagaaagggaagcaaaagagtgcacaaagcagtagccaaggacacaatcaaacttcgcctagtttcctattctccactgcctggcccaaacactgatatacagctagtttggttgtaaataagtctttctcaaaaggctcaatccaaatcaaccattgtagccagaaactctatctaaatgtaagtcttccaaaatattttccacatataaaacatttacttcaaatattcaagtttctactcaagtcagctataatgaactgtgatgatgtcttcctgagtaatcttcaaaacccaggattcttaaacgacaggattaaatctcttccagtgttgttcttctaaggcaaaatgcttttggatttctcattacagacaactgtttttacttataatcccatgtaaatgtaaaaatactttttattatccatgaggatgtgtgttttagattcatgtaattttttgagagatgctagaagaatatcaaaactatgatatttctcttagacctcataaccttgaaaattcccaaatgatatttcttaaggtgctttgagaattacagactccttaaggttagtccctaacaacacactgggaagcttgctaggggagcatatgtgtaactcctagtgaaacaggaagaagaaggattactgtgtctttgagcccactgccccagggtagattgtcctaccttgggaggatatgtcttctgttgtgtttttcaggggagaaagtgcagagggatgaaggaagaaagactgttgctgaaaagattcaggaaagagaatagatgttttcacaataccgttagaagtaagaccgagtgattatcaggggagccaacttattcacctgctcaatatggtgatgaacagagagaatgctcaccttatctgccaagaaagccaacatttttccctgccaagtttgaagagtagaattaaactcattaagcttttctagatcccacttgtatctcattctgatttttctttctagcttagataatgtgactttaaaaaaaaaatgaactgttttattaatttaatgtgaccttgacagctctgtgtagattggaaaaagagcctaaaggaaagcctagttctgctcactctaaagaaaacagtgactttaggaaagaagatggagtagtggggaagagtcaggtccctggaaggttttactttacaggcttctctgctccttaattggatctgagccttgtagccccttgagaacactgaggtagaaatcggaagggtgctcagtggcttggaccatggcataaaggaagaaaaaaaaaagaaaagaaaaaaaacacacatatacacaaacatagatgcccagactaaaaaagtagccaaataagaaagccacataaatgtctaaaccatccaaatcacaagatgatcacaagtcaccacttcagggtttccatctactaccaaaacaagcatatgtatgaatccattgataacatatcctttgaccccctgctctggtagagtgttacatcttaagaattacttttagctgatgtcttctttcctctgctataacttgatattgtacactctcacactcgctctctctctccctctccagctttttcagaacaaaaaaaaaaaactttaattctgttatttaaaagacttacagttttggaagagtctccaaacctagcactaaccatcaattcttggttcttaccatcagaaccatcctcccctctaaagtggcagtagccctggccaactttgcctatcagtgctgcctccatagaattctgccttgatgcgggcacaccatgtatgtgtctgtttcagcaacaagaattcatttaatcagaaagtttgaaaagttgaatattctagttaactttctgagaaacgatttcaaacctataaagttatgtttcttcaaaacatactactttctggctgcaatttgaggataacaaatttgcctaggtttctgtaagtgataagaatctagcaagaatctaaatagatgtcaggctttacgggttaagtggtatttaactacattgccttgcttctctgtaaatggagatcatcagtattttaagattaaatgagatgtatgccatgtcctggtgcaggatctgaaatctagtaggtactcaatatatattactttatgttaacttagttcttcctttgtatttaactctaatttcttttctactttttctctttagggttaaaggcagctccatttacagagtatgactcttatctggatgggatttgggctgtcttctatcttatccttcatgtggtttattttttgttatggaatcttttaatgtcagatgttgctaggcaatcttttctggcttgattaatttagttctagtacaaacaaaaatatatccaaatctccactaatgttgtttctcttccaaaataaatatgttctacttttgtgtcaaatggcttttatgatgtggttccagaccttcacagggctgtgggtgatcataaacttagtagtttaactatttcaccattcattgttaatataaatccatggagaacaaataataagaagtgatgaagtactgctaaaataaaccctccatattaattggataggaaagcacatgagtttcaaattgtaagcagacaaaaaaagaggtgtgatttcgttttggaattcattctgaatctatatagtatggggaaaatgtgacctttaatttccaaggaaactctgatatgccataaggtgggcagcacatagtaacaggttcctacaattatttaggtgaataatcttgaggtctgaaaaatctacacaacttttaaaagttagcaaaggaaagcctgaactgctttaaattactattcaccaaagggaaactaaaatattctggcttaaaaattccggctaagagtgttggctttagatcttttaatatttaattttgaaatgttttctgattttctggttcctgatatctaattttatttgtacaggctgtggaatattgccaggatcattgcttttggtatttaaaaaaaaaaaaaaaagaacactattcaagggaacagcattcagaacaatcttctcttatccaaggctaatttccagagtagctttctgtaagattgtaccgtattttagagctacattaaaatgtcagaggactctatggactgtttgatgctgatggagttacactttcagaaatactcactgtgctggacagaagagccacagcgctgagaactacactgcttttgttattaacaggagtgtaagaggggaattcagtaaaaagggctagcatccaagttcacagtggatcttttcttccattgaaattatggattataatcaatggcttagaaggaacgaggttggtgaatctcacagaagagtttttgagatacttttattacacaaaaaagcttttgaatgaggcaataagccttcaaatggaatggcctccctcagatattttactcatttccagttagtcctcaaaaatgaacaatgcttctaactgaacaatcacagtatttcaacacacccaaggcaaactggggaggaagagctgaattatgatgaaagcctgtactattgtgacctttcccatgaccataattgatggatgtgcccctgaaacactttgcagagctgttgatatatttagaagtgtgcctgtgactcattatgctcatagtatggcaataaatgactatgaaggccaactcagtgcccaaggatatggttctttcatgtagaatcatcgtctgtagaatatacagttgggtccttttgggaattgtgcaagctaggctcagagctctgtaagcccagctttattttttatcagaatcaatatcaaatagttaatatcaaaatgtttcagcatccattctggtatgaataaaaatgaaatgctacaaatattttacttaaaagcttatgccgactttggtttctcctgggatgtacaaatgaggaaagaatgtcactcctaccctatcaatcagaaaaagctagctatactacaaatcttaatttttcttgagcctagagaagtgaagttttaggctaattagatacctaagaaaagacaggtgtcttcaagaagaaagagaacatgagcatggacttactaatgagagcagaaggaagacagggctggctgtcatacaagtaagtaagacaagttccattaaaatttaatacattcttaaagtctaagagtaggccactatgagaatacagaacttctggaaatttcagacagaagggaaatctgtaccatctcaatcttctccatgattatttaataacaaaacagagcccctctgcctactagagtagcagaagctaaatgataggcaatagcagcctatcactgtggcagtgacaagaatagagacaaaccatctccaaaatacgggtgcacagagaaggtctaatgatgaggtggtacagtaatattaataaaaaccgattgcagaccccaccctgaacacaaggtaatgatggaggaatttgaagtcagagatacagtgaataaagccatagtaacaacacaacccaaatctggctcaacttttttgtagaatgacctaataccccaaaatgacagcctagcagagatgggtgcgcccattccaggcataaatactagtttcttgctgtgctgttctacacatatctggcattcagtgaaaaattatgaggcacacacaaacaaggacaaaacaacacacttataagagaaaaaacaatgaacaaagccagagatggcctgtataatgagccataacatagcaaatttaaaattaatatgacatgttaaaaagtctagccaaaaaagtagccaacgtgcatgaacagatgttgattttcataagagttaaaaatgaaaagagtcaaatggaaagtctagaaacaagtacaaagaaacagaaatgaagactgccctgaattatcacttaggcagacacagtgctgaaggaaaaaaaaaaatcagtaaacttgaaaataggtcaacagaaattacccaaactgaaacacagagagaaggatagtggctgaaacaggagagagtgtacaagggtgctatgatctgaatggattccctcccaaattagctgtttccaatgtgatagtattaagaggtggggcctttgaggtgattaggccacaaaagcctctccctcatgaatgagatcacccgcccttataaaagggtttaatggagggagtttgttcctctgttgtccttccacctcccaccacacgaggacacagcattccctccctcaggaggatatagccctcagacgccacatgccagtctctttaccttggacttccaccctctggaactgtgagaaatttctgttctttataaattagccagtctgtggtattctgttatggcagcacaaatggactaagacaatgggctatgtaccaagtggtccagcatacaccagctgaaatcccaggagatgagagagagaataggacaaaataaatatttgaagaaatagtggtcaagaattttccaacaatattaataaaacatcaaatcataagtcccagaagctcagaggtttaaggcaagtaaagcacacacacacacacacacacacacacacacacacacacacacacacacacacacacatcatatataaggtgtggaaaagtaaaaagaaaaagaaaatcttaaaaacagccatagaaaaaaggcacattacttaaaggtaagtttacagaaaggtaaaattgacaatagatttctcattagaaagtactagagtaagaagacatgatagaagagggaggaaaaatctaaggctgagtgcggtggctgatgcctgtagtcccaagcactttgggagactgaggcgggtagatcacttgagtccaggggatcaagactagcctgggcaacatggcaaaaccttctctctacaaaaattttttaaaaaagaaaattagccaggcctggtagtatgcgcctgtagttctagctacttggggagctgaggtgggaggatcacttgagcccaggaggaaaaaatccttgcaactgagaattctatactcaatgaaaatagccttcaaaacagaaagcatattaaagactttcatacaaaaaagaaaattcattaccaacagccatgtactataaactgttaaagaaagttcttcaggcaggaagaaaatgacacaagccagaaacttggatttacacaaagaattaaagatctttgaaactggttaaaataaagacgaacaaaaggctttttcccattttaattactctaaaagaaaattgacttttgaaagcaactgtaatacacatttattgtgtatgtagaggacatataaaagtaaaatctatagcaacatgagctcaaagtctgggaggtggagttggaaatatactgttgtaaagttcttacactattcacgaagaggtagactacatgaatgtagactgaaattaattagagatatatatatggcaaatgctagccaatgagatgaaaaacattttagaaagccaatagtggaaataatataatgaaacaaataataagtcaatagtggaaataaaatggaaatgaaaaatacttaattcaatatataataaaagaaaaagagaagatagagtagaaaacagcaagattgtatgttttaatccaaccataatggtaattatattacaattatattgaaatggtcaatacaaactaattataaaataaagatagatttaaaaagaaaaagaacaagatgcaaatgcattcaattgacaataagctcattttaattctaatgacaaaaaggtaaaaataagtatatggggaaagatatactatgcaaaaacactaatccaaaaaaaagttgcagtgactacattaatgtcacataacgtggatttcagaacaaggaatatttttagggaaaaagtgatattatataatgtcaaacgggtcaatacacaaagaagacttaacaatgcaaaggcaggggtgcctaatgacaaagatatgacaagcaaaatgaaagaggagacctagaagtagaaatggacaaatccaacattacggttggaaacttaaatacttttctcttcctttttctgtaataaaacaaatagaaagagaaccaataagtctgtagaaccttagcaaaactagcaaccaacttctgtgagctcactggtatttacaaaaaccaccaaacagcacccattcttttgcacaaggaacattcaacaagacaggtctcattctggaccatgaagcaaatctcaacctttgtatcaatctcaaatctttgtatgtaaaatcatacaaactgtattctattatactaaaaaaagttaatctagaaatggataacaaaaacatattagaaattctcacttatttggaaattaagcagcagaattatatgtaactcatgaattaaagagtcaaaaaggaaattagaaaatatttttctttgaaataaagtaagaatacagtgtaaaaagatttgtggaaaacagcaaaatcagtgagtcaaggaaaaagtatagccttaaatatactgaagagaagaaaggaccctcaaaatatgtacaactatgatacattaattttccaaaaagataaaaatgggaaaaaaggaaaagaaagggcttaaatcaattatctaaacttacatcataacaaaaacaaaaaaaggagcaaattaaacccaaaacaagcagaaggaaggaaataagaaagatgagaacagaaaaaccagtaaaattttttaaagagaaaaatggagaaaaaaatcaatttagccaaaagctgggaaaaactgataaacctctaagcagaattacagaaaaaaagagagggagagcagatacaattacaaacaccaatatttcaacaactcagaagggatgaacatatttcttgaaaaatactaattaccaaagcttactcaaggagaaatacataatgtaaacaactgtctatctcaaagaaatcgaaataaactttccaacaaggaaaattccaggacaagttgtattcatagcaaactctaccaataacttaaggaagaaatatgaattacctataaaatcttgaaaaacaagaagaggggcaaacactttccgactcattttgtgagaccagcattaccatgataccaaacctagatgaaagaattgtagtgaatagaaaactacagaccaaaattctttatcaacatagaggcaaaaattctcaataaaatcttagaaaattgaatcaagcactgtatacaaaagataatacatcacaaccaagtgggttgaaaccaggaatacaaagctgttcaatattggggggggaaatcaacataatttactgtatgaacagtcttaaaaggaaaaccacatgaattatcttgataaatgcagagaaatcatataactcaacaaccataatactaaaaactctctgccaactagaaataaaagggaacttcttcccttttattgaagttaaataatttaaaaagtaattttattttttttaatttgcatgcctgtttattaaataaaattaaagacaagggaattagaatagcccccaaaaaaattgaaaaagaaaaaagtgaagcccatactgcctgatttcaagattttctataaagcagtaatcaagaaagtatggtattaacatagaatagaatcataaatcaatggaacaaaacagtattttaccaaaacaaatatggtcagttagtttttttgccaaaggtgcaaaggaaatatgagcatgcaggaatagttttttcaacagatggcactggaaaaattggatatcaacatgcaaaaattaaaaaaaaaatccttccactcttatcttgtattataaacaaaaattaacattaaatggatcatagacttaaatgtaaatctttataaaatacctaggagaaaacatttgtgatcttagattaggcagtgatttgctagatacaaaaccaaaagcatgttccattttttaaaaatttagaaattagatttatcaaaatataaaacttctactcttccaaatatattgttaagaaaataaatacaaccaattgacctaaataaggtattactgaaagacatgtcagagaatgacatcaacaggatggcagaacagccatcagcccaattctcatcccagaagcactgatttctcaaccatctgcggataaaagttttaggagcttcaggatctaggtggggggttgtgacagcctggtggagcccaaggccatggaaagctgctttgacaaggcaggcctgtgccctggggtagcaggccaaccgcttgatgcagctccacaatcagaagcagtaacccatcacccaccatcagctccttttcacgcagtcccagagggtgacccacccacccagtacagaggggtcacacccacccataccctccagtagttacaggcccactgattgtggacccgactgcatacacgaacacagccccatgaccaatggaacagaacagaaagcccaaaaataaatccacgctaaagtttctgctatgcaaaataagatctggagaatgtttttaaaggcatgtcagataaagaatctgtatctagaatatgtaaagaactctcgaaaaggtaagaagataatttttaaagtaggccaaaaaactgaacagacatttcaccaaagaagatatacaaatggaaaataagcacacgaaagaatgttcagtatttagtcattaggaaaatgtcaactaaaaccataatctgataccactaccccactcattgattaaaaattgaaaaaaaaaaggaaaaaaggaaaaaacagacaacatggcaaggatgtggaacaactgaagttctcaggcattgcgggtggtcatgtgaaatgacacagccactttgaaaagttgtttggcagtttcctaggaattaagtatatacttaaccacacaaatctaaaaatcttgcttcatgactcttacccaagaaaaatgaaaacttctgtccccacaaaaactgaatgtttacagtggtctttactcacaatcactaaaaactagtaaaagcccaaatgtccttcagctggtgaattcataaatacactgtgtttatccatacaatggaatacagataaaattcagccagaaaaacaaatttgtaatacagatgagaaaaatgaatttcaactgtattgtggtgacagaatccagacccaaaaggcctcatactgtacgattccatttaattgtcattctagaaaaggcaaaattataggaataaaaggcagatcagtggtggccaggcactgaaggtaggtaagagtgatctgggggggcttttgaaactgttctagatcttgatttggtgcggtacacatttgtcaaaacacatgaaaaaatacactaaaaagggtgaattttatatataaattataccgtaatagaactgaccaaaaaacacataggaataaactagatgcctctgagatttttttcaagtctaatggatcaataggaataaacatggtctgagagatagaacctacactaacagaacaaatctcgtataggctctatccaaagcaataagtactgatccagtctaataatgatgatgatgatgaggctaaatatcatagcccccacattccctggctacaaaaaaaaaatatgctcataagatctttttatctcctaagacccaagatcaatcatcagcacccacatggtcatttccatatggctttgtctgtctcctgacttgacctactttcccagccaactctgatctttcttactcctctttgttctctggtactcccaatctgtcatcagcaaaatccacaggtatcctaaacattttatgtaaatgctctcttgaccatcttgctgtatctgaaagctgagttcctttgaggacactgcttctcttatagccttagtcgtctcatggggttgctattttctctctcaaatctctgtgccacaaggccagcagtttcaatagttgtctttcttgtgcttattgctccttccaaatcattgttcttctcatatcaatagaaacttctagcaatttgaaagtaacctctgacatcatagtacccaatacccctccctgttgtggtcacctactgacatccatctcatggggcatttcttgaagagtttagcttgtggctccctctgtcccttcaacaccagtgttttcacagttcttcatatccctgtagaaaatccttcccctatctcagcctttacgtctcatgatcatcacctcacctccagtaaccttgatccttctgcgactcactctccagtcatacctccaacaactcttccaccttctcactgtcagctgatagcctcatttctcatttcatgaaaaatagaagcagtaagagaatgtcctcattctccatccagtggtctacccacctaactgcacgtttactgtgtaccccaccttccccactattccttcagatgaatatgtttccatctaagctcaacccttccacttgtgaactagtactcaatccggctcacacaatagaggaagtcactcttgcagttggctgctatcactgtcggaataaaccaaccgtcgaagaaccatctggacacaatcaactttcaatttcctctatgaggattacacactttatgcactcttcctcttcattcagtctacctcctatcccatcatctccactccctcctggcctgccaacatgaaacaattttagtgtttcttgatcaggggtaaattgtacctgtagatgtctatctggtggcaagctgcacctaaactcccaccccaaaaggctacataaagcggcagagcacagattctttggtgagatcacaattcagccccatctataaagcaagcacttactgattatctgaccttagactctgcacctcacccgcctctgtgcatctcaggtaccttcgtgcttgcttggctttagccaactgctctgacttgacacattgctactgtttattcgcagctggacctctggccagctaagtagactatgttcactttttcagaataaatcaagatgcattatagcacatgaaaagataaaaattgccaaaggaagcatttagcaaaagaaaaacaggcatttattgatctccttccaagagtctgcccatctaaccctgtttctcggttttatgaacactcacgcagccttggcaaaaagaaaaggtgatgctcaagagtaccttgctgcatacttcccaactttaattcaggtgccacgggccttagatagaaatctcccagctcagagcagaacaatgattctactcaaaccacttgtcctctcaccaagagtacaggcctactctacctcatgcacaaaggatgggctctgttttgctacaggtggttctggtaaataggatcaaaatgactgctttattatcaatcaaaccacataaagttgggtcagggcagaaaggactggacaccagttctggatataactgactcatttagcagtatgcctctaaaatcctttcccaggcaacccaacccacccaccttggttcataaactgcctgtgccatatctggcctctggtttcccctcacaaatactattttccaaacttacatctgtttatttcttctttaccgctgccatgtcccttaaatatttttctcatgtctaaaaactccagaaaaaaatcattagctaaaattaactaagcatatcaatggttttgaatataggcaatgtttgtattcctgtgttataaatcgggaatctcaggttcaggtaatttaagtagccaaaggtcatacaagtgaaggtcagtgctcaaatatgaatttggggctcttatttgaacccctcttactttccattaggccatgctgctgctagtagcggtaaaggaaggacacaaggcataacagtctatgaggccaaaggcagtaagaaacagtgtggaattgtgtgtggcacatagtaggtactcgtgctgaaaacaacattgagttactcaatgaatatacaattgattcccagattccatgggcttcaaactcatttctacaatccatgatttcctatttcttctccatgctaagcagagcctgctgccatatggtaactttgccagtaacagtctagctgcttctaaccagggcctgctttcccttggctttagcactcaaaggtcaacttgaccttgcagggaaagtgagcagggagcaagcacctctgaggacacggcagacagctgcagtgtggctttgacatttacaagaaatgaaagcatctctatttagaaaacttttttaaagatacagaaaaagtaagtctaaaaatagccaagatctaaagttccccaaataattaatatcatgtccccataacctaaaggattctcttgatttcagtggaaaaaaactctgcttttaagtttgagagaccttttttcttgcagaaaactgggcaacatattgtctgattgggtaacttctttgaagcctgcctttattaggagttagctgctagtctgctcttccttggatctcaaatattttggttaaaaaaagcagtatttttagtattgctgatttatagttatcaaaaggctatgattgcagatcatgcacagtgcatccatctgggcaattatcttttggttctaatggttagaactgtggcagtttctgaggtgttagagttcaggttcaattcaaagcatcaatgatgctcttcatactagaccaggatctgcctctgtaagacagactcaattcccttctcttctttttttgcaacaaccacagccattaccccagcctcaaattcatatccattggttcagaagccctaaggaagggcattgatttcagagaggaagcccaacatgtgcaggattttttgccctggatccagtgatatctttgagaatcagaaacacttattctaatgtattttaatttacttttcaaatggagcatttaaacaaaaactgtttattgggttcaaattcagagccaagttgtgtgtcgagagagtcttaatttttcataacaggacatgtttggctctaatgtgtgggttatgagtcaatatatcaaatttgactaaagtatttgctctaagtagggagcaagccatttagcattacaaatcctgaactttttgcaggaaggagggaaataactttgatttctaagctctcttattaagatgaatcaaagttgatgaataaactttctggattgcttaataccttccagatatcagtatcaaggccttggcaaggcaggtgaaaatatttccatgagcaagaagcaattgagaaggacttcctctgtgggataaattcttggtaattcctgtgggaaattttcctttatcctaacatctttttttttttttttgccttgcccaattctcagtgtttttaaatacacaaaatacggctttctactaaaaactggtaaatgaagttggaaaaatacaaacacacacacacacacacacacacacacacacacacacacacggtagcccttttattgcagccatgtacgtagcttcgctgaagagttgacaagatatattgtgcagccacagagagacaccacatcttccttcctcccagcacaacttgtacagtgattaaatgtgattaaagtctcaggaacttggacacagtcatatctattttggtaccactgtcttgatccatccctacagccagaagggaatcaccctctttgtgtaaatgtttgctttgttggaaattctcaagcagaaattaatagtatacatgcttcaggaggagtagtaaatcaagcatgataaacaactcctaggcagtgtttagactggccaaaagtcatcttaagaatcgtgcacaatgatagaataccacgtttggcatctatacaccagaactatctataaacaaaaagcaaaatggagatctgtcaattaaccaactagtctgattaatgggatctgtcagcataggtggataataaatgactagaaaagtagcaagtctccactcattctatgtggtgtagacacagttaaatgaatcatgaatgtttagtgctctttatagcagttagcgaacacacttggaacttgtctcgaaattagttttgatctcttgtttgaagtcagatgccaatattctagacccctatgacatcatctattacagactcctggttatcgaagagttgaaactagtcagatagaattggcatgaaaagaattttcaacagaaaacaatcatgttcaaggaagccaagtctaggatttcaggagctcaaagtttcaaatatttttataaaaacatacatacatacacacacatacatacattcatgtggagagagaaaatgaaaagcaagaagaccttttcttccttagtccaaatccaatttaataattatccagggtattctcagtaaaaaccaggtatttatgcctctatatgtatgtcaccaaaatggagccagcttacctgaaggtcctctgaggctgtcactttcctctagtgctgtcccataaacctgaaggatatacaataacaaaggggacaattccgtgggacgaaaatcttattttaaataacttctctatactgacttcaagccaaatgaaaaaactacagcttttttggaattttattccatttctgttgtctgattcataagtgttgttaaatatttaccaggaacctgccaacagtttctcaacattagttaatcataggtaatgctattccattaacaactcaataaacttctttaaagttgtacaaggtaaatttcagtaccttaacactgctaacccatccttgtagaataaatatttgctttgagtttctctatgccaagatttatgggatcaagtaatctaaatctccttttgtaaataaggtgtgccctcaagaggatgagagtgcagactctacagtcttgtctgccttctctccacaggtccttgaataaagcgttccatgtctccagataaacagacttggggcacttctgaccagtatcccagcagcagaggctttgggaaatattttcaagacggttcaagcctcccttccacagattctctcacatctgccagcctgaagtgggctgtgttggttcatgtctaccaggacactaaatggctgaaggccattttttctattctaattattgttgcttctttgtaacaatttttataaaagtccagcctaatttctttcccagcacacatgtatcttcagacacacatctaaatccaggctttcatgattaatcctactctgagtcagctgggatagagctctgatgatgggatatcctacatggtcattaactgctgtttgcacaaacacatcactcaacgtgacttccactggatctaccttgtatgcagagtagaaagctgcttgtatggagtgacttctctgttgcctgaccaaccacatgcaaaaataacctttccactcactgatactgaattctaccaaagaagacaagccatccaatcaacaactctcatagtaaagcacatggcaaacattataactgtattactgtattataaaactgtattattaaagtctactcttacagaatactcgaggaaattaaaaaatgacaaattctcatttatgtacacaccacttatatcaggttcttctggagaatatattctgtttgacggaagaggaaggaagagaggataaattatgtttattggagaactacctaacccagactttgtactaggtgctttttgaaaattatctctttaatttctgcaaccacaataagccacagataaccctgtctttgcttcagagatgattgtgcccagtctcataggagttaagcaatttttcccaagtcctatagctggtaaataatcagtttaagattcaagtaaatcattttatcaaagcaacattgaggcaagaaagaagagtatgatatacaatttttaaaagcccagacacccacacatttcctgtaaggaaaaaaatgtattgatgtgtatgataaaaattaggccctcagctccttgaaaaagaattgtttgagcccctgtaaatctttacccagttagtgttcaaataaatattcctgtaaagatatcttcagggtgagaaaagccataaacaaactccattgtcatttccagcatttaaatcaggactaatcacaaggagccagtgttagcccaatccccctcacctagttcccctcactctttgccaatacgcagtttttaatctgtttcaggaaggagtccgaggcggtttggaaatacaaattaacctgaaactacttcctaaggcattaccagaaatcacgttttagatgtcaagatgacttgcattgttctaaacttccaggctgtgccaatggccacaaaggtaaatggggcattgggacaaccatgtgaaggactaagttgcaacatgaagcaagcacactcttccgcatgagtcacctgaaaatgaaaagagaagaatagctggaaaagatgatactgtctgacaacagcatttcaaataagacacaaaaaacttgtctgcatttgctttcaggtcatgaaataccacatgaactgaatgtttgagaacccattagctatggatcaccctgattcaacaacccaattaatcatattctcaggtctatggcataatcagtgtttctcaacctacactgcgtaataaaattacctgaggaaatttttggctttttgagtgtttttatttaaaaagaaaaaaaaaatcaatgcctggaccccaataccaaaaatttggattcattgctatagggtagaggccaggcactagtatttttaaaaaagctttccaggtgattctaatgtgagtcatggttgagcaccactgttagttgtatgaagtggatttagaaatcttatcccttagacccttagggttgccagagctgtcatggctatgaaacctgcaagaatttgggcaagttactggtccctgagactgtttccaaatctccaaagtgaaagccagaacaccttttaggcacatgctttatcatggaggcctgacgatcatggtttcaaaataaatatctgtgaacctagatactttattttccttcaatcatttttgattcatatgtctttagaatgtacactgaaatgtaaattgtatgtgaatatatcttccacatgtaacagcattacttcttttgactatgtaacttaaattatgttttcaggatgccaaaacaattggctcaaaagtaggaaaatattgttacctaatatttgctgcgtctctatatccctaagttagaaaaacagcacgttttgattttatgtttgttgattttattctatttaaaaaagaccagctaccccatatttagaggctcctacttcatatcaagactcaagttgcaagtcttggaaacaaaataaaaccccaaacttagtgctttagactttttatacatcctaccctatgttactgagaaatttgttgttgtgagaaggaagactttaacttgcatatgtacatatacatgcaagtatgctagcatgattcctgaaacaaagtgtttactagatatttattaagattgtttttaaatatgaacttcaacatcttgattgaatgatgaaacatggacatatgaatcaaactttggtatctgctcactatcaaatgctatagaatcaagaaagtgagagcaacaatatttcctgtgcaacacactacacaccttaaatttggaaatatcttttgctttcatgaaagttttatgataattcctatttacaaattttgaggggtggtttataattctactgtattctgtatctgtaatcaaatctttgacaaatcagttgaattttcccccacaaacataaaagacacagaatcaataaataaaaatactaagatacttcacacagcatcttttgacatttgtaaagaattttagagtacaaagtaattctcttttagtgaatgcatggattatactattatatagaagagcactacttagatcatagtagagaaggatatatctacgaccctatgagactgatgctgctagttgttgccaatatttaccctcacacttcattccttggggtagcaatgtgccctggcacaggtgatagagtatgactagactgaccaagtcataattttgttccttatttcccagtctcccttgcagccaggtatagttatgtggtccagtcctggctatgagaagtacagggaagtctcctggtaggcttctgtcattgtgctttcctgacaaaaggagataggcacaagaggcatagcccattccctccagcttcctgcttaatgaggcatcctgtaattaactgaagtttcagaagctatcttgtgaccataggcagcaatcctaaggataaaagacaacaaaacaaggacaattggactaaaagataaaaagatcctggatctttgatggaagcatcagggagctaaatcaatgccagcaaacacctactctggacttcctattatatgagaaaagtaaactacttaggagaaaatcataatccccatgtctgaaagagattttaaagcatgtattttctcacaaatcaccactaaagaacttactcatgtaactaaatacaacctgtaccccaataacttatggaaatatagaataaataaatttcatatgggatcaaagaagaccctgtagagccaagacaatcctaagcaaaaagaataaagctggaggcatcacgctacctgacttcaaactatactacaaggctacagtaaccaaagcagcatggtactggtaccaaaacagacccatagaccaacggaacagaacagaccccagaaataacaccacacatctacaactatctcatctttgacaaacctgacaaaagcaatgcggaaaggctcttctactcaataaatggtactgggaaaacaggctagccatatgcagaaaacagaaactggaccctttccttacaccttatgcaaaaattaactcaagatggattaaagacaagtgtaaaaccccaaaccataaaaaccctagaagaaaacctaggcaataccattcaggacataggcatggggaaagacttcatctctaaaatactaaaagcaattgtaaagaaagctgaaattgacaaatgggatctaattaaaccaaagagcttcttctgcacagcgaaacaaactatcatcagagtgaacaggaaacctacagaatgggagaaaatgtttgcaatctactcatcagacaaaaatccagaatttacaaggaacttaaacaaatttacaagaaaaaagcaaacaacctcatcaaaaagtgggcaaaggatatgaagacacttctcaaaagacgacatttacgtggccaacaaacatgaaaaaaaagctcaacaccaccaatcattagagaaatgcaaatcagaaaccacaatgcgataccatctcatgccagtcagaatggtgattattaaaaagtcaagaaacaatagatgctggcaaggccatggagaaataggaacacttttacactgttggtgagaatgtaaattagttcaaccattgtggaagacattatggcaattcctcaagcatctagaaccagaaatatcatttgacccagcaatcccattactgggtatatacccaaaggaatataaatcattctactatacagacatatgcacatgtatgtttattgcatcattatttacacagcaaagacatggaaccaacccaaatgcccatcaataatagactggataaagaaaatgtgatacatatacaccatgaaatattatgcagccataaaaagggatgagataatgtcctttgcagggacatggatgaaggtagaagccatcatcctcagcaaactaacacaggaatggaaaaccaagcactgcatcttctcactcatagtgggatttgaacaataagaacacatggacacagagaggggaacaacacaccaccagggtctgttggagggtgggggatgaggggagggaatttagaggatggatcaaaaggtgcagcaaaacaccatggcatatgcatacctatgtaacacacctgcacattctgtacatgtatcccagaatttaaagtaaaagaaaaaaagaaaaagagttggagagaatttagggtgtgtcctggccaaggttacacaaagaatgcaagtaaaagaaagaataactactggacaaaaaataaaaataaaaaataaaataaaatgataactttttttttctgtcaatgagaaataatcttttataacaagtcaatcattaggaaagacatttcaagctcactttcactgttgcccttatttttcttcctaattcctgacactaaaaacaactatttctactacctccaactaccttagttatggccatataaacagactctttccctctccctctcaaatatatgtgaatatatgtgtatatatgcatatttacatagccaaataatatatactcaactttctgaataattccatccacttgaaacctagttttaaatgtgtaggaaagcaattaatatgagcaatagagtacagattgcacaagagatgcttctaatatactttatttccacgactagacaaatgcctttgcatatgttttaagaataataaactgaccacatatcctttccaacttaacgatttatgaggaagttggtttcaaataaaccaaaacagtgctacccacagaaatagcagagagtaaggatctcttaaaaggggcttcttcctcaccactgtgactcatcagaagcccggatttgaagaatgcatttgccttcaaaacctgaaggctattctaatcctgactccttgtacagacctggaaatttacctaaattgttaatgccctggctaccaaattgacacaatagtaatttcctcctgtttatctcataagatgttgaggaagttaccaagaaattttaaagtactatacatatcagtgctattaaaacattttttatttcatacactccacaaatacccagttaccaatttaaatataacaagtagtcctctacataacagggtactatcagccagacaataaaataactagcttattttagagcacataaaacatctcatccttatatttttacttggatgaaacacaaggttattagccttagtattttgtttaatcaaaagtcatttaaccaagtaacaatctgatggacaaagagccaagcagtaaaattataaatttccttaaagttctggaaaaatattctacagtttcaatatgttatataatatgtttaaactattctaaaaaatgtacccagagtctcaatctgtccagtctgcattaatccacaagaaaacaataagactatggtatatgacagtttatccataaaaaaaccacaaagatatctgcataaaatatttttaaaacatcatattctaaaaaacatacaaatacaaaccatttttagacatgtgcttatgaaaagtattacaatcatgagcattttcatggtgctcagaaagataagatttaagtggtatggttataaccaattaattggaaaaacagaaaagccaaagagatcacttataaaagcaattttctagtatgtcctgtgttgagaaaggaaatgtatactacctactttctaggagtctataattaatattacttaatctactttactatcaatgtcataaaaaggcaaagtatagttttatttttctttttttattatactttaagttctagggtacatgtgcacaatgtgcaggtttgttacatatgtatacaggtgctatgttggtgtgctacacccattaactcgtcatttacattagttatatctcctaatgctatccctccccactcccctcacccaacaacaagccccggtgtgtgatgttccccgccctgtgtccaagtgttctcattgttcagttcccacctatgagtgagaacatatggtgtttggttttttgtccttgagatagtttgctcagaatgatggtttccagcttcatccatgtccctacaaaggacatgaactcatccttttttatggctgcatagtattccatggtgtatatgtgcctcattttcttaatccagtctatcattgatggacatttgggttggttccaagtctttgctattgtgaatagtgccgcaataaacatacgtgtgcatgtgtctttatagcagcatgatttacaatcctttgggtatatacccagtaatgggatggctgggtcaaatggtatttctaattctagatccttgaggaatcaccacactgacttccacaatggttgaactagtttacagtcccaccaacagtgtaaaagtgttcctatttctccacatcctctccagcatctgttgtttcctggctttttaatgattgccattctaactggtgtgagatggtatctcattgtggttttgatttgcatttctccgatggccagtgatgatgagcattttttcatgtgtctgttggctgcatcaatgtcttcttttgagaagtgtctgttcacaccctttgcccacacgttgatgagttgtttttttcttgtaaatttgtttgagttctttgtaaattctggatattagccctttgtcagatgagtagactgcaaattttttctcccattctgtaggttgcctgttcactctaatggtagtttcttttgctgtgcagaagctctttagtttaattagatcccatttatcaattttggcttttgttgccattgcttttggtgttttcgacatgaagtccttgcccatgcctatgtcctgaatggtattgcctaggttttcttctaggattttcatggttttaggtctaacatgtaagtatttaatccatctggaattaatttttgcataaggtataagaaaagggtccagtttcagctttctacatatggctagccagttttcccagcaccatttattaaatagggaatcctttccccatttcttgtttttgtcaggtttgtcaaagatcagatggttgtagatgtgtggtattatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggcaatgtgggctcttttttgattccatatgaactgtaaagtaattttttccaatcctgtgaagagagtcattggtagcttgatggggatggcattgaatctataaattaccttgggcagtatggccattttcacgatattccattccgtatgatattggctgtgggtctgtcataaatagctcttatgattttgagatacgtcccatcaatacctaatttatgaagagtttttagcatgtaggcctgctgaattttgtcaaaggacttttctgcatctattgagataatcatgtggtttttgtctttggttctgtttatatgctgcattatgtttcttaatttgcatctgttgaaccagccttgcatcccagggatgaagcccacttgatcatgatggataagctttttgatgtgctgctggattcagtttgccagtattttattgaggatttttgcatcaatgttcatcatggatattggtctaaaattctcttttttttgttgtgtctctgcccggctttggtatcaggatgatgctagcctcataaaatgagttagggaggattccctctttttctattgattggaatagtttcagaaggaatggtatcagctcctccttgtacctctggtacaattcggctgtgaattcgtatggtcctggattttttttggttggtaggctattaattattgcctcaatttcagagcctgttattggtctattcagagattcaacttcttcctggtttagacttgggaaggtgtatgtgtcgaggaatttatccatttcttctagattttctagtttatttgcgcagaggtgtttatagtattctctgatggtagtttgtatttctgtgggatcagtggtgatatcccctttatcattttttattgcatctatttgattcgtctctcttttcttctttattagtcttgctagcagtctaccaattttgttgattttttcaaaaaaccagctcctggactcattgatttttttgaagggttttttgtgtctctgtcgccttcatttctgctctggtcttagttatttcttggcttctgctagcttttgaatgtgtttgctcttgcttctctagttcttttaattgtgatgttagggtgtcaactttaggtctttcctgctttctcttgtgggcatttagtgctataaatttccctctacacactgctttgaatgtgtcccggagactctggtatgttgtgtctttgttctcactggtttcaaagaacatctttatttctgccttcattttgttacgtacccagcagtcattcaggagcaggttgttcagtttccatgtagttgagcggttttgagtgagtttcttaatcctgagttctagtttgattgcactgtggtctgagagagaatttgttataatttctgttcttttacatttgctgaggagtgctttacttccaactatgtggtcaatttcggaataagtgctatgtggtgctaagaatatatattcttttgatttggggtggagagttctgtagatgtctattaggtccacttggtgtggagctgagttcaagtcctggatatccttgttaacgttctgtcttgttgatctgtctaatgttgacagtggggtgttaaagtctcccattattattgagtgggagtctaagtctctttgtaggtctctaggggcttgctttatgaatctgggtgctcctgtattgggtgcatatatatttaggataggtagctcttcttgttgaattgatccctttaccattatgtaatggccttctttgtctcttttaatctttgttggtttaaagactgttttatcagagactaggattgtaacccctgcctttttttgttttgcacttgcttggtagatcttcctccatccctttattttgagcctatgtgtgtctctgcatgtgagatgggtctcctgaatacagcacactgatgggtcttgactctttatccaatttgccagtctgtgtcttttaattggagcatttagcccatttacatttaaaggtaatattgttacttgtgaatttgatcctgtcattatgatgttaactggttactttgctcattagtgatgcagtttcttcctagcatcgatggtctttacaatttggcatgtttttgcagtggctggtactggttgttcctttccatgtttagtgcttccttcaggagctcttttagggcaggcctggtggtgacaaaatctctcagcatttgcttgtctgtaaagtattttatttctccttcacttatgaagcttactttggctggatatgaaattctgggttgaaaattctgttctttaagaatgttgaatattggcccccactctcttctggcttgtagagtttctgccaagagatccgctgttagtctgatgggcttccctttgtgagtatcccaacctttctctctggctgcccttaacattttttccttcatttcaactttggtgaatctgacaattatgtgtcttggagttgctcttcttgaggagtatctttgttgcattctctgtatttcttgaatttgaatgttggcctgccttgctaagttggggaagttctcctgcataatatcctgcagagtgttttccaacttggttccattctccctgtcactttcaggtatactaatcagatgtagatttggtcttttcacacagtcccatatttcttggagtctttattgcttcttactcttttttctctaaacttctcttcttgcttcatttcattcatttgatcttcagtcactgatactctttcttccagttgatcaaatcggctactgaagcttgtgcattcgtcacgtagttcttgtgccatggttttcaactccatcagggtttcaactgcatcaggtcattctctacactggttattctagttagccattcgtctaatcttttttcaaggtttttagcttctttgcaatgggttcaaacttcctcctttagcctggagaagtttgatcgtctgaagacttcttctctcaactcgccaaagtcattctccatccatctttgttctgttgctggtgaggagctgcgttcctttggagggggagaggcactctgatttttagaattttcagcttttctgctctatttttttccccaactttgtggttttatctacctttcgtctttgatgatagtgacgtacagatggggttttggtgtggttgtcctttctgtttgttagttttccttctaacaatcaggaccctcagctgcaggtctgttggagtttgctagaggtccactccagaccctatttgcctgggtatcagcagtggaggctgccgaacagcaggtattgctaaacagcaaatgttgctgccccatcgttcctctggaagtttcatctcagagggtacctggccatgtgaggtgtcagtctgcccctactgggggatgcctcccagttaggctactcgggggtcagggacccacttgaggaggcagtctgtccgctgtcagatctcaaaccccgtgctgggagaaccactactctcttcagagctgtcagacatggacatttaagtctgcagaggtttctgccaccttttgttcagctatgcccagcccccagaggtggagtctacaaaggcaggtaggcctccttgagctgcggtggtctccaccaagttcgagcttcttggccactttgtttacctattcaagcctcagcaatggcaggcgcccctcccccagccttgctgctgccttgcagttggatctcagaatgctgtgctagcaatgagcaaggctctgtgggcatgggaccctctgagccaggtgcaggatataatctcctggtgtgcagttttctaagtccattggaaaagtgcagtattagggtgggagtgacccgattttccaggtgccatctgtcacagcttcccttggctaggaaagggaattccctgaccccttgtgcttccctggtgaggcgatgcctcgccctgcttcagctcatgcttggtgcactgcacccactgtcctgcacccactgtccaacaagccccagtgaaatgaacccggtacctcagttggaaatgcagaaatcacccatcttctgtgttgctcatgctgggagctgtagactggagccgttcctatttggccatcttggagccaccttggcaaagtatagttttcaagttgaattttccctctcacaataccagccttcttaaaaaggccaaaggtactgtcacacattctcatttaacatccctatgcagagaagtagaaagtgagaggaaatgaggaaagatgaagcaaattaaaagatttgataaaaatattttgataaaagataaaaagtcacaaatctaatttcaagagttaaaagctgaagagtatagcaaaaatcacataattaaatcactaaaaatcattttttaaaaaccctttaaaataatcaaagaaaaaggatacattatatattaaggaacaaagataagaattacataaaacttctggtcagaaacattgaaagccagaagacagtggaaaggataaaaataaacctaacctagaattccacacctagcaaaaatctctaccaaaaaaaaaagaaggtgaaataatgacttgataaacacaaacagatgtaattcattgccagcagacatgcactgcaagaaatacttagaatagccttgtggaaagaaggaaactaattccagaggaaaattttgatgtataattaagcatgaagaacactggaaataatacgtaaacatgaaagcttttgaaatttttgaaaaccctttaaaagaaaataagttggttaaatcaaaattcaaaacactatattatgtgatttagaccacatgcagaaacaaaatacattggtgcacaaaggctagcaaaggggaaacgaaagtatttgtcgtaaaatccttatactatatatgaaatggtacaatgtttgaaaatagactgtgctggattaaagatacaattttataccctagaacaaccattaaaaatagtatacttgaggccgggcgcggtggctcacgcctgtaatcccagcactttgggaggccgaggcgggtggatcatgaggtcaggagatcgagaccatcctggctaacaaaggtgaaaccccgtctctactaaaaatacaaaaaactagctgggcgcggtggcgggcgcctgtagtcccagctactcgggaggctgaggcaggagaatggcgtgaacccgggaagtggagcttgcagtgagccgagattgcgccactgcagtctgcagtccggcctgggcgacagagcgagactccgtctcaaaaaaaaaaaaaaaaaaatagtatacttgataaggtggctgggcgtggtggctcatgcctgtaatcccagcacctcggagtccaaggtgggtagatcacctgaagtcaggagttcaagaccagcctgaacaacatggcaaaaccccttctctactgaaaaatacgaaaattagccaagcatggtgatgcatgtctgtaatcccagctacttgggaggctgaggcaggataatcgcttgaacccaggaggtagagtttgcagtgagccaagaccacaccattgcattccaacctgggcaacaggagcaaaactccatctcaaaaaaaaaaaaatagtataattgataagcctataatgtagataaaatgaaataaattatttaattcaaaagataagaaaaaagaacagagaaccaatggaacagaaaaaaatagcaagacctatttaaacccacgcatattgataatccattaaatgtaaattgtctaactctacaattaaaaagggaaagatgatcagattggattaaaattttaaaagcaagacccacctaaatgctggatacaacaaccccactttaaatataaagagactaatagataaaatgtaaaaagatggtaaaagatatgccatgttatcactaatcaaaacaaagttggagtgtttaaattaatatcagattaagtagatttcaaagtaaacaatattactaaagtaatattttgcttcaaagtaaataaagcaaaacctgatacaactaaaagaagtgaaagacaaatccataattatagttgaaaatttctaaacccccctctcaatgatagaaaaattggaccaaaaaagaaagatcagtatggatatgaaagacctgaatagcaccaacaagtttgcttaaatgacatttctaaaagactctaccaacattatcaagatacatgttctattaaagtgcatatagaacatttactaagatacaccagattctgggctataaaacaggttccaataagatgaaaagaacaaaatatattctctgaccaaaactgaattaaattagaaatacacaacagaaaaacatttgaaattcctatcttttttgtaatttccaagaaatccaaaggtcaaagaaatcaaaggaaattgtaaaatattttgaatttaataaaaatgcaagcacaacatatcaaaatttatgagattcaactaaagcagtgtttagaggaaaatttacagcacttatagataaaagaagatttcaaatcaatgatctaatcttccttctaattatttttagaaactaaaaagatgaacaaattaaactcccaataggcagaattatgaaaataataaagatcaaaataataaacagtaaaataataaagaagcaataaaaccaaaggttggttccttgaaaatttcaaacaagctgataaagtctgtccagaaaaatcaaaagacagagaaaggaggagatagagaaacacaaataaccataatcaggaaagaggaaatatcactacataacctacagatgttaaaataataagggaaagtgatgaactttatgtcaataattttggacacttgatgaaatatttaaatcccttaaaatacatgatctaccaaagctcactgaaaaagaaaaaagtaatctaaatagtcctgtatttactaaggaaaataaattaatggtttcaaaacttctcacaaagaaaagtcctaactcatttggcttcacttatgaattctaccaaacacttaagaaataatgttatatatactgcaactcttccagaaaataagaggggacatgtccccattcattctatgagaatatcattaccctaataccaaaactacataaagtcatccaataaaaaaagaccaatatttcccacaagagacacaaaattccttaaaagtttagccaactgaaactaactatgcataaaaaaattatcactgccacattggctttactctgaaacacaaggtcttacattcataaattaatcaatatagttcatgaattccagagcctacaaaaggaaatgccatataaaaataccatttaaataacatatatagaaaagcccctccacaaaattcaacaaccaattgtgataaaaatttatctgcaaactaggaatagaaggggactccctgatactaagaaagggcatctatgaaaaacctactgctaacttcatgctaaatggttatagatggagtgctttcctcctaagttcaagaacaagcccatttccattctacactattgtggaggtcctatccagtacatatgtaagaaagaaaatcaaatatatatgaattgggaaaacaaattatccctctttttattcccagaatatatgatagtctatgtagaaaaatctgtggaatatacccccccccccaaaaaaaacactccattataattagtgagtttaacaagtttgtaaaatgcagaatcaacattttataatctactgtatttctatatgctaacaatgaataattggaaatttaaatttaaaacaaagcatttacagtagcaccagaaattaccaagtatttagggataaacttaaaatatttacaaggttgggggaagggcctagatggtcaattagaagcagcttctgtctacagctcccactgagaagaaagaaaatggtgagtgaatcctgctccatcaactgaggtatccaggttctgtcaatgagactgactaggtggttgacccacacaaagagaggaaaagcagagtggagcaatgacctgagagctgcaggggataaggggagctcccacaccaagccaagggaggtggtgagtgactatgctaccccacctgggaaaccacactttttccatggatctgtaaatcccatggatcagaagatccccttgtaagcctatgccaccagagccttgggtcccaaacagagagctgtgcaatctgctcgagttgcagctagcagcagcaggctagacacagcctaagatgaccatgttcctgtgaggaggggtggctgccatcactgcacctccagtcgccattttccccctgctggtgttggggagactgggtggtttggactgagaggaattcccaatagtacggcacagtggctgtggcagattgtggccaggctgtttctttaggtgggacccagatccatccctcctcaccaggcagggcctccatgcagaaattgcaacaactccagctaggggtttacagacggaactttgatatccctgggaaggagcccctgggggaaggggcagacatggtttcacagttcagtggatctcacagttgacatgtatttgtaaagagctatgacagttctgggattttatactaccagcaaactgacaagttagctccccacccctcaccagtttcatggattctgacagaagacacgcctgctggcagtccagacaaggggggattctctccaacacagccaaacctgctcagccaatgggcagccagacggtccctgatcctgtgcctcctgactgggtgagacctcccaatgggggtcgctagacacctcatacaagagtgttccagctggcatcagcttggtgcccctctgagacagaactcccagagggaagagcaagcagcaatctttgctgttctgcagccttcactgatacctccaggtatgggaggaactcaagtaaattgggtctggagtggtcacccagtaaaccacagctgccctgtggaagaggggcctgactgtttaaagaaaaacaaacagaaagcaaccacaacaacatcaacaaaaaagaccctacaaaaaccctgtccaatggtcagcagcctcaaagatcgaaggtagataaacccacaaagataagaaagaacgcaaaaacactgaaaactcaaaaagctcgagtacctcttctcctccaaatgatttcaatacttctcaagcaagggcacagaactaggctgagactgagatgaataaattgacaaaaataaacatcagaaggtaggtaaacaaacttcactgaactaaaagggtatgttctaacccaatgcacagaagctaagaaccatgataaagcagtaaaggagctgttacccagaataaccagtttagagaggaacataaccaacccaatggagctgacaaacaaaacacaagaacttcatggtgcaaccacaagtatcaatagccaaatagaccaaatggaagaaagaatttcagagactgaagactatcttgctgaaataaggcaggcagcaaggttagagaaaaaagaatgaaaaggaatgaacaaaacctctgagaactatgggattatgtaaaaagactgaacctacaatggattgggctacctgaaagagatgaggagattgaaaccaagttggaaaacatgcttcaggatgtcatccaggaaaactttcccatcttagcaagacagaccaacattcaaattcagggaatccagagaacccaagtaagacactccatgagaaggtcaaccccaagacacataatcatcaggttctccaaggtcaagatgaaggaaaaaatgttaagggcagccacagagaagatcaggtaaggccaggtcacctacaaagggaaacccatcaaatagcagacacctcagtggaaaccctacaactcagaagagactgggggccaatattcaacattcttaagaatttcgaacccagaatttcatatctggccaaactaagcttcataagcaaaggagaaataagatccttttcagtcaagcaaatgccgagggaattcgtcaccaccaggcccgccttgcaagagctcctgaaggaagcgccaaatatggaaaacaaaaaccattaccagccactacaaaaacacactgaagttcaccaaccaatgacactatgaagcaactacattaacaagtcttcaaaataaccagcaagcatcatgatgacggaatcaaattcacacgtaacgatattaaccttaaatgaaaatggactaaatgctctgattaaaagacacagaatggcaagctggataaaaagacaagacccattggtgtgctgtattcaagagacccatctcacatgcaaagatacacatagactcaaaataaagagatggaggaatatttaccaagcaaatggaaacagaaaaagcaggggttacagtcttagtttccgacaaaacagactttaaaccaacaaagatcaaaaatgacaaagaaggggattacataatgctaaagggttcaattcaacaaaaagaactaacccaatacaggagcacctatttcataaaacaagttcttagagatctacaaagaaacatagaatcctacacaataatagtgggtgactttaacaccccactgtcgatattagacagatcatcaagactaaaaatgaacaaagatattcaggattgaactcagctctggatcaagtagatatgacagacattaacagaactctccacccaaaaacatcatacacattcttcttggtgtcacatggcacttactctaaacttgatcaaataattggaagtaaaacactcctcagcaaaaagaactgaaatcataacagtctctcagatctcagtgcaatcaaattagagctcaagaaattcactcaaaccacacagctacatgggaattgaataatctgctcctgaatgattcctgtgtaagtaatgaaattaagacagatatcaaaaagttctttgaaaccaatgagaacagagacaacataccagaatctctgggatgcagctaaagcattgttaagagggaaatttatagcactaagtgcccacatcaaaaagctagaaagatctcaaatcaacatccttacatcacaactaaaacaactagagaaccaagagcaaacaaaccccaaagctagaagaatacaagaaataaccaagatcagagtggaacttaaaaacccttcaaaaagaatcaatgaatccaggagctggttttttgaaaaaagttaataaaatagatagactgctagctggctagactaataaagagaagaatgaaatagacacaatacaaaatgacaaagaggatattatcaccaaccccacagaaacacaaactatcacagaatatgatacacgctttaatgcaaataaactagaaaatctagaagaaattgatatattcctggacatttacactctctcaagactgaaccaggaaaaacttgaatccctgaatagaccaataattagttctgaaattaaggcagtaataaatagcctaccaaccaaaaaaagcccaggaccagacagatttacagctgaattcaaccagagttataaagaggacctggcactatttcttctgaaatgattccaaacaactaaaaaagagggactcctccctaactcattttatgaggccagcatcatccttataccaaaacctggcagagataacgaaaaatgaaaacttcaggccaaaccactatggcacatgtttttatatgtagcaaacctgcacatcctgcaaatgtacccagaaacttaaaattaaattaaattttaaaaaatatttacaaggtttataagtggtaaatataaatcattacatagagaaattaaagacctaaagaaattaagaaacacattgtgttaacaaatcaaaacagagtattgtgaagaagtcatttttccccaaatagatctaacaatcccaataaaatagatcaacacaatcccaataaaaactccagaaaccttttgtagaaactgtcaagctgattctcaaatatctaaggaaatgcaaatgatctaaaatacccaaaatactttccaaaaaagaagaaagttataggacttctacaacctgattccaagactttattataaagcttcagcaatcaagatagcatgacttaaagatatagattaaggaaacagaatagaaaatatgtaaacagacctatctatgtttaagcaattcatttttgacaaaggtgccagggaaattcaatggagaagagagaatcttttcaacaagtggtgctggaataattacatatccctaagtgaaaaaagtatatacaacataaacctcacactgtatataaaaattaacttaaatgactcatgatcctaaagttgtaacacttctagaagaaaacagggaaaaaaaattttgtccttaggttaggcaaagatttatcataggggacaagaagcaagaacagaaaaaaataatcccaataaattagagttcacaaaaatttaaatagtttgctgctcaaagccactgtttaaaaaatgaaaggcaagccacaagctgggagaaaaatttgtggaaaacatgtatttgtaaagagctatgacagttctgggattttatactaccagcaaactgacaagttagctccccaccgcccaccagtttcatggattctggcagaagacatgagattcctgagtcacagacaaaggactttattactcacagtagtggggatggtgagatgtacgtgtgtgactggccccgatagatgctgcacatgcagtagatttgtcttgccactgagtaactccaagcttaatagcccagtcttatttaaggcctgcaagaaaacaagggagatatctattatcttggacaccaaatatatcttctctttcccaaaaggaaaacaatatctcaattatccaaggcttttttgctatacaaactcctttgaaaagatagtctagaacaatagttgtcaatgtccctgctcacaatatgtgcagaaatatgagagatccataaagagttatctccaaacagtaaagaacaggtgtgcagagaatataaagaactctctaaactcaataacaagactaacaagccacaattttaacaaaatagttgaatagacacacttcaaaaaaagatgctgatggaaaacagcatatgaaaaagtattcaatgtcattattgttaaatataaattaaaactccaatgcaatgtcccaacacaccctctagaatgactaaaatttaaaaagattgataacaagtgctgtggagcaactggaaatctccaacactgctggtgggaatgcaaagtggtacagacactttggagaacagtttggcattttcttataaagtcagactcatccttaccatctaacccagaaattccactcataagtatttacccaagataaatgaaaacatatgtccacacaaacatttgtatgttagtgctcatagcaactttattcataatcgacagaacctggatgttggaaattaattctccatgtgtttcctgtgtttctacatgtcttgctagtagaggcactgattgcctttgtttcatactatctctttaagcatgtgtacagagcaatttctcttttaaaaaggcaagttaaattaaaaatatatgtaaaacataagcattcaggaaaatgttatcagaattcaagagacctgccaggcaatttaactcagagttctagagtcatcttcacaacgatgaattgctgaaggaaaaataatcagcaatctcttgcttctgtgcaggtagatgattcttcacaaccagaaactgaatgctcacacctaagactggaactatttgcagactcaacattgggaaataatcttcacatggaactttccccctgcttccacaaggatctgcaaataattacagcagcacagaaatgtctatgctttttttcagaattgagaaagctttttaccatctccatttattctcccttgtgatagaactctattgatcattaaaaattaacaagccacccagtaacttcatcctggtgtctgacttaaaacaaaaagtttcttgcatgattgaaacggacatctcttgggcattttgaaaaaactggattgaaattacaaaactaatctggtaacaccatattttagttagatatataaacataacacagaaatttacacaacatcctgccccaagcacaaatataattcattttctaattctgaagaaaaatgagatgagtatgtaaaaatcattctttacctgaaattattgaaatatatatgatgtacatatatgtgtgtacatataatactaggattttattatgctaggtaagttaaataaggtactgcaaattatttgaagaactatttgataaaaactacatactgtagaatctgaaagaaaataactgcataatttgaagtacctagttgtaaaagcagaaacaccacaatcaacagaaaaggagtatcttaattaccaaggagaaagtcactaattgttaatttttaaggtaaaagattaaggtgaagatcagcagttccaaggggttggggaatggaaaaataggtggaggaccaaggatttgagagtagtgacaatactctgtatgatactcgaatggtggatacatgtcattatacattttgtcaaacccatagaatatgcaatagcaagagtgagggaaaactggctagccatatgcagaaaactgaaactggacgccttccttataccttacacaaaaaattaactcaagatggattagagacttaaatgtaaaacccaaaaccataaaaccctagaagaaaacctaggcaataccattcaggacataggcacaggcagattaaaacgccaaaagcaattccaacaaaagccaaaattgacaaataggatataattaaactaaagagtttcttcacagcaaaagaaactatcatcagagtgaacaggcaacctacagaataagagaaaatttttgcaatctgtccatttgataaagttctaatatccagaatttacaagaaaaaaaaaatgaccccatcaaaaagtgagcaaaggatatgaacagacacttctcaaaagaagacatttatgtggccaacaaacatatgaaataaagctcaacatcactgatcatcagagaaatgcaaatcaaaaccacaatgagataccatctcacatcagtcagaatggtgatgattaaaagtcaggaaacaatagttgctagcaaagctgtggagaaataggaatgcttttacactgttggtgggaatgtaaattagttcaaccattgtggaagatattacagcaattccacaaggatctagagccagaaataccatttgacccagcaatccctgtactgggtatatacccaaaggaatataaatcattctactataaagacacgtgtacacgtatgtttactgcagcactatttacaatagcaaagacatggaaccaacctaaatgctcatcaatgatagactggataaataaaatgtggtacatatacaccatggaatactttgcatacataaaaaggaatgagattatgtcctttgcagggacatggatgaagctggaagccatcatcctcagcaaactaacacaggaacagaaaaccaaacactgcacgttctcacataagcaggagttgaacaataagaacacatggacacacagaagggaacaacacacatcagggcctgttggggggttgggggagcagagggaacttagaggatgggtcaatagaagcagcaaaacaccatggcacatgtatacctatgtaacaaacctgcatgttctgcacatgtatcccttttttttagaagaaataaaaagatttttaaaaaatagcaagagtgaaccctcatgtaaactatggactgtggataatgatgtgtcaatgtaggttcatcagttgaaacaagagtaccattcctggttcgaaacatgtcagcaggtgtggggtatacatgtgtgaggtggaggttcacaggcatctctataccttcctctcaatttggctgtgaacctaaaacttttattttaaaaaattaacttttttttaagttggaaaataagaattgttcttctcttcaaagtcttttatttaaagaccacgtattatgatatagtataccataccatgcaggcatgagctctacagtctaatgtgaaggccaaagataagtacacaaataactatagttctgaatataatccccaaaattctgcaggagaggttgatacaaggtagtagtcatttccgacaagagaaatcaaggaaggtgtaatgaaggaggtatttgagctagtcattgaaggatagctcagctctctgcaatgctgctggacacaaagggcattccaggtaagaaaaaaaaaaaaaggcagtaggaaccaagacatggtgggaagacatcatgagtttgtaattagattgcaaaggacattggtgacttttcctcactggtgtccaattctctaatttcatagcatataatggactgtttctgacactcttaagaacaagtcttcctgaatagctaatccttatttaataattattactgtgatatctttaaaacaaatcaaagttgttatatcattaatcccagtggtgaaggtacgttgttatatgtagttccaaagctgtttgagtgttatttatctataaataaacaaaattaactaggtaaatgaaaaatgtctaatctgtataggtattggagggagggaatatggaggttattaggtattttaaagaggtattttaatgatgagtatattgaagtacataaagatttaatgaaatgctcaaatttaattatttttcatttaataactgcttacatggaatattttagaacattaactcatttgattttcataacaatcttgatatggtgctactgtgatcctcattttacagatgaggaaactgagacacaaagcaattaagagactccccttgtcagcactaaagccaggattggttcccaggcaggtggaggtagattccatacaccaggttaccaatcactgctctagttgcctctccaaaccagttagtggcagagtgaaacccagaacacaaggaccccgagtccaaatctttttttttcactctaaaatatctgttactacacatccaacacaagttttcatgatcccagtcactaaggctctttgctacctctttatcaaaatgctttcttttctcctcaaattttagatatggttgtgtttcttatttttacagatggaatttctctccctcagctacactcaatttacatctccctacaaccaagccatgactagttaaaccacaacaaacaagcctcagcattatgcattccttcaacaaaaagggagagagagagaaaactaaccacacgtattgtctgtccatatttgtcctggaaatgaaggaatagaaagcaagctgttgcactggttcatacaactcatttgtagcacaaatacttggtggtggtgaattttatggtaacctcccttttagaggccatagctgaggaaagcaaaaggccctcttttcacttcattgtctatactcaagcatgtcatttcatccttgtggaacaggatattgaagggaatttttccctgaatgactggctaggatccatgactggaaacgacaggacagaagtatcctaacgttttagaacgttttagaatgtcaatagctgcagatagcacccaacatctgccaggattaagagatggcaaaatcaggcttctacttgtgcctagatgcctcctatagagatatctgattggtctggtgccactcttggcaataagatgttttttaaagctccccaggtaattctaattgcaggcaaggttggaatgactgctatacaagagaagggagcagtgcagacaataagatggtcatcttcttctcaagcagtgagaagattaccacttccaagtaagatgtatctttcttctctgaatagcctggagagtgggaatgtggttggaaagaagtccaagagggctttcctgtaagaaaggatgctgtttaggggtatgcttagactccgcctgtgtgggaagagaatgagaacaacattatggtacacagaagagagtgacatggaatagacagctatgctgcagccgtctttcatcataggttacccaagaaagctgtttaccaggtgccagccaaagtctgggttgtggcagcaaaaatctgtggctagactactggtggtggggattgtctgggctataaggtataaggttccactccgaaaaccgggcagtggacagactccactctgtgccccaaaggtggacacttggatgctgccccatagaggcatggaaggacagcagagaagcatcaaccaccaacaaagagatctaaaccagggccagatgaagacagacacctcctctactccctccttcaattccaagacacaggaggtatttgcgcctaaaagatgaagcagaaaaatttggatttctttggattaaattgtgagcttggaaattgaaaactgagctcagttatagtagtgataattaaccagaaatgtagagaatccaccaaagatgctgcctaaaagcagaaaagaagtcttctaaccaacaaaatcaaggcagaatggggcagatttgtggaagcttgcacatttgtccagaggcagtttatttctgtggaagaaaatggatatgctcaaaggatatgacagtttgtgtgactgactgactttaacaggaacaatgcgccattataccatcctttgtgtagaatgtaggaacgctactggttggatgctctgaacttggcttccttacaacttctgtgtcttctgccttggttgacgggggtcagaagtccaagtcgatggtgacttggctgcaatgagatatgaaacacacaccaagcagttgcactgactatgtacaaattatgtaactctttgaatctcaattttcttatacagaatatgggaataacatctgctcatgaggtggttttgaggattgcattttgcctcacaaaaatggctggcacgtgacctactcaataaatgttcataaaaatccatcttgatataacactcttctagcataaaattctagttaataacccccatttaaatgaacataagtacctaaaggactttggtgaaagattgtttcatagaaagggcatccatgtggcacaatagacaggacatccacggtcttatcttcctccagattaacgcttgtggtttcctggaaagtttttaagcacagttcatactaataacagccatgcatcggctattggatcctatttaaaagctacttcacttgatgatttttaagtattcagatttaaagtgtctggcccttttaagaaaacagtaaaataaagaaacagagattttgaatgagagaatactaacacttatacttccaaaactatttttcttcttaggaggtaattcagagctagacggcagacagaacaaatgctcggtaaccaggcagcaatctatggatcagaggaacacgaaggtaaaagtaattaaggctaattaaggacacattgcaacaggagaggcttacagaagaaaaaaaaattatacctttcctttgaatagaagttaggaatagctggaatggggcctagaaacatgaaaaagtaccaaaatagtctcaaacatggaagaacactaaaaaccttcctttagaataaaaggaagctaaattcttaaatactcagtttttgttagctattacttacaaatacatcctatgaactacacttaggactatccatttctttgacactaaattataagacaaaagcagctcatcaatatacatatcattttcttcataaataattgtatgaaaaagcaaagtcaaatgcaccttgctttccatcttggattccagtttatccttaccagaagaaaacctgtgagtgcagggaaaaggcaacccttatacactgttgataggaatgtaaatcagtacaacacctgtggaaaacagtatgccaatttctcaaagaactaatagaactcccatttgacccagcaaccccactgctggctatctactcaaaggaaaagaaatcattctatatttttaaagacacctgcacccatatgtttattgcagcactattcttgatagcaaaatcatggaatcagcctaagtgtccatcagtggtggattggataaagaaaatgtggtatataggcaacatggaaaactatgcagccatgaaaaatcatgaaatcatgtcctttgcagcaacatggatagagctggaggccattatcctaagtgaaatagctcaaactgaaaatcaaatactgcatgttctcacttataagtgggaactaaacaatgggtacacatggacataaagatgaaaataagacactggggactccaaaaggcagggaaggtgggaaggagtgagggctaagaaaaattacctattgggtgcaacgttcactatttgggtgatgggtacgctagaagcccaaatctcaccattatacaatgtatctatgtaacaaacctgcacatgtaccccactgaatctaacatttaaaaacataacttttaaaaaaagaaaatctattcttgggcaccaagatattccaaactccaaaccaatggcttttaactgtaaatgtacatcagaatcatctgtgagctttcaagacacacacacatacacacacacacacacacacacacacacacacaccccacacccactttgttcccaattcgaaccatctggatcagaaactcctagggtaagcatggcccaggaatgtgtattatatgttaagtctccagagatgctaatatgtacctcccatcataaccacaagccatcaccattccactggtggcagctaccgaaattgtagatattatcccccaaagaagagttaatccaaatactccctctcatgatcaagctgagagccttccacagttttactttacagtctctgataaactatcccagacaagtataacctaaattattttaaataaaagtctgtttgcataccaaacatttccaaaaataggaaacaggatttgcccaataatgatttattgtatattgatcaagactagattctaatatcgaagtcattagagcctctttcccaatgctctgcatcatctgtactttgggcagaatgaaccacagcagatgacaaaatcatctcttccttataggccattatctcctgctgtggggattggtcaatgaataactagcaattgggcacctattataacagagcactatccaggtgctatactttcacttaatctgtgtttttaaggaagttaaaatgcaatttgacagtcaacccatcagaaaataggcaacaggaacaaagggcaagatataagtttgaagtcaaagttatacaaaggagggaagctgttggctgagcttatcagagaataatttgtggaggacgtctgagcttggtcctaggaaatagcaataatgaggttagtagaaaaactttgaaaagatcacttgaactcaatttgtagttcaagaaatattcactggagatctgctacatgatcaatcctggagtagtcaatatggtagaagacaaagatgatgggcacccagtcctgttcctgaaaggctcatactaactcacagcaaagtacaagtatttatcatctacacaaacagctgttggaaaaacatggcaggcttcgtggaggtggtggcttttttagctaggtcttaatataaaggaatttgacaagaagaatatgaagaaaatgactttctaagacaatgaagcaggctgtatctggggaattaatttatttaattttctccaaattgtattgtatatatttgtatatcaaatgcgttgtttatatatttacataaagaatatacatccctgaaaaggaaaatattcctattttaattattcaggcagatagatgaccaatgcctcataggcaaattggccacgtgttcacaacagctgtttgcacctatgttcctccaatgagggaagaaaacattgaaaaaacaggatcgttgacttgccttcattctatgtctcaacacatgcaattctgacttagaattctgtgtttatccaattgtaccacaaagcttgcatttatggaaatataagacaaaaataaataaaggcactgggaagtgtttgggaaacatgacacatgttagcttataactcgagtacatggcagaggcagaattcatttcaatatcaagtctgtcgtcaccattgagaaagaaaggtttgatagactacacgaatcccagtgtttatttgtattgaacggtgtccccatctttcaaggcattttaaaaatgtatttatatccttttatgttctgaaaaattccttgttactcccattatatagataagaaagtaaatgcaagaaaagcccattatctcacaactaaattggtacccagcttcaatttctagttaactactaataaagtgaagctttattggctcttcatttaacactgtgatgttctgcccttgtctctctgccagatccacgtctccacctttgaaacaactgcctttgataccatgcctaacatattctaaggttaaaaggcagcttagagtgcattttagaaatactcagagggtttgatggatgttaaaatgctctcataaaataacatcttgatatgagttaattgtgaattaatgaaaaacatgtgaatcctaatacattcaaataactcattggttcaaaaaaacaaggcaggtctgcttagtggaaaacatgctgccaactcccagatatttaagcaaaaaatcatgacagtctaaatccaacacatgctggataggtctatctctgtgcgtaaatttaaagaaggcatttttgtgagtgctaaacaaccagtctcctgaaaatcagccaagcatttggagattatattctactgccccattaatactgtaaagaagtctatggaatggcaacgttctctgaaaagggtacctgaatcacctgggaagcagactcccaaagacagtgaagtctgccatttatcagattagaccactttctggtctgcagcagcttgaagcaaagaaaggactattggtttcagtttttctgaaaacccggatcctcataaggaaggcccttcacagtgaactcatgcaagtccaaatttaaattctgattcagcccagatgtcatcaataatcacggtcaactcccactggacaacattaaaaattgtcaccctcagagacaaactcattacagcttccaaaatggattagggcatttgaggtttctctattcttagattataccctagatcatttagtgctttgaaagtctgaaaggtcatcaatatcttttctttggctttgaaattaatccaaaagactatagactcaatataatagagagtagtatcatacaagtttttatgaaaagaatattcagaaaatagcatttttaaaagattttcctgccacggtttgccagctgtaatgatgagtgaggagagtctggagttaagaaagtcacctgggttaggaccctatttaagcaacagagaggctcaactcaaactaaagcaaaaaggaaactattatgtttactggggtaggctcagcattgaagaaagctgctggagccaacacccccaggaactccttacctcctggattctctctccatttgcctctcatccctcctcctcatatgttggcttcactctcttctggaagttggccttctctgctaacaggagacatggctactagcagcctcagccttgcaccaccccatgaatcacagggaaggatgctcattggttctgcttgtatcacatgctcaacttacgtcccgcggatgaaggagtgttagtagctacacctggtacccatacacagccagagatggtgggcttgtgactagaggaaggacagtgggagtgctctcttggcagactaaaaataataatagtaacagtgacggcctctacaattttactgtcttctacaatggcctgatagattgtggaggctaaaggtgtgtctactcgaggaggcaattgtggaaatgttctttcctccttatcacttgtcagaaaagcactcttcctctaaagccaatgttacagtgaagcaccccagataatttactgctattaacatatttggatatgaagccactggctgctgtacatccctatcctaggggttgactcagtatggctcttgctcttgctggaaataaaagaaccccacattttatacaattttggtactctcacaaggggtcctatatgctggggttttatatatgcagagtaaattcttgggtttctgacctaaggcaaatcactcttccttaaataattgccaatctctctcacctgtactttgataaaaagatggaaatcctcgaatgaggtagttctcaaacgtgggccctaatcattaccagcatcacctggaaacgcaaattgcagcattccaccaaagacctagtggagattctgacgctggtgcccagcaatctgttttaatgagctctcgaggtgatagcaagcacactgacatttgggaaccactgttctactgtatttatcactgacaccagcacaatcaaatgaatgtgggaaatgtgaggaaattccctctttccaaaaaagacagacatgctccaaggacactgaagtatctgatgagtcgaagaattgccaaaatggttgcctgaaaataggatattttgtgaatgagactcatgtctgggaatgaggtataaaaggatcataaaataaaggctatgcctagacaaattatgatattttcttaccaatgtaagagtataattcattaaatcaatccaattctgtgcatcagaaagagagggggacagagaacagaagagacaatgcaggaggaggagtggaaggagggggaggaggaggaagtttgactatggttgtgttttggttggctttgcccattggattgcaaagtaactcagaagttaagcaggataaataataatattagctaatgtttaagaagaaagggggaagatctggtaaatgaggacagaagcaaggtaaactataagtgatataacaacaaagaaagtgtcatcatacatagaaagatcaaggacagaacagactataaagttgcatgttatcattactatttttttaaagtgttatgggaacaagaattgaacgacagtatcatgaatagcattgtagattagatcaatgattgtttttcttaaaattgactctaataccaatgtatttccttgttaaggtatgctggctgaagggtactggtgtttgtcctagaaggtgctctgagagattctctgttcttagttcttattagaactaatacgttctatgatcatgtcctgcagggcctagcggtgccaggaggctgtgcggcacattattgttgcttcatgttgagcaaatctacacaggtgtgggttaatccagtttgtcaggtgttgctaatgtgatcggtgaatctgactgatgtgaattcattccaaaagcctggcagaattttggagaaagagctaagttgcacatcgatatttttaaaccattttgtttaaaatgcaggagagactggttgcagtggctcatgtctataatccctgcattttgggaggccgaggtgggaggatggattaagcccaggagtttgagaccagactgggagacatcgtgagattctgtctctaccaaaaatacaaaaattagcttggcatggtggcacagctgtagtctcagctactcgggaggctgaggtaagaggatcgcttgagcccaggagttcgaggctccagtgagcaatgtttgcaccactgcactccagcctgagtgacaaagcaagaacctgtctcaatcaatcgatcgatcaattaatcaataaaatgtaggggatacaacgtcttaagtcatttgaaacttccaagtcacatgtatatagtcaatggtgtggtcagcttagatacgaatattggtattaggaagaatatgtagcaaagacatggaaagaacaaaataaaaggactcacaaggaaatcctgctacactctaatcactggagtcacataagatgttgctgacaatggaacaacattaggaaaataacatgcagaatgtgaacaattaagcaaatgtcaagtgcagagggccaacccctataaagaataaataattggtgaagcatttatttctttagtacccaaggggaaaataaatagaaatggaagaaatagaacttgctcaaaagtggtttggcagtctgaagagcagctggatttaatttagctttcccaagaaaagagagggatttggagttaacccaacttgactgttcagattaactcagcttttatacattcattcattcattcatcaacaaacctccaccaagtggccaccacacaccaggcagacaatgtgctaggctttagggaagcctgtccccatgcctcccctcggctcctctctgcctcttccccatcctttcattttgacacactaactcttccctgaggagaaagtatgcagccacattccacactattcaattgttagaccacctaggataatctgaataaacataacctataacctaaaaaagttcaatttttaatgcatcagttggaatcaagttctatttcttagttaatcaaaaagtaagtctcaagagattacttctacttttgacctagtcctggagaaggctctaagatactaaaagggagttaaagaagcccagtgcctgccattgaaaggcttcctgtctacagtttaagcaaccagagaatacaagatcatttaaaatgaagaggcaaaaaaaaagatagcctagaagataaaatattagaggctgggtatggtggctcatgcctataatttcaatcctttggaaggccaaggtgagatgccaggaattaaagaacagcctgggaaacatagcaagatgctgtctctaaaaaaaatatccaggcatggtgttcagtgcctgtagtcttagctacttaggaggctgaggcaggaggatctcttgggccctggaattcgaggttgcagtgacctatgatcacaccactggactccagcctgggcaacagagtgagaacctgtttcaaaaataaaataaaataaatattagagagaggaaacacaaaatacatacatctttgcctatctttcctagctagtttgacattgcaagaactaaaagagaaagtagcaggcacatgtgggttatcaatgccattcgtcaaaagtaataattggcagttagtatctactcttctttgtgtaatgtcttccaggatgttgggcacatatgaatcaggtgtcttctttccattcagtggtgttgagacatctatgcatctggctatttcagataaggactgtgagtgtggagtcttgataaatttacagcattctggccttttcaaaagaaagtgagttttattccagcagattcagggtataaagagagctgccgcctatgcccctgccatagaccctagatagctgccttcccccacccatagtgatgcctttaagtttgagcatacacccacataatcaaaaagtataaacaaagaatcaagtctggtgaggagaccccagcctgactcaaaggcttaagtagcagccagtggattcctgatgcttcagacaggaggaaaaaaaaaaaaaaagatctatggtatatctatctcttgtgccaagctagattcagaatctcgaagaaacaaaaaagtccttatttcatgtaaaagtacacctaacctagccaacccttaactaggatttgacaactcctattatgatagagcctcaaataaaaaattatactgtcatctgaaagcatgcacaattagagccagatattgaagatatagttacagtttatctcaaagggattaatttaaaataccagggaaaggtctgattgctatgtttggggtgccctgaccccaagacctactatgaaatcaaaatgactcacctaattctcagatgagaatcacattgcgagtagagaaattccagactcagtgctctgaagacaaaaatcttaaaagcatgactattaagagttggaagaacattagagtttctactgtatctaccataatcttctatttaatgtatcaattctcactacaacattctagaaaaatggtcctcaagtttatttgaacgaggaaatgattatcttccaacacaatgtttacgtgaagagaaatcactgggtgcctaaaatgatgtgtattgcttgatgtcttttcctcatcctaatgataaataatcattttttcgtacctacgtgtagaagaataacctatgcccctatatgccaagaattttgatgccttcttaccctgccttttcccagattatatgagccagtaaatccgtcatgtgcctagcctatccattcacactagataaggaagagatttatagagaaaaaaaagaatatcacaagtgtcaaattagtatccactttccagttccaaagtaactaaagattccgtctatgttaagttagaaccattcatattgattgtgtgttgccttacatacatattgttcttcttcatctttacatccacagagaagagtcataaaatgatacagttaaacaactggaaaattccttagttgtcatctactttggccatgcagaagaaaatagagagatttaaaagagaaatcctgggtaaaatattttacaaggaagaaatagaaagaaaaggtgattacatcagataaaactggacctacttatagaaatgtgagccaaggccgggcacggtggctcatgcttgtaatcccagcactttgggaggccgaggtgggcagatcatgaggtcaggagatcgagaccatcctggctaacatggtgaaaccccgtctctactaaaaatacaaaaaattagccaggcgtggtggtgggtgcctgtagtcccagctactcgggaggctgaggcaggagaatggcgtgaacccaggaggtggagcttgcagtgagccaagatcacaccactgaactgcagcctgggcgactgcagcctgagcgacagagcaagactccatctcaaaaaagaaagaaaagaaagaaagaaagaaagaaagaaagaaagaagaaatgtgagcctagagaactgggaagttccacatttgcaaatcagccacccaaattaaagggcacaattaagaccaacagagctaacaatcaaataccaagtaatatgccaagtacttcacaggtatgaactcatttagtctttaaaataaccttataagataggttccaaaattatttcattttacagataaaaaatgtggctttgagaaatatgacttcaaaatctacactcttaaattctgtcatgtctacccatagatactgtggtacagcactaaattcagttctgagatcctgatgtcaaaaaaaaaatgcagaaaacaatgattatgttagcattttgattttccaacaaattaaatgggaccttcaaaagagaaaaattttgagaccaagattcagaaagaataaatcatgcctggccttatgttacaaatagtggatgtattaacaggcagaaaagagttttcaacatttttttcataatctgtttcttgtataatcctccaattaaagctgaggacacagtggtgacctggaacccagcgggttttccacaagtgaagaaggcacagaggcagaagaataaataggtcctccagcagagggtcctttgtttgcaaaagaaattttcctcatctggctcagtttaacttaggaagcaagcctaacaggagagaacagagatcatgaaactgattaaagcttctcttgtgctgcttcatgttcaggatgagataaatgagataaatgagaataaaatctgcaataaaacaacccgttgaggtagcaatataccaattaaactaaaactcttctcttgaattgggttcagctgcatctgtggtaattcttattctcctttcttccctgcgccactgcagggcacagagttccccctgcaccatgtccacacactgcttttctgcattctgcttatgttgctataatccagatagttattcattcacaaatatttattgagtctccattacatggggtccccaaagctaatggaagagttagccttcaacaactacctacatctgctcataccatcccctcttctcgttactatgaaaaaatgttctatcaaagcccaatcacccaagtttgtattctgaatttttttgtcctcctgtttctcagaaaccttcctcatccactatctcatctctgtcatgatcgtcaagcttttcttttctataggatcatgccctataacatacaaacatcactttcataaaattcctgtctttaccatcatcttcttaaagttacccatctaagtgtcaactcccagctccacccaagctttttaaagaggtatctacacatcctttctttgcttttttatcatacagtctttaatctaaattactcttgatcatggttatttcccaaagatggcccaaaacaattatgctggttcttgtataagcagactgctcctcaattcaaacagtaaagtttattacctctgcccttgactcgggtctgaacctgtgactattttggtcaataaaatacattggaagggctgctatataccttgacctggcagcttctgcttttcttggagtgctccaggaagcagcactctatctcagaaactagccaccatgctctgagaacccacgctacatggagtgaccatgcataggtgctcacccatctcagggcctatgtgtcatctatttactcttccaaagagactcgtctgttttcctgctctacatctcagtagttccactcatccttcaaatctgaaattaaatattattttgtaagagatggcttgatttgaaatactccaactcaaatcaagtaccagtattgtaatttgtcatcaaacattatatttctaatccatagtatttatcaaaatttgtaatggatattgtatttgtattttatatctgtctcccctaacaaacataatcttcatgtttatgttgttcaccatcatgataggcagcttttcacatggctcccagtgatccacaaatcctggtattcatactcttgtatcatactctccatttgagcatgggctggacctagtgactcacctgaaataaatatgtcaaaagtgatggaatatcatttccataattaggttgtaaaagactgtgagttgtgtcttgctagctgactctattagcttctcaagttgcatgctttgacaaagcaagctgccaagttgaaaggatgcaaatggcaaataattgagggcaatcactgcccaacagccatcaacaaagtaaatcctgccaacaattatgtatgtgagtttggaggcagatttttcctcagttaagcccagtggaccccttaattttaacctgtgaaatagtggtcccaagtaagccatgctcagatttatggcccatggatactatgagatagtaaagaagtgatgttttaagccactaagttttagggtaatttggtaggcagcaatataatcattgtgtctccaatacaaaaaaaaaataaattttattgtcatgtttagagctattctaagcacttcatatgtatttattcatttaatcatgacaacaacctcaggagataaacacaattattttcctatttacatatgaggaaagtgaagcagaaaggttaactgccaaagttcactcagctaagtaaggattagagtgagtgctcagattagatattttaatacataatcattaattcattcatttagcaaatgaacgaataaatgaataaccctattgctctgaaaagcaagagaataaatatttcagggactactaaaacacttttagcacttaaaaaaattcagtgaaattaatcaatgcccatgtaatggactctcagtgtgtgttagtactttgtggccctgttgttggcataaaatagctgctcccttaatccaatatgcactgtaaatattacgtgtactttatgctatctacaggtcggtttaggaaatcacgcagaagaatctggtcattagccaggatgtatggcacgagatttatggctgagacaggtgaatctgaccattttattcgacataaattaccagcttcagctgtaagcaaaccacttatctatgttgaatagctaatggacagtttataggatatcttcttgtttcccattctgtgctgtgctatgtaatgccagcaccttcacaccagcaagttggatcatgtggttcatatcggatgacttccttgctatgatttaggtgtggtttccaaataatatagttccagaatatggcttgactccaaagactgagaccagcctgatcacacatctttaccatatcccttattagaagcaaaaatgaaccctcaacagtgatcatttcaaaagtttgatttgaataaaagagaaatgggtgggactaaattcttcaacactaatcctattttacctcccgggattctgtgggtgtttgggcagtaatgtaataacaaatatgctgatatgtgtctgaaaagaatgttacatgaccatgagtcattatgcccattgcttcaaggctgtttaggtagctggcaggaagtagtatgtgtctccagagcataaaattggccgcaaagtaggtagggcctatgaaaatactgatgtaatgtaaacattgtatttctaaactatttacaaggtcatccctaccctacatgagaggtcagctctaccactaagaggtcccacatggacttctacaatattctttgggttttggcacttttgcagcacagctcacttctgaagtgtgtgggaaaggccgaataaagtcatcaaaagaacccttgatttagagttcatctgtgggattttcattcaagtcagttcacttggctatagtttactcaaaaatgaaaataatcttagaccacctttttttttaggattagcctcctttccacagcttgatagaattcccagtgatgataaactatctctttctgatatctctcaggggcaatttcactctgagagacaacattagcatatcaccccatggtcacctaaacttgcccagagatttttcaatatctacacctctcttctaatttacatcctagtaacttcaaactgtgtggaaaataaaaagtagcatctcctctccaaaagtttggggaccgctacccttaataagaaagcatatagggaaggaatggcaatcacttatgtataaatcagttaacctgattatccaccttctacaacactcctaagacaatgtgtttattcttacttatagtgagactgctttaaattaagaaaggggccctgcagtagcagttaatatttattaaacattaatttaatcctcacaataacctggaagtaacggattttacaaatgggggttctcaaatacaaagaagtaactttccgaagatcacgtggctcacattgatagagtgattgaaccaccttaaaccagagacttagccacacctgaatctaactcaaggaaacatctcattcttcagcatgacaggccaggtcaggattgagaggctaaagtttaaatcaggtcctcagcttcctttcttagcatgtttttcccacctcagccatccagtcctttcccacactccaataagtctgttttccagaaaacacaagttaccagtcaggatatgttaagataaatcattgctttgcctcccctgaggatatttgcatttaaaacaccttgctctatttttcaacctaaaagtttctcagcaagttgccattaaagaaattttagacatctatcagcaaatgtggaggaaagaatgggccagaaatgtgtaattaaggcagaattttccttcatgcttcagaaagcacaccacatggagctaccaatccgctcataatttcttgtccagagattcctaccttgctgctaaatgaggaatagaaattgcatccaagtctgttaaagtcagctttcgtcctttggggttttttccccaagttggtggatggggggcttttagcattcctcagccacttggaaatagaaagacagtgcacacatatcaactttgtgaactttaattcaggaaggaaaaaggaaatctaccagaaacatgaaggacactacctcctgaggaggagaatataggcaaatggcccctatataggtacagctgataaaattgactgaagccctagtatgtgagagaggcagagagcctccctctatgactcacctttcccctaaggatctgagcaacccaggccagggagagcattttgtttctcctaagctctggagctaaaatggggagaagcttggacatactgtgagagaaagacattgggaaaagctgtagacattttcccaggccagaaccaagaggagaatgtcatttttattctgagtgcatacaaaatcagccattcttcggtaacacagcatcatggctgcacaggcattttactcttgggccagagattgcagcacctgctctgaagcagggtaggggcctccacagctaggactgtggaaagtacctcaggagtagatcctggaattgtgctctcccccatcacaggtgtggagtgggaggagagctgctaccactgcagttttttggggtgatgagatttgcagccagggccaccttggtaacctgaaactggtctgagtgtgccattgctgtgtgcaccagcctgctccactgagatcatggtgaagcagggccctctccactctactcccaggcagatctccaggcatttagaccatttcctcacctggatcagcagcctgagatggcctaacattggggccctctccactccacgcgcaggcacaactccaggcattcagagcacttcctcacctgggccagcagcctaagttgcccaacctttcctgcacagagatcctggtccaggagggccgtctccactccatgaccaggcagatatctaggcatttggagtgcctattcacctggagcagtggcctgacccaccccacccttcctgtgtagaaattctgttatagggagaccttctgtgcttcaaacccaggcagatctgaaggcattcagagcacctgcttgcctggttcagaagcctgagctgccccacctgcctgcacaaagatcttggtgtaggtggtggtggagggctttcttctctatgcccaggcagatcttgaggcatctggagcactcactctcctggattagttgaggctgcctgcttctctatgcagagaacttgggaatgaggagatttcccaacgctacacctacacacacctctgggcacttagtcaccacccactggattcttcctcagagctggtgcttgtgcctgccattgggggacccatagatggatacgcctggtctggctctgaccatcttggccccctttctcctgcagctgagcagagagctcaaaccactgtgtactccatgaatcaacccatttcctgaggcaacagagagtttcttccagtaaacaaggatcaagtatatacccagcatgttggccacaatctggctgttagaagcatgatatcctggcttataggttgaactgcacagcccaacataaatcctgctaacaaaagtacataggatatagaaacaaagccaaaagactctacacagcattttctacagttacaccctctatggaggaggagaaagggaaagggaaataaaaaaaaattacagggaaggaaaaagagaagaatcctacctgcatgaaataattataaaaattagaagttccagtatctccagataagaaggaactagtgcaagaattctgataccatgagaaatctgaatatacttatgccaccaaagaatcacactagctctccagaaatggtcactaaccaaaatgaaaactcagaaatgacagataaagaattcaaagcatggattacaaggaagagtaatgagatccaagacaaggttgaaaatcaacacaaagaaacttctaaagcaatccaggaaatgaatgaagagataaacatttttaaaagaatcaatctgagctctgggattgaaaaactcactttcaaccaggtattgcgatacacacgtatagtcccagttattttggaggctgaggcaggaggatcacttgagtccaggagttcaaggctgcattgagctatgattgtgccactgaactccagcctgggaggcagagtgagaccccatctctaaaacaaaaagaagagaaaagaagggaaaagaaaagaaaatcttacttaaggaattttaaaatacaattgaaagctttatcaataaactggacaaagcagaagaaagaatttcagagcatgaagatcagtctttcaagctgacagataaaaataaagaaaaaagaattttaagaaaagaactgttagagaaatacaggattatgtaaaccaaccaaacctatgacttattgacattcctgagagggaaagagaaaaagtaaacaacttcaaaaacatagtttagggaataattcaagaaagtttccttcatcttagtagagaggtagacattcagatacaagaaatgcaaagaaaaccttctagatattatacaaaataaacagcaccaaggcatatagtcatcagactgtccaagatcaatgttaaagaaaaaaatcctaaaggcaactaggaaaaaaaaggtcagatcatgtacaggggaaccccattaggctaacagcagacttctcagcagaaacctcactatccagaggagatttgggggcctattttcagcattcgtaatgactagaaattccaaccaagaatttcatatcctaccaaactaaactttataagtgaaggagaaataaaatcatttccagacaactatgcactaagagaatgtattaccactagactggccttacaagagatccttaagggagttctaaacatggaaatgaaagaacaatacctgtgaccacaaaacacacttaagtacatagaccacataccctattaggcaactacacaatagaaactacaaagcaaccagctaacaacttcacagtaagatcaaaacctaacaaatcaatattaaacttgaatgtaggtggtttaagtacaccacttaaaaggcacagagtggcaagttgggctaaaagaaataagacccatccatctgctgtcttcaagaaaccaatctcacgcataatggcacccataggatcaaagtaaagggttggagaaagatctaccacacaaatggaaaacaaaaaagagcaggggtgaccattcatatattaaataaaatagactttaaatcaacatcagtaaaaaaaaggatggggggagaaaaagaaaggcattacataatgataaaaggttttaatcaacaggaagacctaactatcctaaatatacctgcacccaacattggagcatacagattcataaaataagtacttctggacccatgaaaagactgagacggccacaaaataataattaaggacttcaacatttcactgacagcattggacagatcattgaggcagaaaactaccaaaaaattctaaatttaaattgaacacttgacgaattgacactaatatatatctacagaatactttgttcaaccacagactatacaatctcctcatctccacatagaacatactccaagattgaccacatgcttgcccgtaaagccagtctcaatgaatttgagagaaaggaaattataccagcaatctctcagacaacagtggaataaagatagaagtcaatatctttattgatccctaaaaaaccataaaatccctaaatcccataaaatccataaaatcctaaaaaacataaaaccctaaaagggatttaaagatccctaaaaaaccatacaatttcatggaaattaaacaacctgttcctgaatgacttctgagtaaacaacaaaattaaggcagaaataaaaaaattatttgaaataagtgaaaatagagatacaacataccaaagtctctatgatgcagcaaaagcagtgttatgagaaaattttatagtgctaaatgcttacctcgaaagctaaatctcaaattaacaatctaacatcacacctagaggaactagaaaaacaaaaacatactaaccccaaactggcagaagaaaaaaaaataactaaaatcagagcagaactgtacagaattgagacccaaaaaaatcatacaaaaattcaacaaaaccaaaaggtggttcttccaaaggataaacaagattgatagaccacaggctaaattaacaaagaaaagagaaaagatccaaacaagcacaatcagaaacaacaaaagtgaaattaccatcaatcccacaaaaatacaaaaaatcctcaaaaactattatgaaaacccctatgcacacaaactagaaaatctagaggaaatggataaataactggaaacacacaagctctcaagactgaatcaggaagaaagcgaaactcacaacagaccaatatcaagttctgaaatgtaatcagtaagaaaaaaatctaccagccaaaaaaatttccagaccagatggattcacatcaaaattctatcagatgtacaatgaagaaatggtatcaattgtactgaaagtattaaaaaaaatgggatgaaggacttctccctaattcattctacaaagtcagtatcagcctgataccaaaacctggcaaagacacagtgaaaaaagaaaattacagggccatatccctgatgaacatagatgcaaaaattctcaacaaaatactagcaaactgaatccaacagtatatcaaaaagttaattcaccatgatcaaataggcttcattcccagaatgcaaaggtagttcgacatatgcaaatcaataaaggtgattcaccacataaacagaattacaaacaaaaaccatatgatcatctcaacagatatggaaaaagctttcaataaaattcaacatcccttcatgataaaaaccctcaacaaactaggcattgaaggaacatacctcaaaataataagagcatctatgacaaaccaacatcagactgaacaggcaaaatttggaagcatttgtcttgagaactggaacaagacaaagaagcccactcccactattcctattcaacatagtacttggagtgctagccagagcaatcggggaaaaggaaagaaataagaggcatccaaataggaaaagaagaaatcaaacgctctctcttctggaaaatatgagtctatatttagaaaaccttaaagactctgtcaaaaggcttctggaactgataaactacttcagtaaagtttcaggatacaaaatcaatgtacactgtacgtcagtagcatttctatgcaccaataatgtgcaagctgagagccaaatcaagaattcaatcccatttataatactcgcaaaaaattaaaatacctaggaatacacctaaccaaggaagtgaaagagctccatgaggagaactacaaaacactgctgaaaggaatcatagattacacaaacaaatggaaaaacattccatgcttctggattggaagaatcaatattaaaatggacatactacctaaagagatctacagattcaatactattccattaaactaccaatgtcactttgcacagaactattaaaaactatttgaaaattcatatagagggccgggcgtggtgactcacgcctgtaatcccagcactttgggaggccgaggcgggcggatcatgaggtcaggagatcgagaccatcctggctaacacggtgaaaccccatctctactaaaaaaaatacaaaaaattagccaggcatggtggcaggtgcctgtagtcccagctactcagggggctgaggcaggaggatggcgtgaacccaggaggtggagcttgcagtgagccgagatcgcgccactgcactccagcctgggtgacggagcaagactacatctcaaaaaaaaaaaagaaaagaaaaaaaaattcatgtagaaccaaaaaagagcttgagtaaccaaaacaatcctaagcaaaacaatcctaagcaaaaagaacaaagtcaaaggcttcacaacttcaaactatactataaggctatagtaacatggtactggtgcaaaagcagactctcagagcaatggaatagaatagagaacccagaaagaaagctgcaaacctacagtcatctgatcttttacaaagttgacaaaaataagcaatgaggaaaggatgccctattcaataaatgatgttgggatagttggctatccatatacaaaagaatgaaactggatttctgtttttcaccatattcaaaaattacctcgttagattaaagactttttaatgtaagacctcaaattataagaatcctagcagaaaacctaagaaacatcattctggacattggccttgggaaagaatttatgactaagccctcaaaagcaattgcaacaccaacaaaaaatgacaagtgggaagtaattaaactaaagagcttctgcacagcaaaagaaactatcaacagagtaaacagacaacctacagaatgagagataatattcagaaactatgcattcaacaaaggtctaatatccagaatctataaggaacttaaacaattttacaagcaaaaaaacagataactccatttaaaaatgggcaaaaaaacataaacagacacttcacaaaagaagacatccaagcagccagcaaacatgaaaaaatgctcaatgtcaccagtcctcagagaattgcaaatcaaaaccacaatgagataccatctcataccagtcagaatagctattattaaaaagttaaaaaaaaatcacagatgttggtgaggctgtggagaaaagagaatgcttatgcactattggtggaaatgtaaagtagttcagctactgtggaaagcagtttgtaggtttcttaaagaacttaaaacagaactaccattcaacccagcaatctcattactgggtatttatccaaaaggaaataaatcattctactgcaaagacacatgcactcatatgttcaccacagcactagtcacaatatcaaagacatggaatcaacctaggtgcccatcaatggtggattggattttaaaaatgtggtatggggccaggcatggtggctcacgcctgtaatcccagcactttgagaggccaaggcgggtggatcacgaggtcaggaaatcgagaccaacccagataacatggtgaaaccccatctctattaaaaatacaaaaaattagttggacttggtggcacacatctgtaatcccagctagtggggaggctgaggcaaaagaatcacttgaactcaggaagtggaggttgcagtgagccgagattgcaccactgcactccagcactctagcctgggtgacagagtgagactccgtctcaaaaaaaaaaaaaaaaaaaaaaaaaaaaaaaaatgtagtagatatacaccatggaatactacatagccataaaaaggaacaaaatcatttcctttgtagcaatatttatgtatttggaggccattctcctaagtgaactaatacaggaacagaaaattaaatactacatgttctcacttataagtgggagataaacactggggactcatggacaaaaaggtggcaaaaatatacactgggactaccagagggaagaaggagcagagaaagggttgaaaaactattgggtattatgctcagtacctaggtgatgggctcaatcataccccaaacctcagcatcatgccatgtactcagataacaaacctacacatgtaccacctaactctaaaatagaagtcgaaattatttttaaaaaagaaaaaaagaaagctttagcatttttttctcttttttctgggtgaaaaaaacaaaattcagctttattataacataaagctctacggcatacccagaatcaaaatatataaatgatggttgatacccttggggacatcaaatctcactagaaagacagagcacgcatatgaagacattaggcaattcaagaacaacagaaaggaatattcaatgatgtgttatataatttggatgtttgtcccctccaaatctcatattaaaatatgatctccaatgctggaagtggggctttgggggaagtatgtggaccaagggggtgtatccttcttgagtggcttggtagactccctgcagtaatgagttcacacaagagctgattggttaaaagagcttgatatccctcttgctccctctcttgccatatgaaacgtcagctcccctttgccttcctccatgattgaaagcttcctgaggtgtcaccagaagcagatgctggtgccatgcttcttgtacagcctgcagaaccatgaaccaaataaacctcttttgtttataaatcacctagcctcatatattcttttatcgcaatgcagaatggactaacacgcaaggactctccattcttagaacgtatagtctagtgaaggagagaggtgcgttaaaaaatagagaaataattcaaattctaagagtgacaaatactgggaaaaatagcacaataggaaagctgttatgagcagaactgtgtctccctaatattcatatattgaaatcctaacccctagtacctcataatgtaactattttggagacaggatatttaaagagataattaagttaaaatgatttcattaggatgggctattccagtctattccagtatgactgatgtacttaaaagaagagggaatttggacacagacacagagggaagaccatgtgaagacacagtgagaagatgaccatctacaagccaaagagagaggccttagaaaaaactaaatctgacaacactttgatttcaaacttctagcctccagaactgtgagaacataaatttctgtggttcacctaccgagtctgtggtactttgttatggcaaccctagaaaattaatacagaagcctaccttagctaatattgtcaaggaaggtttctgtgaggtgatgacaagtaatatcgggtctgaaacttaaaggagcattgtctgttccaagcagagaaaatgtcaagtgcaagagaccagagatagaaatttcaaaaaacagaaagaagtcaatatatctgtggcacaaggaacgggggtgtgtgataaattgtgttctggagagcatagaaatgctctctcccatttcacagggatgatcttcaagtataaataatgggatgggggtgagaagggtagtccttggatatgaactgaggacaattctcccatcataaaaggagggaaggtaaaaaatgagtgagtagatacatgtcagtttttatctattctttcaaaaataaattatgaggcaatgttatcagctgaggaagttagaagacaaaaaaagtcacctcagtaagtgggagagtgaatgtaggaaagacgttagtaggattgacagcctatgttgagtgcccattttagatctgtagttacaattttaaaggaagaaagcacagttgctcaattttctccaatgatgctcagctgttagataaagattcaaagtaggtagagttaattttaatcagggttctggtgttacagatgattacaactggggacaaaagaataaagggtgtttttttttaaagactagctatagtatctgattaagaaagctacactcctccctcttttcctcctttgtgaactcagtagtctacagggctttgtatcaactgtcaagaataccagtggtagggtagaataaagccaaattatgaagtcttaaaagcccagattggaaattagactcgatcatggagaaaataggcagtcattcatgatattttaaacaagtaagtgataagattttaaaaacataacatggtttagataagagggaaattggcaaaggagcaggaggtttcctctcctctcttgagtaatcgggacttgtgagcatttatatgttcctaagtttacacagtagaaaagctatgccatagttaaaaagcatcctagcaaatcaattttatcgactgtgcaaagtccagtaaagaaaaattagtgaaacgtgattcccatattccagggacttttgttataagcatgatgaccaaaagcaatgaatttttccagaaaatttaaaattccagtattattccattgtcccaaatgatacccttatactcgttgaaccacaagcctcattgctgtctctgaaaaatattactaccataacaactaaaccaaacatactgacgttaagagaacaaaaacagaatgcagattaaaaccttctgtaacaaattccaaaatacgggtataagccatttacttgttaaaaattccacactttcagaatcttgaggtccttcatgggaaggataatcgacttgacatgttcatactaatggctgtaccatactgattttgctaaaaagttaaaggaaaaaagccattgctcaatcattcaggctatatctgggagagtcaagatatgcaagtttgatttggagatactggttgggggttgaggggaggaacaattctaattgtgtccattgatcactttctagaccaatatattacttagggtatgggtcaagatgctgtaccaaagggtccccaatacacaagtggctcaaacaaaacacagatgcatttctcttccacataccagtctgaaagaagcttgctgtattctaagagctcactcaatggtccaggtggatttcattgtgtagctctgtcataactgaaggcaaaggttcttaaatgttttgttctcaggatccttttatactcttaaaaagtattgaggactctaggctgggcacggtggctcacacctgtaatcccagcattttgggaggccgaggtgggcgggtcacaaggtcaggagatcgagaccatcctggctaacatggtgaaaccccgtctctactaaaaatacataaaaattaggtggtgggcgcctgtagtcccagctactcgggaggctgaagcaggagaatggcatgaacccaggaggcagagcttgcagtgagccgagattgtgccactgcactccagcctgggtgacaaagtgtgactccatctcaaaaaaaaaaagtattgaggactgtgaatagattttgtttatgcaggaaatatctgttgataattaatatattagaaattagaaggaaaaagaaatttgaacttaaaaaatatttaagtattaacttattttataaaactataatcaacccattgtttgttaacaaaagtaacttcttttatgaattctttgtcatgcagttcaaaagtctctattcctttagagtcagtaactagtgctttattttgaccctttggagatgtcatgtttccctgattgtttgtgatcctgtggccatgcactgatgcctgcacatttgaagaagcaggcacatattccagtctttacagaatggcgtttgcaaggaaagccctacagtaatcagcccacacagagattctgggcaggccatctggcatggtatgtggccaggcctgggcaagttgggtgtctgggtcagcaggtaggcgggcttggcacttgggtttgcagggtaggacccagagccttggttcacttggacaggcctgcagcttgggtctgctggagtgggtggaccctgggtccatgagaccaacctggcactggggtccacttgcatgggcctgctcattgggtctacagggacaggcctggagcctgtatccacaggggccagcctaaagcctggacccatggaggctaacctggtactggggaaggccttcttcagcctgcatattcaggggctggcctggcactgaaatgggcctagcacctggatccatggggacaagcctagagcctgaatccacaagagctggcctagcactggagtgggcctgaagcctggggccattgggactggcctgtaactgagtttactggcatggtcctaggctggagtctgaggcagagcatggtgctcacttgctcactccactctccttctgccatagaaagggtgtatttctccccactctgctgtctagggttggggctggggtgatgtaagtaatgtgaaattgtcgttcataccctcttcaatgtattttcttatttgtgtgctacacccaggtggtataatctctcatctggtttctttagttcctgtgaaggcatttccatgcatggacagttgttcaaattgatgtttctgtgaaaggatggatgagcgttggaaaattctattccaccatcttattgatattagtcataatatatttcattttttaaatcttcttaaaaagataataaaaagagtagcattgtttgacatgaaactagaaatcaataataggaggaaaattggaaatttcacaaatacgtggaaattaaacactcctaaacaatcaattggtcaaagaaatcaaaaggtaaattttaaaaactctgatacaaccaaaaatggagaaacgtaacatatcaaaacttatgagaggcaatgaaggcagttctaagagggagctgctatttaaatactatatgtaagcatataatataaatgcttatattaagaaaaaagaataatcacaaataaacaacctaactttaaactttaaggaactagaaaaagaaggacaaacttaacccaaagttagcagaaggaaggaaataatgaagaccatagcataagtaagtaaaatagagatgagaaaggcaatagaaaatatcaacaaaaccaagacctgggtttttaaaaagataaatgaaatttacaaagctttaattagactaactatgaaaaaggaagaatcaaatagataaaattataaatgaaagagaaaacattacaactgatagcacagcaacacaaagaatcataagagaatacaataaacagttatatgccaacaaattagataacctagaagaaatgaataaattcttaaacacatgcaacctaccaggacttaatcaagaagaaatagaaaatctgtacagaacaataatgagtaaagaagtagaaacaataatcaaaaatctcccagaaaagacaagacaagctcaggaccagatggctctactggtgaattttaccaaacatttaaagaattaatgtcaattcttctcaaactcttccaaaaaattgaagagaacatttccaaattcatttttcaaggccaacattatcctcataccaaagccagataaaaacattatgagaaaagaaaatcatactccattggccctgatgaacatagatgtaaaaaattctcaatgaaatactcaaaaactgaatccaacagcacattaaaaggttcaagtggaacctatccctgggatgcaagggtgattcaacatgcaaaaatcaataaatgtgatataccacattaacagaatgaagaatcaaaacatatgattatctcaaacgatgcagaagaaaagcatttgacaaaattcaacatcctgttatgataaacactttattaattcatttcttaaaagcatgataaactcaatgtttgttaacatgttacttattttataaaaaataaatatatcttggcctggcgcactggctcacacctgtaatcccagcactttgggaggccgaggcggacagatcacgaggtcaggagattgagaccatcctggctaacacggtgaaaccccgtctctactaaaaatacaaaaaattagctgggcgtggtggcgggcgcctgtagtcccagctactcaggaggctgaggcaggagaacggtgtgaacccaggaggcggagcttgcagtgagccgagatcgcgccactgcactccaccctgggagacagagtgagactctgtctcaaaataaataaataaataaataaatcttctaaaaagatggtgaaaatgagtggcattatttgatatttttgtaaatcttttaaatatctgacttactagaagacagattatcattattattactatgaaatatttctgcattcaatctggtacagttaagttgttttagttaaagtatgtaaagagtggcctggtgcggtggctcatgcctgtaatcccagcattttgggaggccgaggcagggggaatcacgaggtcaggagatggagatcatcctggccaacatgctgaaaccccatctctactaaaaatacaaaaaatcagccaggtgtagtggcgcgtgcctgtagtcccagctactcgggaggctgaggcacgggaatcacttgaactcgggaggcagaggctgcagtgagcccagactgcaccactacactccagcctggtgacagagcaagacaccatctcaaaaaaaaaaaaaaaaaaaaaaagagcatgtaaagagcaaccagcctcacacaaatatagctgggaaagggatgaatactccttttcagacaattatgaatactgttctttgatactacaccaaaactcaaatggtagtttcttaaaagttaactgctgtgtggaatctgaaaccatatcaataaacttttaatactctattacattaaaatccattagaatggtggtaattatacaactgattacatttgtcaaaacggatcaaacaaaaaacaagcaaaatttattattttatagttccaatggctcttttacccatgcacagattcctaatattttgcattggtttttagaaattactggttcactgaattatgcagaacttccaaattttgacacgttttattacacaatatcagaaaatcacatttaatattattgctagtctcatcagaagcattttaaaatattgggatgttgccaagtttatagtaacagatagatattttccaaaattaaaatttcctcttgaaaactcaaattttatcactggtaacaaatattgtcagtttttttcccttgaagtaacaggcccatttttaaagaaatgtctaaataaacataacttgacaatcattctttttttgtttgttttttttgttttcttgttttgagatggagtttcgctcttgttacccaggctggagtgcaatggtgtgatctcggctcaccacaacctctgcctcctgggttcaagcgattcccctgtctcagcctccctagtagctgggattacaggcatgcaccaccatgactggctaattttttttatttagtagagatggcgtttcaccatgttggtcaggctggtctcaaactcctaatctcaggcgatccacccacctcagcctcccaaagtgctgggattacaggtgtgagccactgcggctggccgacaatcattctttcaagtaaaaatggtgttatatgtgaaaagtgagtagttcgactcacaactctctaacaatcacccgagtctttttcctggagacaacatgtattcatatgcatcagaagtacttatgcatattccctattgtattacacagaatcttttttaaaagtgtgctcaatgacagtgattgaattaaatcgatcatttgtaagtgcttcctcaaggacattctttactgaaactggcattttgttttgctttgttttattgcaagcacaaagctgtgaagaatgttatgaatcttggctctacctcatgtcactgtcttgattcatgctaagaaaccagcagttctacccaccattgcttttgtaccatccgtgcaaatgcaaaacagtgaaaaggcaaatagcattttagtgttattatgaaaacagctttggtttcctagactccctgagagggcctcaggaatcttcaggtgtctgcagaacacacttaaagaactgctgcactagggtaaataggggaaaggataaggtacagggcaaatctttcttttttaagaaagtgaccacaaatgtaaactctcacattcctttagcgagagcctagtaaaatggcctcaattggcttcaggacaaactgggaaaggtactctgaagaggcagccatattacatggatgagagaaagaacagatttggggatataatcagcagtctgccatgcccacccagttaaacaacgagcaggtcaagtgtcaggatagtcaaggacctctagacaatggaggacataggaagctgcgctttgtgcctggtaccagggtgtaatgctggtcagggagagctaagacatcatgaaacaggatcagaggagtagctatatccattcctatgggagccagcagagtggagtaccaggaagagtgtcctcaaaatgagtctcaagcactgcagccaggagacgatcactggaaaaatgtagaacgggggccacagagagaacagtgggaccctcgaggcagaaaaaaaaggacaggtcatttgtgggcttcagtgagcatgttatagggcacccagtgaccccttcaactagaaagaattttggattgcagcaatatcactaattgggctgagctagaaatcagctgctctgtgactattaccgtgatcttactgtgtcctaggcagaagagctggagtaaatctgggtttattgtgtttttctagctctacttcttcgaaacatattactattgaagagttgagttcccatactttatttgtattcccttttcgattagcaacaagaacagaagaaccaattttgcagaaagttgccattctgcagaaaattgatgtgaacttagcagacaaaggtaaagaaaatagaagtaaaggtaactctggtcacggagaacaaattcccgatcacagcaagcatactgaaagccgaggctaaaccaaccttgcaaatctagataaacagtaaatctgggaccaaagggcttttaactgctgaactttatctgatatgccagcaaatgtacacagaaactgaaagaaaaggctggaaggcattcattttgagatcagacctagatcaactgagcggtcataggtcctcaggcttcattctatcagcagcaaacagaaagcctatagttacctgggaaaaggagcttgtgacaaaataattgtccagaggtcatgctcattcacagtttttcctgtttttcctggaggagctagcactctcttgccctccaagggaaagcagcttatgacatattattttggtatattagcttagataaaagaacatacagacaataaaataatagaaatgaatgacatatcagaaccaaggaaatgagaaggaaacttatatgccagcttccagggttaatgcattccctgtaaatgggcacaattttgagtccaagtcttttggcagttggggcaaaaaggtaaacataattatttacataactcccattataagaaaggagggagcaaatttttgttgccactacactctcaaataatttttcaaataaaatcctttaatgggaatcattgagctacatattgaggagaatgttcattctcctaataccagtgctgcggtcagtgcaaatcaatgctcatttaaccctaagcctatggcttatgttactgacctttgtgcagatttttcaagaacccacaagagcgtaacaaattccatatagaatgaactaattgtggctttggaattattccaattgacctgatataaatctgacctggcaatacttgacaatggtgtagggaaacccatgctaccttggcgtctggttggaaaatactgtccccaagtaaattaaaaggtctagtcttgtcaccaaagttctgggccaacaccaccagcttctacgacaactattgattttaaattctgtagccttgtcataaagtcctgactctgccagcattcactgtgaaatctggagcgtgtcacttaaactcttggcatggcaatgccctcatttcaaaaacaaataatgagatagctaccatcttttgagaccctactctgtactagtcactagttaatatctgctttcccagctggattataaattcagtgagggcaaggagagtatttcttttgcccaccattgaattcccaacaactaacatgggttcagcatagaagaaggttcatatttcttcctttctgttttaactaaccaaaggtccactgtcttaacaaccctgaaagtaaccattatttctatttttcagctgaagaaattgaggttcagaaagtttaagtgactttcaaggggtcacacaactggtaaatagagtggcctggatttaggcctaatctgtatagccccagagcctagactagttccacaagggtgcagaaatggaaacagactggagcatgtcccaagactcctcctggttctgaaatgcaatgatccccacgattgatgggaagccaatctccctgttttgtgaggctcctcaacaaattttcatcactttatgacccagagacatggccacagcaaattttggcctctgccagagtggcagggctccactgaggcaggtgaaaaccaaaacatgtcactctgggagggtctccacttatttaggaggcctctgtttattcaggtggacattgcccacttcctattgctaccttaggggacctaagtaccacatcccaagttcaaagacctagcaaggatgagcatcactctgaagctaattgctcgagttttagagagctgtatagttaacatctgttgacaaagcagtcgctagatgtgtggggcatggcactgtgtgctagctcatggtcatttcattttgaaattcaaagtagaaggaaatattcagcttagctttaacacctagttttgagtgtattcttaaacaactccttcagtccacatgttatttatgacagataaaatccttcagtggcttcttaaaaatatttttgctatttgctgaggactagcataaaggtataaaacctcttacaaagtgctaataggaacaagacacatgttttactttattcttagcaagcaaaagtcaacaactgtctactcatcaaacgcagctgattcatcatttcaccctctaccgtctacactacatactcttttttgttcttgcaaccagcatattgtgcttgtaatgaaacaaaatagacaaggaaataagcagatttttaaaataagttgcatgacagacagtaaagggaggtatcatttgttaaagcttttgtttcaccatatgaacatgaatatagcgtttcttatatttttatgtatttgtttttacttttattttaggtttgggggtacatgtccaggtttgttattagataaattcatgtcatgggaatttgttgtacagattattttgtcacccaggtactgagcctggtacccgatacttattttttctgctcctctccctcctcccacccttcaatctcaaagaggccccagtatctgttgttcccttctttgtgttcatgagttctcattatttagctccctcagtgagaacatgtggtatttggttttctattcctgcgttattttgctaaggataatggcctccagctccatccatgttcctacaaaagacattatcttgttcttttttatggctacatagtattccacgtacactgcttactctctacctgtagactggaatctaggaaattaggagacgttcaggacctcagagactaaagccaatatcagggttccttatttctcttgagactctctttctggcgggagattctttattgtcctcattacatttctggactatgaaaaatagtttcagcacctaaattcaaatccctccccatgttctgagcccctcctattatggctttgttgtaggttatatctcacctcttcatcctacaaatttctatttatttcacctcaaaacccaggtttcattctacagacagaagtaacgtatccttccaaaggcatggtatggtgactgtagttaacaacaatgtgttatataccaggaatttgctaaaagagaagatttcaaatactcttgccacacacgcaaaaaggaaaagtaactatttgaggagatgcatacatcactgagcttcattgtagcagtgatttttatatacatgtatgtcacaaacatcaggtcatataccttgaatatatataatatttatttgtcacttatacctcaataaagttaaaagaacaaaagtaatgtatccttaaaattcaaaaccaaggtgattgtgttttatctgtgtagttgatataggtcaaaagaacatgggctccgctctcacccaaattaagtagccctgagccatggcagtgaagttaagaatggggagggactagaaagggtcttacccttgccatgagcctctgccttctcctaccacccactcttctcttggccaccagatacccacatggagctggaactgagagactggggcagggggaacccgaagtggcctctattgctctgcacggacacacggcattgatccaacattggacagaaaggaaatgggaaagaaagaatagtggagaaaagtagaaaagagagcaatacattgaaaggcaaaggcaacaagggagtggaagagagagatagacacagagtgaggtaggaaacctcagaccaaccagcaccaacctgtcaatactaacagtaacatttactaaacatttactacatgctagtactttgccgaatgtgttacatgcattaacattcctttattcattcacaaatatttaactgacaaaatccctgccctcctgaagctaacacccaatcaggcagtcagataaattggtaaaatatataatatttagaagataagtgctaacaataaaaatgaaacagggaagagggatagtgcgtgtcagagtgggagaaaagggaagtggccactttagctagggtgtccaaagaaggccttattgaggaggtgacatttgagaaagacagcagcatcagctttgttcactcttgggcatttttgccacactttgagaccctcaaaatgtttgctttgtgtttgagctacttgtgcttgtttgggtttttttctcttattatattttatctatcatttccatgtgttgaaagcagaagggattatcaaggtgtaaaatctctacatcaacttggctagtgtggtcatttctttgtatcaacggtgaaaggactaaagtcttactcaagaagagcaaatcttttttaagtttggacatcttgtcttaagaaagaagaaccagtgtgtctatagtattagtctatattagtattagtattacagtattagtctatatttcatcctgctgatgttatacaattcaatatagacagcttcaaagcatgattggaaaagcagaagacacatcatgagacagttaacctcatttcattatattattaaaaatcatttgaatcatcttacttgcacttggaattctagtcccatattaggacgaccttgcataaaattgagggctgctatctatttgtatagtttgtgccgttttgcaaaactcagagacattgtagtaaagtacttgccaatgtcacatcagtgggttgtacctgggaaatctgtgagtatagactgggaaaaagagttaaagctgatgagctgatgtgtggattgatttcattacagcctcaggaggctaaagagagcaaattgaagagagaaggcttgagacccttgagaacactggaaaaaacatggtatgccaacaccaagactgagggcctgaaacagaacaaatatcaattcatgtgtgtgggggtgtaggagtgtgcatcttgacaaaataatccctaaaatgaaattttacagttaaaagtacacttgaagtggtaagtaaaagagctgatagagcaataacttgacactcagcaaggaactgctgctggaggaaactctaagttgcctgccttcccattggtcaaaagcatcagaagtgagctgagcccacatgagctatttgatgaaaagacagaaggggcaaagcaggactcttcaggagccagctcctgagatctcattatgcacattttcaaaccagcatccagtggtgtcaggttggtagcttgaaataggtgatggaggagtatttacactatggaaatcagcaaatgctaccaatcaggccaaggcattgggtttgtttttgtttgtttttccatgattgttaagtatttcccagcacaccatgaggtaagggaggggctgttctggataaatcaaatgttctttgtcatgactcagaagcaagaatgagagaaataattccagaatgcatgaaaatatacaaaagatatgagataaatatcctgatgataaggttactctagggaattgagtgccacattcatttaaggcaagagcattccatttcaggacaggagattctaaaaatctattaaacccaggattatcttaacttcattaaagaaaacaaggagccataaagcctgtgatccacataggataaggattctaggtagctattttaagagctcttggaaagccaaaacaaatgattggcttcctccaaaacttatttcataaagtcaaggccaattttctattttaaatttattttgttaatgccctttaatccctaaaggtaggagaagaggaaaaatgtacatatgaactcaggttcattccatagctttagccatatagctatcactgtctagattgccaataaaacccacaaacatttcctaattatcctaattattctctctaatcaaagatcaaagctgtcatcaagactgaaggacttaaactgagtggggtggagcaacagtacaaagaaccacaagcaaacaaatgtctgtcataaaatctccatgttccttgcttaaaaatctgcaagctgattgaactcatgtcaagtcctgaggatatattatatttgacatcactcactacagaaattgtaaactttctaataaataacatagagcaggatgggacatttagtttatttaccttcatttatgcagaacccaaaagtattgcctgtgtttttccaggctccttcagcaaaacttttcttgtgaattcttgtaacaggaaagcaacaaacaaataccaagtagggaataattatagttatttcttaaaatggagatttcatttgtgatatctgcattctttctatagatgcagatttctttgagttttagatggtcaaaccccttgttatgatatagcatgatggttaaaaataaagtctttggagacagccaaatctgttttttttttctcttaatctgctacttgctagctagcattgtggctttggacaagctacttagcagagatttttttttcatttgtataaatgaggttaataatgcctaaccctcatagttacagtaaagattagataggagactgtatgttaagtgcctcacatggggcctgactcagaatgaaccccccaaaaatgttagttattacagctctcttagtcagtctcctcataactgagtcactagattaactgatgcgtgctgatgtctgtggaatactgagcacttacagctactacattcatctccagtacgcttgcacacttctgctcctaactggtgtttattctcaaaactgcaaattccaatcagacttattgttttaattatgtacaatcgattaaattttatgtaaacccataaaatatgagtagaaaaagaccatttctataaaaactaaaatgcgtgaatgtaagtgaatccttggaaagattcgtaaacacggacgactagaaaaacaatactgctaatatataaagtatggatgagttgactaaaaataactgaggaatttcttaaccctttaaggatatatctagaagactacttcagaagcatcattaaattatccctccacttaaaaatggatgactggaaataggagaggatgcagtgtgtgtgtgtgtgtgtgtgtgtgtgtgtgtgtgtgtgtgtgtgtgtgtatgtgtatgttttgaatcaatgaataaggtaaaggattggattaatgctttgggggcaggggagagcaatgaacaaagtgaaaggatttggtgtgactctcttccatgtcctagttctatgtcattaggcaaattatatagcctcagccctaaaatgtgggtatagaaaaagccctaaaggcatggatttgaatcagaatcttttaaggtgctttctaactcaaggattcttatttatcacagttttcataggaagtaatgatccatgacaaagccacagcattgacctaaaccaacaaatgcaccacaggaaaaacctggcttccttgtctcgctagtttcatattatgatggcaaattcacagagtttatagagatttagaattttcattctggtcgaatttacttaaatgtatgtagatgtagctggtgttcagcaatggcatttataatcccaatgtaagccaacaagtcccagattctgtagcaatgcttggcagatttcatcttttttgtgttatcaatacattcaaatcttttgaaaatcactctaaggattatctgcaagggcctacctctttctgtctttgcctcactatataagcaacagaaagaagagatgttttttaaaatgttagattattgccatttggtggagattatcatctgagcccattaaccagagccttaaggcactgggcaacctgccaacaaaatgagatgagctgcattaagatcaatttgttaatttttaatgaggcttcaaaatgccctagtaaattacttaatcattttaagaatgcattgctgcttcttcactattcctcctttctgtacacaaaaaactaatttatttttaatcatttccattcctcctttcatccccctaaaggctacaataattttctattactacaactaactaaagcagcccataaaactgaagaccaaatataatgaaagtggattaaatagcatgacaagattttcaaagcaatccgattctttgactccataaaaaacatttcacagttttaacataaggagttaacatattatgggtctttctttttggaagcaatggtttaagttgtgcaggatgttgcacaccaccatgcttccaatgagttagattatatataagacttcatttcaattgatcatttttaaaattaactaaaatttgtgtggaacataacaaaaaaaagagggaaagggtttaaaagtgaaccattaacaaagtaatctaaatccatcaggacacaggtcttaggatattttgttcactgggtatccccatgactgcgtagtgctaggcacatatgaggtgctcagtaaatacatatttttaaataacgctttaaaggagattctttttttcccctgtgcttgagaaacagttcagaaagtataatggatatgctttcaatggataggttgaagacactatcaaacctgtaactactggaaatgaaaccatgacttttgtggaatacaaggcaagggtaggttgcatagccaattagagtagacataacccacagacaagagtaagtcctgttccagttcacagaaacacctctctctctccaaccagagcaacatgcattcctgctagcgaggtctgcaaattaaaagtgagatgaagcattttcattggctactgagtattaaatatctggcaaatagaatatctctctaacataactcaaaattattaaaaatcacatcttctactaattctacaggaagaagttaagatttacaaaagtcttccaaccacaaaaagccactttaaggaaccacgtggggcacatgacaataacaatcgcaagtcctccctgctaggatgttagctcacaagggcagaggtctgcacctctctgctcacctgtttccataacacctaggagtgacagaacaagcactggaattttaatcagtagaactggattcaaatctaagctctaccagtttccccctatttataaaaataataataataatccgttcttcgcagggtgttctgatgattcaggctcaggaatctgcatttcatatgaaaaggtgtaatgactctcacatgttgtttacataaataatattctgagaaacactgtctccccaaactccatgttgtccaatgaagaaactgacacccaggtgagattaactgatttactaaaggactttccattactttgaggaaggaagaaatagatgtagaacaaaaaggggcatgcgagttgtggagcaagcacaaactgtcttttgcctcccatggacactgtagccatctcttttaaaattgatcacttactaatccatacatataattattttttaataaatttgcatcatcagaattgctgcatcacagaatattcacttttggaggatttcaatatatatttatcaaaattgtcttctacaaggcctatagcaatttacaatcccactagcagggtaagagagaagggtaatccacttcaacctcccaccaaatagtgggtcaggaggcgatagcgtgctatctggagctccggctaaatttgctggggttctgcagagtctccaatggaaggttaatttttaggcacagcattttgtttttgacacagacctgcggctgcatcttgggcttacaatatattttggtcagtttgttgtatccttaatccttgctactgatttgggataaaactagattatttcacaagaacagtggttgcaaatgagataaaaccacaaaatcttactctcaggagaagcaaattgaaaatggtttggatgatgagtttcagtcagctttactacatgagccagaacataacataaactcagagtaaaagaaattagaaatggaaaaaaaaccagttccaaagactaaaagtgaataagccaaatatctgaaatttaacaatttttcatatttatacccatcacttgcaatagatggaattgcgtctgttcagtcggcttgtgtttttttgttcattggttttttatcaatatccatcacccaaaatacagcaactaaggaatttctgcaattgctaagcatagagcttacatagacccatctaaattagtgctaccaaaactctgacgtgtatacaatttacctgaaggcattattaaaatgcaaatactgattcagtaggcctggggtggggcctgacattctgcatttttaacaattctccaggtcatgctgatgctgctgtttcctgggtcatactttgaaaagcaagaatctatactaaatgtactgaggaaatacagcaggacatcaactgtttatccctaagccaattgttgtccacaatagtatcacagtacaccagtatgaccatttccactgaagaggaaagtgatagaattagaacaagcacctggtcttgagaatcacttgtgtacaccacaacctatgctatcagtgacccaaccattagttacttgacagggctatgttgccttaagaacttgtgagcaggtgtgtggggcagaaaagaagaaagtgaaaataatcacctcaagaacttttctgccataacttgagaagtgtactacttattttttagccctagagctccttccagaaggggatctcatcaggttgattaaaaaagacatatcaccaaagttattagtcatttaagtgggcggggggacaagatgatattgtggaaattttaagcatacccttctatagattgacatttatgtgcaatatatatgacccctggtttcccaagcaccatagagaaagaacaattttctagctaatatagttgagataaacatgagctgagaaaaacagttctagaactatttccaatgatttaagaagtaacatgatattcccaaaacaaaattaatttttaaaatagatatatttcaattagacattagaagaaaagagagtgatacaaaagctgccataaaaaacaatttttaaaaattattaatttagatataattatttactacctcctcagaagcattgaaaattaactggactatggaaacacataagaaaagtcaatgcgcaatgactaagtgtactatttctacatagttcactgaaggactggctttgcaaaagccactaaattttacctacatgagtgacaaagttctatttccaataatcaaaaaatatctggcagcagtaaattttacttggtaacttataataatcaaatttaggagtatattttctaatattttaagaagcacaccttgccttatacatggaaatacgaattactatcgttaaagtaataaccacagatagtatgtgtagctatcatgtggttgtatttgagaacagagtttcttatcccaagctttaacctcggatataatcccttctcaaatgccctgttagggtttctttctgagcctcttgcacattctttggatttatttaatgatggattcctttgagaatggcttgtatttttaaaaatagccaaaagccatttgaaaacaaggataatggacaaggaaggacaataaatactgtttgagggaaacagaagtaaataactgggattgattttcttttgtagccagtgagtgcattctgaggccattctgaagttagagctccaaaaatattttgagccgcaaaagtgttatttgaatagcattgtgatgacttggaagactaatacatatttaaagattattttgttgaaaaattgattcattgctcttaatccagtgtcaacacatccacaagggtgcacagatgggtttcagggcaatctcctgcaactgcatgtcaaatgtggtaggtacgtgcctttgggtttatttgttatcagaggagaaaactgttctcatcagagtttcaaaaatgttcataattcacaaaaaagaagcaagttaggatgtcctgcagatatgtgtgctcaggccacctacttacttgcagtgtaaccttgagcaaattacttaaactccctaaacaggagtctcttcctccataaaacggtgataatcatatctatccggaagattggcatgagaattaaagtgaatgcagtgcctggcacatggtaacaactcaataaatggtaaccttgttgatacacaattgtatagccttaacatgacttaatttctcaaatatcctgttcattgccaaatagccttgactctccttgtgtcatttcatccttctctcaaggctcagagaaaaatggtatcattttccacactgactcccccaatctctccatcttgttccttcatgtttcttggatcttactttctcattgcttccttcaacatctttcatctctcttcctctgctgtgttcttctctccatactagttccccactttttgcaaaatattttcttgccataattctatctataattgtatacctccttttccttttaccatctctttttgaatatgtggtgggctccaatgtgtccagttcttaattcttaaatggctaaatatggtttctgcatgtgaatgaaaatgaaaggtcagcagttacattcccaggagctgacttctctcgcaaactgctggtcagaaacaaggctggtgaacggttctgatgaggcttcatttgggcattgtcctgtgtatggagacaaagatctactgcagaccttgttgctaatgtattctcaattcctcaattttattcgtgctatcagaacaagctccatcctaactagactatgtgatgctctttatcaactaaccagcataacatgcacactcaacatgaacagatatccagaaagaatgacttcaaacactttcaaatgtcttcacatagcttttctcaattctcagcctgtggtattgcttatagcattgagtgtggcagccttacctcaagctccataatttttttttttttgagttggaatttcactcttgtcgcccaggctggagtgcagtggcatgatctcagttcactgcaacctccacctaccgagttcaagggattctcctgcctcagtctcccaattagctgggatgacaggtggtgccaccaccggctatattttgtattttgagtaagacaaggtttcaccattttggccaggctggtctcaaactcctgacctcaggtgatccacccacctggccttccaaagtgctgggattacaggtgtgagccaccgtgcccagcgctctatattattatcgcttgcatcttaacacatctactcaaatacaatatcactaaaactgaaaataatcaatagctaaattttcatccgcctgaaactggttctcctactccaccttcttgagtctccagtttgtgccagtgttatcactcaagttccctactatgaaaaaaccgaccctggtgatgagttgacaccatgaaacagagactccaacaaggagtaacctgcagcacctctcttcccactcctaagggatcagctatcccaaagcatttggtcctctcctttcagtttaatctgaaattagcctagtccattcctagggcatagatatgaggtctcctattttaggaactaggtcttgctctgaaggtccaaatttcttgaggtcaaaagtaattaaatttggaaaactttccattatggtgagcgaaaatctccaatacaattaattcagagttttaatagggctttttatgattttaataatgctatccatatttgtaagcaaattagagcttcaaaagaccatttcatctctttctatattatatatgtgcacatacacacaaacacacacacacataaacatgtgcagttatttattagtcaaagatttattgagcaactttcatactcaagttaggttgttaggcaaatgggatacgaagatgactaaaatatcatctctgtcctggaaaaggtcattactagaggagacaaatatataaacaaataacatcgtaacaatagcagttgtactagctaactcttgctgtgtgcttcctgtttgctagacactttgtcaagtgctttacatggatattttatttaatagtgtgcaataatactacaggtaggtactattatagataaacagaggttttaaagatgttgggtgccttgtccaagcctatgaatgggcaaaagcttcaaacctaagtctgtctaacctgtaaagcaaactttgaactagcacattttcttgcatccaaaattctggaggagcaaagaaacaggaagaatgccatggggtatgcagcaaggaaggtggttcttactccacagctagtcttggacttactagagaaaagggacactgattgagtccctagaacctaaagcctagggaataaaaggaggcaaggagcaggggtccttccaaagtcagagctgcattgctgggaactgctttatcaattggcccaggcagcccaaccctcggtacaagaggcataggaggactcccttgcctctctttgtacctctcagttaggtttaccaatagctcagacattgttgatctgtgttgtcattcccatttatcactacagtgtgagtcattgttttcccatactgcttctttgaagaagcaatagatgtgatccacacccattttacactggtcagcagcactggaattgaggaacaaccaaggacagttacacaacaaaatttttggtaacacaggcctaatatctgcctcataaaacttttctattttttttttttttttttgagacagggtctcactctgttacccaggctggagtgcagtggtgcaatcttagctcacagtaacctctgcctctggggttctatttatcctcccacctcagcttcccaagtagctaggtctacaggtatgcaccaccatgcccagctaatttttgtatatatttttggtagaggtaggatgtcaccatgttgcccaggctggtcttgaactcctgggatcaagcaatctgcccaccttggcctctcaaagtgttgagattacaagcatgagctaccgtgcccagcctataaaacttctcttagaaaaaaaaaagttatcaggtatcttgagctctttcaaaaaggcaaaacaaattcttagtaacatttatgtacttctcatactttttgctatgggaaaagatactttttgctacgggaagactttttaattgacacataacaattgtacatatttatggggtacaagtgatgttgtgatatatgtatacaatgtataattataaaatcaggataattggcatgcccatctcctcagacacttatctctttgtcttcagaacattcaaaattcttttatctattttgaaatgtataataaattattgttaactatgtgttatagaacactattgtgttctatagacactagaacttattctttctatctaagtataattttgtactttttaatcaacctctccctattcctcctcccctttacctttcccagcctctgtaatcactattctactctcgactatgagatcaacttttttagctcccaaatctcagataacatgtggtatttgtctttctgtgcctggcttatttcacttaacataatgtcctccaggttcatccatgttgctgcaaatgacaggattttattcttttttatggctgaataatactcctttctgtgtatttaccacattttctttatccattcattcactgatggacacttagattccatatctttgctactgtgaatagtgctgcaataaatatgagaatgtggatatcacttcaacacactgatttcctttcattgggatatatactcagtactgggattgctagatcatatggtaaccctatttttagtttttaaggatcctccatactgtattttataatgactgcactaattttcactcccactaacagtatatgaattcctctttctccgcatctttgccagtatgtcttttatttatcttattgattatagctattttaactgaggtgagatgatatctcactgtggctttgatttgcatttccatgatgattcgtgatgttgaacattttttcttatacctgttggccatttgtaggtcttctcttgagaaatgtctattcaaatcatttgcccatttttaaattggattgtttgggttttttttttttttttgctattgagttccttatatattctggatattaatcaacacagggaatattaatcccctatctgtgaatagtttgcagctattttctcccatcctgtaagttgtctcttcattctgttgtttcctttgctgtgcagaagctgtatagtttgacagtctcacttatctatttttgcttttgttacctgtgcttttgaggtctcatcaaaaacatttttacccagaccaatgtcctgaagcattttttctatgttttcttgtagtagtttcatagtttaggtcttatgtttaagtctataatccattttgagttgatttttatatatggtaagtgataggggtctagtttcattcttctgcatatagatatccaatttcccatgaccatttattgaaaaagactgtcttttcccaaatgtatgctcttggcacctttgttaaaaatcagctagtcataaatatgtggatttactaccataagacttcctatcaaaggtgctcaaagttcttcatccacttagtcttcaaaaaatgttttctgaggccctaatatgcacctaggcagtgatccaagtactggggtagagctataaacagaaaagacaaaatatctgccctcagaaaacttgtttacttgcaaatgtagctggatgaaaacttaaaacttagcttgataaggaactagtcctgacaacaaattacatagaatgataaaaaggacaagatgcaatttcacttataaaaagagcttcaaaatgagttggcaagtggatgagattctttttaagctatgattttattgttttttaaaaaacatgtctttttaattttttttaaatcaagctatgtagaaaattacaaagaaagaaagcaataaatcgcccatatcctcctttctggattcgctcatgctatctttgatgaatacaattccagacatctctgggcagctttagacacaggtagatatgatggtatatgagaaggatcacactatatgtgattttagtagaattattaaataaaactatacttgaatttaaaaagaaacagaaattggagtaaaactggcttggattattgaactgtaaataaatatttttaacgaacagtaatactaaaaattcatcaaagggagggctggaaatccacatgcagaagaataaaattggaactttatctcacaccatataagaaaataaactcgaaatggactaaagacaaaaatgtaagatctgaaaccctaaaactactaaaagaaaacatagaggaaaagctacttgaaagcggtctgggcaataatttttttggatatgacaatgaaagcataggcaacaaaaatagacaagtgagattgcatcaaaagacaaaccttcttcagagcaaagaatacaaacagagtgtaaagataacttctggaatgggagaaaatatttgcaagccatatatctgataagcagttcaaatccaaaatatttaagaacccagacaactcatcagaaaataacttaaaaatcaaataacctgattctaaaatgagcaaagaacctgaaaagacatttctcaaaggaagatatataaatggccaagaggtatatgaaagggtgctcaacatcactaatcatgagggaaatacaaatcaaggctgtggtgagctatcgcctcacacctgttagaatgattatcatcaaaacacaaaagataagtattggcgaggatgtggaaaaaagagaactcttgtacactgttggtaaaaatgtaaattagtacagacattatggaaaatgcaatgcaggttcttcaacaaattaaaatagaactatgattctaaaaatggttcaacaaacccacttctgggtatatatccaaagtaaatgaaatcactatctccaagcgatatctgcactcccatgctcattgctgcattactcacaatagccaagatatggcaacaacctaaatgcccactgacagataaataaaacgggttacatatgtacaatgaaatattattccttcacataaatgaaggaaatcctgtcatttgcaataacatggaacctggaggacattatactaagtgaaataagtcagacagagaaagacgaatactgcatgatcttacatgtgaaatctaaaaaagccaaatttataaaagcagagagtagaatgtctgccagggactgggggagaagaaaatagggagatgttggtcaaagggtacaaaggttcaggtatgcagggtgaataagttccagtgatggaatgtacaatatggtgactattgttaacaatacctcattacatacttgaaatttgctaaaagatacatctcaaggattcttaccacagcaaagaaagaaaaagagaaagagaagaaaaataaaattgtaactatgtgaggtgatggctatgttcattaggttggtggtaattatttcacaatgtaaacatgtatcaaaacatcaaattgttcaccttaaatatacaaaatttttatttgtcaattatacctcaacaaagctgtcggggaggatggggaggaaagctggaaaatgcaccatgagaacagcaggaggatggggctggctgaggaagccaaagtgagaaggcagtcccttcttaaggtggcagctcattctcaggtccagacaggcttgccttctgggaattgagtcttgtagtttcaaattttataattacttgagaaatcccagaaactggatttttatttaaaattttgattttttttaaagattcggacattttttcaagttatttaagaaaagtgctgtccccagcctaacatctctgactctctaattttaatccccaatgtaagcacttttaatgacctgcattttccaaatatttatcttgctatttccaaaaactgtgcttatgttgttatttcttgatttatccattttaagtataatctattcaactcttattatcagagatgacctaccccccccccaattatttttgtttaaattaccatgactgtattaatagtcactgctaaaccaagtggtaaactataattattgcctagatgtacaactttgtttcatttttctaaaaagtagcactttcttattttattattttttcccttttccatataactattgctaattcttcccttattctcaaataacctcccaaaacaatcttccagctgtcatatgtatcacatgagctattgatccattttccccacccgaagatttctctcctaaagtgctccatgtttttgctacaatgtgtactgattttctagacatggttcttaaacctcagtaatattgctgtgatgtaaggaaagggaaacatactttcttaaggattattatttaaataaaaattttaaacattggctgcctttgctgcgtagaattagaggctttttttccgagacaattcttactaactcttcactctcagcaaccatatctattggtagacgtaaacccatacagtccagttgcagtaagaagcctttaggtcaacatttttctcgaaggtggcctattttaggatttctcattgtttaatacagaagaacaactgctcaatatttcagtcttcgcttccaacattagttttgcttcctctccatgtgtttgagtgtttttgatgtctaaggtttttacagcagacattagcttcctgaaatttaattcaaacattttgtaaaggtcactgtgtatatgtgtgtgtgcgttttccgaggagcaggtccacagtttttatcagattctcaaagccgttcttgatgccaagaggttaaaaatttctgctttgtggagtagatgtgctcgtaatttggagaatcaaaataataaagttagaagggacaagaagaaaccatttggcagttaagcaattaagccatccaggagatagagtgagttatccttttctggaagcggctcatccatgactaaagtgcacagcttttcacctgtcaaaaccagtaggcttcaaatctcctcaccagactatagaacccagttaggctctttgacagacagcagcctattgctccttattacaattcttacagggcctcctcaccatcccccaccatgcagattgcacaagtcaccacctgcacagacaggcaactctctctgcacaccaagctggatttctggtaagtgtgtgggattacataaaatgcatcagacaaggaggaagaatacttgtaattagtcctattcagctatcaactcaccacatccctcaagtgtgacataagggaatttaaaggaaaaggaaccaatattttttttaagtatgcataatgagccaggagctgcatatatataaatttcagttaattctcttgatattggtatgggatctattattatcttcacttgacagaataaatactaagagagagataacttgttcaagatcatagtgaatcacagagctaaaattctaactgacccctttttgtaaatataaactttatttttttagactggttttaaatttacagcaaaattgactgaaaattacagagagctttcacgtaccccatccccacacatgcacaacctccccggctctcaatattcaccgagtgtgtttttttaaacacgcaaaaaaggcattttctttcttctgccaaaattctgcaattctaaatccattcatgtaacagcaaatgtgtttgagtaatatcacatttaaaaggcccctactattaattatattaaagcaaaatatgttttacgtaatgaataattaataaccacttcatcatttatattttgagtaaatgtagagtttctcatacaggattttcttagagtagagtaaactctatccagacctagtccatatgataaaatgactctattgatgcttaaattcatgtatgtgatcatattaaattgcatattttgaagaataacttgtgatatacaatttctaaactgtctttattcacacaaagttccatgaaaatcagaaaatgaaagtacctaatctcacttcacagctggagccatttaatgacaaatactcaaccagaaaaaaaaaaaaagtgatagggagacagtaggcaagagaaacagaatttaaaactgtttggtaaaatgtagattaaaaacttcaaaaagataaaaaatattggtggctttagaatattttgaacaagttagttaatcttgcaattcttcagtttcctcagctgtaaaatgtggataacaaccagatctgcctcatgaagaccctgtgagaattaaacaagatgatgtgtgcagagtacagaagtcagtgagcccagcatctacaagtgactatgtgaattagtggttattatggctacgattgtgcctgctgctgctaaagtcaaacgtttttttcctttcataactgaacatagcaggatttgcatttgtggaagatggtaccaaggtacctatctctctgaaagtcaaataaagagaaaaataaaaaaatgtcgattcatcttcattacattttgccctaaaaatttactacttgttttttgtcttaaaataatagtcttttaaattgaaaacaaaacaaaacaaaacacataagtctttgcgggaaagcagagcagtcagatcagccactgcctcatgtgtggagtctgtgctaccttttcaacaacattaaaattacatggcaaagttctatccactctaaacagggaatctcttaggaagagattgagaaataacagaaccaagacgcagaccacgtgaggctctattgtcgccataagtcatgaccgtggtctagaaatttagacacgaatttacctccacttttttcatcaacaaagtgaacacgaatgcacgccttaaaatcagaggatccaaaatgtaacatataaactggattttagatgtcatttcatttgaattttttcagcaaagcaagcttcaaaaactctggagagaatttctgagaatcacaatgcgactaaagcctttttctccattgaattttaaaattctgtccttgaagaaagacgcctcaaattaaagtgtcatagccatgatcacccactaggggcagaattaggacaagcaggaaaatctaacacccagcccagcaccctttccagtacctcaagagaactatcaaaagaaaggttttttgaaactagtactctttttttcctacttcaggctgtctaaggtcattatattttgaggataaaacaaagtccaagaacacaaataattcagctctagccacttacccagaaggagaaaatgaaaggctctctgccaaggttatgtaagatgtcacccccaaaacaatatcccactgacagagaaagggaacagccagaatcttggcatgtggctgtaaagctcaaagttcagttccatttcagacgtacctagagtcgctcagggaattctccccaaacatttaaattcagcaatggaaaagtatttaagttacatgggagtcattttttattcttttcttttcagcaagtgttgctttctttgaaatatgaattatatacacccactataattaaatgtctctgatggagaatgaatggcagttggaacctagtttttcacttgttccatttatcacaggatgtaaaatactcttactctggtaaatatttcttcagagtatcattctcgagtagattatgtgattttcctttacaagatcaaatgcttaggggggaaagtattaatttaaaatgcctaggagaggtgtgtatagatcccgactttaaataatcaatgcttgttattctatttaattaaactagtaaggcaaacatcttcccaatagagcccaaaagaaagcaaaatgaaataaactagattccaagaaatgatttcaccttgtaagtaagctgtctgcttttcttctcttcatcttccacctttttttaattcattctcattgccgtctctgcctgtcaccacctgaaacctcaaaaggaagtttatccctgtgaaagatagttcttcctactgccattgtaacattagaattgttttaaagacaaacaactctggagttaaacatgatggatgcaaacaacaaaaggattcttttgttatcacaacaatccctgctgtcctcattttgctactatgtgaatttagaagtacacttagtaaggtcggagttatgcataggatgtacctattttttcatatttgcaatgatttgggaagctggattaacttaagtgctataagacatggcctaaaaaagtagagccacttctggtcgagaatactctatgcgccactctcttacatttcaaactagaatcttcttgaccgtggaccaaactgactgtggcttgccacaaggttcatctccctgtgtctgggtcagttttcccagcctataacccaaagtcagcctgtcaagatcctcaacatgccagcaagagctgtgtatgaaaaaaatgattatttatgaaattataaagttgttttataatcacatcatataaaaattaagcttgacatcattatctggaataaaatcattctaagccaagaagtagttcaccagtttaaagtatttacttaacctgtttataaaatcatttttttagaaaagactaaaacatatacctagaaaatcactgagctcatctaaagagtgtccattgtggtatagcataaactctgtagtggctacattctgaaatcatagtgttaacagtttggctgtgtccccgcccaaatctcatcttaaattcccacatgttgtgggtgggacccaaatcttatgttaaattcccacatgttgtgggtgggaagtaactgaatcatggggcaggtctttcccatgttgttcttgtgatggtgaataagtctcatgagatctgatggttttaaaaatgggtgtctccctgcacaagctctcttctcttctctgccatcatgtgagatgtgcttttcaccttccaccatgattatgaggcctcctcagccatgtggaattgtaagtccattaaatctctttcttttgtaaattgtccagtctcaagtatgtctttatcagcagcatgaaaatggactaatacagtaaattggtaccagtagagcaggcactgctgaaaagatacccaaaaacgtggaagcaactttggaactgggtaacaggcagaggttagaacagtttggagggctcagaagaagacaggaaaatgtgagaaaatttggaactccctagagacttgttgaatggctttggtcaaaatgctgataatgatatgaacaatgacatccaggctgaggtggtctgtgatggagatgaggaacctgttgggaactggagcaaaggtgattcttgttatgtttcagcaaagagaccggtggcattttgcacctgacctacagatttgtggaactttgaacttgagatagatgatttagagcatctggcagaagaaatttctaagcagcaaagcattcaagaggtaacttgggtactgttaaaggcattcagttttaaaaggaaagcagagcataaaattttggaaaatttgcaacctgacaatgcaataggaaagaaaatcccattttctgaggaaaaattcaagctggtggcaaaaatttgccaaagtaacgaggagccaactgttcaccaagaccatagggaaaatgtctccaggtcatatcagagacctttgctgcagtccctcccatcacaggcccaaggtttaggagaaaaaagaatggttttgtgggccaggtccaaggtccccatgctgtatgcagcctagggacttggtgccctgtgttccagctgttccagccatggctgaaaggggccaacgtagagcttggccatggcctcagaggtgcttccatgcggtgttgagcctgcaagtgtacagaagtcaagaattggagtttgggaacctctgcctagatttcagaagatgtatggaaatgtctgaatgcccaggcagaagtttgctgcaggggtggggccctcatgaagaacctctgctagggcagtgcagaagggaaatgtggggtcagagccttcacacagagtctccactggtgcactacctagtggagctgtgagaagagggccaccatcctccagactccagaatggtagatccactgacagcttgcactgtgcacttgaaaaagccacagacactcaattccagcccatgaaaacagccagaagggggcatataccctgcaaagctacaggtgcagagctgcccaaggccatgggagcccatctcttacatcagcatgacctggacatgagacatggagtcaaaggaaatcattttggagttttaagttttgactgccctgctggattttggacctacatggggcctgtagcccctttgttttggccaatttcttttatttggatagctgtatttacccaatgcctgtaccccccattgtatctaggaagtaactaacttgcttttgattttataggttcataggtggaagtgacttgccttgtctcgaatgagactttggactgtggtcttttgagttaatgctgaaatgagtcaagactttgggggaccgttgggaaggcataattggttttgaaatgtgaagacttgagatttgggagggtccaggggtggaatattatggtttggctatgtccccacccaaatctcttcttgaattctcatgtgctgtgggagggacctggtaggaggtaattgaatcatgggggcaggtctttcctgtgctgttcttgtgatagtgaataagtctcatgagatctgatggttttaaaaatgggagtctccttacacaagctctcttctcttgtttgctgccatgtgagatgtgcctttcacctttcaccatgttgtaaggtctccctggccacatagaactgtaagtccattaaatctccttcttttgtaaattacccagtcttgggtatgtctttttttttttttttttttctaagacagagtctcgctctgtcgcccaggctggatggagtgcagcggaacgatctctgctcactgcaagctccgcctcccaggttcatgccattctcctgcctcagcctcccgagtagctgggactacaggcacccgccaccacgcctggctaattttttgtatttttagtagagacagggtttcaccgtgttagccaggatggtctcgatctcctgaccttgtgatccactcgcctcagcctctgggtatgtctttatcagcagcatgaaaacaggctaatacccatagcctataattaaaaattatttttaaaatgcagagcagtaactttcatctggtaagatcaatatcgatagtttgtcagttacttgaaaaagctgaacaaagtagaggagttttaaaatcaaatattgtaatttaaaacctgaaaataaacatgaatttaccaatcttttaatgtagagggtctccttttattgagtgcacattatctgattagaaatccatatcatctttcctgaataacccacatccacaaggcgttctctccaaatccccacttcccttgcaagaacccagaaataattttgcagaaattttagaatacaggccttcaagattttcagtttcccctccaacctcttatatttgtttcatccacatccaaatttaatagcaagtctagtaacttctctttatcaagtctttctaagcattatatataattagttttcagagaaataaaaatccccttttattttgcagtcatatttcacggttcacataatattgcaattacccactttaattcaatggcaagtataggtggcataaacaggattgggacaaactcacctgacccttggcaggcacacaattctattgggaaagcaaaactgtggggatcctgctagcttactttcaggatgatacagacatcagatagtataagaaaaaaaaattggttaatatgttgagtcagttaagtggagatactcagttggaatatccaaatccatatccaagtccatatcttttactatttcctcacactttcatccttccatctttgatatagttttcctcttttacctgatccctgcagttttttaaaagtagttgatttccaaacacattgtattaacattttctaagcaatttgcatttcagttaatgttatacaatacaaagtatatttctggctttaaaagagggcttcatcaaaggagtttatttttaaaatctaatcaagcaatgtaaaaatcgttaagtgagaaacaagctcttacaatattgatgagtaaaagaataagatcttcataggtaaccaacatatatcaccacatatatacatggaaacaaaggcgaatttaggttgactttcatttacatttatagtaaataagacaatgtatcgtgaccttccctgggaataaatgtttttttcacttgaaattgatatccatgaaatcagttaggcagttccaatataattcgcctttccgttttagataaggaccagatgtgctctattgggacacatgttttcatgtccatttgtattttcccttcaggactaagggtgtggagtctagaattagtgaggctctctgatttgaaactgcacctccctcacttactacattatatgtctaagcaacagtctcctccccatggctcttctgtcccatgcagaacacagtcatgccttgtgctaagctggtagccccaggtagagtagcccaggaaatgcttgggtgaaaagctgttactcttgttctctaacttatattgcagaaaagcagtgctcccacattataaaaggacaggcaagaatcccaggaatctctttacctcttcataacaaatcccactctgatgagactagaatcaattaactccagtgcctaatacacacatcactactatatgcaacaattctattcactattctagaaaagccttgctaaacaaatctgccttacaatgacatctgctgggagtttctggcactggatttttttttttttaagaccaatatctgaggttaaaaaacacggctcaagagaaagagaatttaactgtgtcaagaatcaatctctcaagttatctttcaaactagggactatatcgcttaaaaaataaagaaaatatacctcaggtgaattcataataaatatcagatgctgagctatgaaactgaacccaaaacatgaattaacattcgaatgcagtgttatccagcttttaaacattccatctagcaagaaaaggacagaatatatgacattcttcttggatatgcttatacttcagagaatttctcaatgccgaaaatctgtcatttttttcaaaaatatcaaagtatttattgagcttgattattcttcatatttaagggactactgctgtaagtttacgttagaaatctttaagggctggtgaagagcattttccttctaaccccaagtttgaattccagttgaggatgtggccaaggtatggtgttagaaggaccatgggagtgaatcttccagcaactgattgacatatccagtggttctgccttcaaaaagggatgatggctgggtgcactggctcacacctgtaatcccagcattttgggaggccaagctgggtggatcacctgaggtcaggacttcaagactagcctggccaacatggtggaagcccgtctctactaaaaatacaaaaattagctgggtatggtggcaggcacctgtaatcccagctgcttgggaggctgaggcagaacaatcacttgaacccaggaggtggaggttgcagtgagccaagattgcaccattgcactccagcctggcgacaagagcaaaactccatctcaaaaaaaaaaaaggatgatcatgctgaaattaagatgatgcctaatatttctctgtcaaagtaacctaagctataaaagaaaatctcctaacattctctcccctgtgaagcggcagacacctaaacgaaggaggagttaagttatgggagttcaccgatgaattagaaaggcaaaaggaattataacatgaacaagttataattctacttaattgcacccactaagacatattaacatgagatgcaattaacctaagtattagcacaaagtccaatctccagctaccacttagccaaaaaatttttgtaactgaatagaagtgttcattgttcattaaggaaatttatattggcattattgtatttgacagcatgatggacaaattacatttctcttgctattgttcatagtaataattgaggccattctttaacctttgattagataatgattaagaaattcttgagattatgtttgtcagaacataaaactggagataatctaaatatcaataggagaatgggtttaaaaaaactgtagtatattgatacaatggaatattaaaggttaaaataaatgaactagaacttcaaaaagaaaagaaaaatattatgagcttaataacattgcaatctctctgaatttcctaagagaacaaaaaaaacaattacagagaaattggactggtgtcctgagaaaaagcccatagactgttaaaaaaaattaagccatcatatagctctttacttcagccataagagccagcaccccaaatctgtgctgttcagatctgtccacctttcaatttcattttcatgtttaaggacatgaagcaacacaatattgaatctaataaagtgtgaaggctgtgctttgcggcaaggcaggagttattcccacaaaactgacatagggtcaaaaagcataaagagttggtatatattctataattccccatctttttcctcataaatggaggttattttgaggcatggctctacaagagcaaaggctatgtccagctctgttcagtgctattttcccagtgcctgctggtgaatgtttatagaactgctttcctacttgtaagctattttacaaccttgacacctgatatatccacatcttaaagcagatctttccacatcttttctgactctcattgttccctattctgctccaccccagatcccagattccaggagtccacctcagctagtctgagtctcccttacattgctctggcggcagagagagtcctctgatttttacagaggccatctgctgccttggaccaaagacctctgctcacttgagtcctctggcatcaagactctgggagtgagagaagggagagtagaaacaactggagccatcagatggaaggtaaagcatgtaaaggagcatctaaggaaatatttgcccacaaggcagtttttgaaatggatgttgaaagatactaggggcatgattggaggaaaccaggaaaatttcaaaatctttgtcttttaatgtcactctgtttgtataaaagcatttaaaaccgcaaacattacacatattgggataaaaggactatttaggcagctttacagttaattatactgatttgtcttacctgcttattcccaatacccaaatacgtgaatgtctgtctgcttgctacacaagcaataaactatactgactgtatgctcatattaagtttcaaccaggaacataaccaaatatcttgctaatgctgattctgaatgtttttgctgaccatttaaacaataaaccagtttgaccaaagaagttattatgcagttgcagagatagatattttatgccctcttctgcaggataattttttcttaagcagaaaatgtataaataatctgcaaataaaataattttcatttagactacttccatacatgtttgccaaatctatcctgctccaatcccccagcactactagaccaagtctcatctctttagtctgcattactgccacagccctgcctctgaacttctgcctaccctaccaagagaaaatgttttcactggccgggcacggtggctcaagcctgtaatcccagcactttgggaggctgaggccggtggatcatgacgtcaggagatcgagaccatcctggctaacaaggtgaaaccccctctctactaaaaatacaaaaaaataattagcctggcatggtggcaggcgcctgtagtcccagctgcccaggaggctgaggcaggagaatgggatgaacccgggaggcggagtttgcagtgagccgaaatcacgccactgcactccagcctgggcgacagagcaagactccatctcaaaaaaaaaaaaaaaaaagaaaatgttttcactttactcctgtaaattgatacaacaaaaatgctgtaatggcttctgatttctttcaacttcaagccacttccaagaccccagtccactttgtacattttatattccattatttcccactatatatggaaaacacattgtcttccaggtttagaaatctctttttaggtcaattaatatcaatattccctttaagctactcagatcttgccttaaaagaactgcctggtcagtaagtctcaactcaatgccactagagcttcctcatacaagttattcccagcagcattccagaaatccatatttggagctctaagacacattgtcttactagcacagaattctagttcccatcttaatcacttcattcattttgtccttttcacccggaacggtatgcccccctacttcactccctattcaggttctaaggaaatatttgccttaaagattcaccttaagctgtatctgaaagcttttatatacttcaagtggtaaagagttctgccccctcttgtaatggtcatatgaccattaccaaatatctgttgatcaaacacaaagcctaaatcatagaatagtgaaatgaatagttttaatcatcttaatcaaattaacgtgatttctctatagcttcaattagtatccaatgccagtcaatcaatattcctccccattagtataactcagagattctcaaaattagctgcttttcaaaatcaacgatgaagcttatagaagaatggatatctggacccctccctaagactgtgattcaggaattctggaaaaaaataatctagtttcaagtagctccacaggtgtttctgatatccacccggggccaggtcatagtagttccagctgagtgcttagtaattgacccacaagtgtgtcaggccatgaggagtcaaagaagccatactaacaacaagagatttagggtgatctgcagattaaaccacaaagcaaaaagttttcctttacatgccaaattccgcagcccctgcagatccaataattcataataatttctttgtagatacagttacaaactgacaactggagccaggggttcccagttgtgacagcacccagaataatctggaagcaaacataggtacactgacccactgaactggaaactctgggaatgggaactggagatctacatttttcaaatctccaggtgattgcttaaagcagaaaggattggaaatctctttttaggtcattccaaattagtacctatattccctctaagctactcagatattgtctttaaagaactgcctggtcagtaagtctcaacccaattccactagagcttcctcatatgagatcttcccaacagcattccagaaatccacatttggagctctaagacataaggaaatgataaaggattcctatgaaagaagacaaaaacttggtttgcgttagctgatactctcatctttccaatggtcatcacaataattgcttaactaagtcagtgttatggcacgagtgtttgtatattgttctaaaatctttccattggctgtgactctagtgtattaaccattcttcttgcctagagataacctaatatctttgccatacagaagatgaaaagcagctgaaacctttaggcttctttgtgtaaatatattagctggggattcatatcatgaactatccactctttaaatacccttggaaactgttttgtctcaattgcaaaaatcactattatgaagcatcactttttattataacacagtagatagtttaatgtacagcaaccaagaaaaaaaaggaatatgtttgccagttggtattttgcccttattatataaaattggaaatggaaaaggcagccttgatgaaaacactgaaattccagtaagtaggattagtcatactttttgtgttccagggttagatttcaaacggcaagtaaaaattccctgagctaccagtggaggcaaacactctcaaattaaaataaaaaggactacacatatttacaagagccaaagctagaatgagtaacgtttgacatttggaaggctggaattgcagcaaacagctctctccccgaggagaaacttctcaccaaatagttggctcattgtggtatctagctttctttgaaacagcaagcctaaaatcttcagggagaaggcaaattaatgaaaaccactttggcttaacgcctcacaggctgggaactgttgtaatcaagtcaaaaagcacaggccaactgagttttaaattatacactggtgggagaaactggaaagacatcaatgataacagattgtttacaggcctggggcccctcttgtagcctcactcactcagtgagtgtcttggggcttttcacttccaccattaataagatctctttgcttgggaggtaacacttggacatcctttgttttgtacattaggatagcagccatattaacagcagcaacattttttcaacataaacataacagcaaataggtaataggatgagtcaaggatcaaaacatgtgcactgtcggccagacacagtagctcatgcctgtaatcccagcactttgggaggctgaggtgagccgatcacgagatcaggatatcgagaccatcctggccaacatggtgaaacttcgtctctactaaaagtacaaaaattagctggacgtggtggtgggctcctatagtcccagctactcaggaggctgaggcaggagaatcgcttgaacccaggaggcagaggttgcattgcagtgagctgagatcgcgccactgtactgcagccgggcaacagagcgagactccatctaaaaaaaaaaaagtgcactgtcacccacataattcacagggacaaagagacagagaggcagagggagaaatagggcagactttcagaagtcctaaacatgaactaaaatactaaggtttatacatattctttatatctcataatctttcagagtatgtaatcttactttgattatgtaaccataatctttcagagcagtggagtataaaataactgttgcagattattaactttctttaaatgccaatggcaaaagttagcgtttacgagtttttcttccaaaccatctatgcacctcaaataatctctttggaagccataacatctctttacagctcacgtaggaaattcaacttctcctaaacccctcccattcagatgagcgctgggtaaaagctcctaggaggcctttggctaggtcagctgccttgccctattctgctcagctgggtggtgtttgtgtctttccacaaaatggataaagacaagaaccgattgcccaccctatctaacagtctcacagcttcaaggagtttcctgatggcccactgctcctaacatgtttctcctaccaagtcagtctatgacagtagttcagcaaagacccttttattactttattgtggctgctgtaacaaagtatcacaaaatgggtggcttagacaacagaaattcattgtatcacagcgctgtggaggctagaagtcagagataaggcattggcggagttagttccttctgagggctgtgagagaaggatctgttgcagtcctctctccctggcttggagacagtcatcttctcctggtgtctcttcacattgcctttcctctatgcatatctctttgttcaaatttccccctgttgatcagacaccagtcgtgacggattagggccagtcctaatgaccccattttaatttgattacctctgtaaagactttgccttgaaataaggtcacattttgaaggactaggggttaggatttccatatataaacttcaggggtaccaaattcaggccataacaaccatctattcattcttatatggtgaacactgctgacaacattaaggtcaatttgcactctgagaagcaaggatgccaaacccactgggccatgtgtcagctcatgaatagtttgcaagaagctactataattctcacaaactagtatcctgtgatgctaagtgaaattcattacaatcaggtcacctataaaacacttttcttctaaatgtatgtgtggtttactgtacgataatatgaaagagtcaaactaaaaccacacctggtaataatctgtgaatacagcaactttggctttttcttcaatcatcctctgccgaggtatttatccagtttcattctccatttcatgcatttaacaatgagacaataatatagccttatccaccctgtatcataggtcatcaaatcctctgtctttcctagccaccacaaccacaaattcaacaaccaataatatgcctatgtccttagtaacactgttttccttaaaaagaattccaccaccatcctgctaaaagatccccaacccagttcacaaaggttgtgtcactgtgcttcatcaccctgatgacaataaggttgaaatctcctcttataaaccccttgtcttgaggcataactcaattgatcctatgaggaacagggatatactctttgaatagactgtaaacccaatcacagaaagtgtcttcctctccaaagaaactagtttgacctaaaaacccaaagcccacatagatagacctaccatgttctgttagaaaaataaattcaacggaagtgttctaagattgccagatgcacaggataagacatcacttaaaaaacaaaggatccatcattgcctgagatctcactttaaaggtagaattgcctttacttgagtctgctttccttagctaatccaaagtagccaaggtataaaattgaaccatataaatcatatgtgttaaaatcatcaataactgtcaacttcatgtggctcagcctaattccatgcttcattcattaattcaattctttcaaaaatcctttattaagtgctttccattcctaggtctctatcctcggtgtgcataaatctacataagtagagttttcaacacagttaaggaaaaaaccacttctggctatgagatctgaagttatccttcctctgtaaacaactaagaagcagaacaaaatacaggaaataactattttcagacattggacaacaggcaacagagaactgtgatcccagacagaaaggaaatagagtgctatgactgcccaggttctttgcctaaaggcaatttctgaactgctgagcaaggaggggaaacccaaactgcaatctcactgagtggaggaaacaaagatgagattcaggaggatttaggtggctttaatttacatgccagaatacccgaaaaaactggagctgatacagagaaagagttctagaaatcagcatagaagaactctagaatctatgtctgattatcaatatgcacttgtagagtgtgaaacaccctaaggtacggcaaataatgacttctgaggaaagaaaatgtactgaggagttataagccaaacaattcttagagctcataaaaggccaggaatagtttgagtttccaccagtgagaatacaaagtcctcatgggatacatgtagcagccaatgaagaccacagaagggccaacctaaaaagtgagtttaaattacctctagtataaagacgactccagctatgcccttaaaatctctttttaaaagattcaaacagataaatcttgtctgccacatgctccaaatgaaaacaactagatataagaagaagcagaaaaatatggaccaaaaccaaaaaaaaaaattagtcaatagaaacatagatgaaaaatatatctgagatgaaaatatcactagatggaatcaatagcagattagaagcttcaggagaaaagattcgtgaattcaaagacagcagtagaaattaggcaaaatgaagcatagagaaaaattactaaaaaaaaatttacagagctcagcgatctgtgaaagaacattaagaactttaacacaagtaaaactggagttccaaaaggagaaagaagtgaatagaaacaaatttttaagaaataatggttgaaaatattccataattgaaaactgtaaatgcacaaagaggctcagcaaacctcaaccaagaaaaatacaaaaacgtaaaaaaaacacacacacaaaacactacagaacaatataaccacattgcttaaaggcagtaaaaagagaaaatctttaaaaaacagcctgaggaaagaaaacacattaaatacagagaaacgaagataaaaataccacagatctttcttacttcagaaactatgcaacctctgttttcacttatttgtgggatctaagagtaaaaacaattgaattcagaagaatggttaccagaggctgggaagggtagttgggggaagaggggaaggtaggggatggttaatgggtacaaaaaacggtaagaatgagtaagacctagtatttgatatcacaacagggtgactatactcaataataatttaaattgtacacttaaaaataactaaaagtatatgactggattgtttgtaacacaaaggataaatgctagaggggacggatactccattttccatgatgtgatcattacatattgcatgcctgtatcaaaacatctcatgtatcccataaatatgcatacctactatgaacccataaaaattaaaaatttaaaaaaaagaaactatgcaagccagaggacaaaagaacagcatcttaaagtactgaaagaagaaataaatgtcctcagacaacgaaagcaaaaatagacaaagggaatacatcaagcctaaaatctttggttcatcaaaagacacagtcaacagattgaaaaggcaacctatggaataggaaaaatatttgcaaatcaggtatctgataaggagttaatatccggaatacataaagaactcctgcatccttcaaaagtgaaaaaagaacaaaattaaatatttagaaaattaaaatagaaagaattattacagctcaacagcaaaaaaaaaaatcaataacccaattaaaaatgggcaaaggacttgagtagacatttatctgaagataacacacaaatggcaaaccaagcatatggaaaaatattcaccatcactgatcagcagagaaatgctaatcaaaaccgcaatgaggtatcatctcaaagccattaggatggctactatgaaaacaaaaacaagaaaacaaaataacaaatgttggcaggaaagtgaagaagttggaacctttgtgcactactggtaggattatttaatggtgcaatagctttggaacagtatggcagttcctcagaaaattaaaaatagaactaccatatggtccagcaatcccatttctgggtatatctacacaagaattgaaagcagggcctcaaagagatatttgcatacacatgttcataacaacactatgcaataaccaaaaggaagaagcaacccaagtgtctgttgacagatgagtaaatgaataaaatgtgacatatacataaaatgaaatactaggcagcctttaaaagggaggaagttttatcacatattgcaacatgcatgaacctggagaatattatgctaagtgaaataagtaaaccacaaaatgacaaacactgcatgattctacttatatgaagtttataaagtaatcaaattcatagaaataaaaaataaaatggtggttaccagaggctacagggagcataaagagggaagttgtttaatgagtacagagcttcagttctgcaagataaaaaggttctggaaatctgttttacaataatgtaaatatacttaaaactattacactgtacacttaaaaatgaattgtgtactttaaaaaggttaagatggtaaagtttatgatgtatggtctttataataaaacagaataaataccaatctataattctatacctagtgaaaatattttttagaaatgaaggcaaaatgaaggttttttagagaaacatgaaaactaagaaaattcaacacctaacctgcattgtaagaaacattaaaggatgttcttcaggcagaaggaaaattgtaccacatggaaattttaatccacacaaaggaataaagagtgacagaaatagtaaatatattggtaattaaaactcttttttctcactttttaatttatttaaagataattgactaaacataaacagtaagtatatgtagaatctttaatatacgcagagattaaatgtatgacaatagcatcaaggatggaagaggaaaatgaaagtacattgttaaagatttatacattatatatgaagctgtatgatattatttgaaagttgactgtggtgagttgtaagtatgcatattttaaggcctagaataatttccaaaaatataaaacaaagaggtatagctaataagccagcagtgaagataaaactaaatcctgaaaagtgctcagttaatccaaaagaaggcagagagaaaggaaaatgagcaaatggtgcaaataaaaatcaaataccataatactatgtttaaaaccaatcatgccaccatttacattaaatataaataatctaagcactccaattaaaaggcagagattgtcagcccagataaaaaagtgaaattcagctggacgtggtggttcacgcctataatcccagcactgtgggaggccaaggcaggtggatcacctgaggtcgggagttcgagaccagcctgaccaacatggagaaaccccatctctactaaaattacaaaattagccgagtgtggtggcacatgcctgtaatcccagctactcaggaggctgagacaggagaattgcttgaactcagaaggcggaggttgtggatgagctaagatcgcgccattgcactccagcctgggcaacaaaagcgaaactccgtcttaaaaacaaaaacaaaaacaaaaaagcacaattcaactatatggtaccaagaaactcctctaaaatataataatacagatggtataaaataaaaggagggtaacagagctaccatgcacagctatgcatgagacagctgcaatttctgtattaatattagaatggctgtaactgccaatattagccaagtatcaccaaggcttttgcctcattctgttctattaatgtgatgcctgcttctactcacattgctgctattcggcctggcccaagcgctaaggttccaccctgaactccctaggccctagtggacttcactcagatccagacctcattccactgcagggtcctgtgaggccactctgcccctgtcatagccacatgtcttcttggttaaaatcagaaccagccccatgtaagtcaaattctccatctgttcccaaaccaacctttcttctccagcccaagttattgaactctaggtcaaaacccatgtggctttattccaagtagcatctgagtgctgccatgctgcataaaagcaggctgcagcaggaattagtttctgcttccaccacatggaaagatggaagggctccatcttttgcccgacattgctcaatttctccacacaggaaaattgacaccagtatcatcttttggaatgaacattctttaaaactaagcgtttaccttcttgtgtccatagtagggagcatgatttacttgtactatatagaactttgcattttttacaacagttacagacatttgtatcttttctggtgtcctctgagattaagagtaacaggcagtagagtcagactgccagggtttaagtactacttaaccttatcactatcactgactagctatgtagactttggctagttactcaaactaagtttaagctacttgtagagtagtgcgtgaatagactttcaattaaagtagagatatgcgcctgtaatctcagcactttgggaggccaaagtgagtggaccacgtcaggtcaggagttcaagaccagcctggccaaccactaaaactacaaaaattagccgggcgtggtggcacgtgcctgtaatcccagctacttgggaggctgaggtaggagaatcacttgaactcaggaggcaggggttgcagtgagctcagatcatgccattgcactctagcctggacaagaagagtgaaattctatctcaaaaataatactaagtagaaatatgaaactcagaagtattatacaaggtacctgaagtcacctaaagaagggtagatcgtggattacaattctaagatttttcatgtattttggcatcacttctcaccaactccactgctactactctagcatcatctcttgcaaagcatattagacagcttttaaagtggcttgcaatgactcccatctcctggtattcacatccttgtgcaattccttccccttgagtgtgtgctgaacttaatgatttgtttctaacaagtagaatatggcaaagctaaggggatatcacttctgagtgggctttgaaagactgtggcccccatcttatgcatgctttctctttccctggctcttactgcttgctcacttgcttgctctcctgaaataagcttccatgttgtaagttgccttacaatgtccctaagaggtacatttggccagaaagtgagggtggtctccaattaatatctagaaaaaaaaccaaagccctcagtctaacaacccacgaggaactggcttccacacgagtaagcataaaagtgaatattgccctaattaagccttgagacaactacagccttggctgacaccttgattgccacttacaagagacgctgcaccagatcacccaattaaaccttgcccaaattcttgactcacaaaccgtgagataataaatgttcgttgtctgaacatgtgttgaaaagtttgggggtaacttgttacacagcgctagataactaatgcgtgaaaattatagcaatagccttctaatgtttccttacttctactattacctttccagagtacagagacttatgcttttaaacaagtctgataaagtcatctttcagctcaaaaccctgcaatgagtccctccttttcagagtaaaggtaaaaatccttacaagacctaaaagatcctaagactcccctttgctgtgacttcaaatctcactactcacttgcttgcacccccaccccacaggtttctttactgttcctcacatgtgccgggtgtgttcacacattggcttttgcattggctttcccctttctctgaaatcctctttccccggatatccatacatctaactcccttgcctgtttcaattgtttaatcaccctgttatcttctcaatgagttctaacctgaccatcatattataaattgcctatatcttctctttccccattctacttttctttatccacggcatgtatcatcttctaatttgatatatattttacttatttattatgctattgttaatagtctttcctccaaaaataatgtagtctccaagaggagagagaactttgccttttttcttctgtattagaagataactaaattaactaccccgctctcagtaataatctagaaggagttttttcccatacaaagatgattataacccacttttagcatgtaaaaatacttaacatggacttaatacattatttgttatcattactctttatttaaagtcacagttttcaagattttcaaagtgctgatgagattttatagtgccaagacaggggttacagtgatcaccaagcaaaggcaaatcatgcctgctgtgaccatcttcgcaaggaccttctatcaagacaccaaaactttagaagcaaaaataggaaaattaacttaaaaaacaaaaacgctgatataaactaaaagcatgaatggcatttccttattcaacatattaaacaaagtaaaagcttccaaactctcatataagaatacatgataagaaatatttggctgccaaatgagttttatactattacatacctcctttgttctatggaagtatgaaatagacctgaggcatcctttatatttatcagaacttgattagtaagcagcaattctatttctttgttcagtttttatgggcttatatcatactttgatcctaaaacaaattccctagtaagagaagcaggattcagcttgtcaggtgcccacaaataaaggccttttttatttccttcttagttgaaaggctttccctcaactgtggttagcaacctcattcccaaggcagcctttgtgtccaagtaggagttgtgtatgttacctccaagcatgcaaagtgcaacgatcccccactgtctgtgttaatgggctgcaaagcttaacagtcccagatgaagcaacatttttgcgtttttacacttgaaacttggccttgtaatgcacctccatctcctgcctgccctttccctcctacccaggtgcacaagcctgtgtgtgcacacacacccacatacacctacacacacacactgaagtattcttttccaaagctgcccttgaactctcttacaattttctagctgtatgacaagagagaacaaaatacattgaatgtcttatacttaatttttaaaagctgatccaaatgctgtctgggcccagccacagtcattgaacacacgcacagacacacacacacacacacacacacacacacacacacacacatcacagagcatttttagtttgacaagagaaggggacgtcaaaggcttgtccccagagacagctatttataaaagacatcaaattaatgtaacatgagtcaatggagtccacacgtttcttggactaaacaacttgtgggggcctgtgatgagatccaggacactgacggctgagcaggggatggctccgccaacaccactgactcagctgcacatcaaagggatttgttgcttggatgtatgggcagatctgccctggaggcttctcccagagctgtcctctttgaatccagagcagcccctgcccccagcagtgcacatgtaggtgagggaagggtggaaaaaaggcgaagggggaagcacaggcatgatggagagagcagcctccacattatccttgagaacaggtcccacccggctgctcagtcccaagaacttgccttggccttttctttgtccttcatggccactaccccttctaccaggaacattacccttcaggctgaactttcaactattccaaaaatatttattgggagctttgtgtgtgtttgcgggttgggggcacagaaggaaacaagacagcccaggttcctgttcccatggagcaatctcacaacttggcagttagctgcaaatgcaggaaccacttggcttaggtttgaatcatgcctctcccgcattccaatcgtgtgacttttgggaaatttgcttaatttttctaagcttcacttttgcatttgtaaaatggagataagaatatgacatctccaaagagctatggtgaggatcaagtaatataaatgtcaagtgcttcagaacattgtcaggcacatagtaaatatttagtaaatgttagtgattgtcaactattaaattgtcaccatctgccagtcactgtgtaaggcactgggtgtggagagaataaaacacatggtccttgccattatgaaacttttattttgctgggggtgacagccaatagactaacaaccaggtgaatgtacagtaagtcagatgataactagtaatatggagaaaaataaaggaataatgaaaaagaaagaatcatgaaatgaacctacactgagaataaaagaagcgaaacaagattaaaacaaacaaagcacctactcttctctgacacaccagacccccaatctcaaatagcggaagagaagcaatctactttgtcccctttcttcatgcagaaaaaagaaaagttcttggaaaccgtctttactaaactctagaagttcctgagagtgggatacttgtccttatttattttctctgagattaccattattagtgccattcagcatctctaactataaatctacttggtatcctagcaatttcaagacactccagttttaaaagtaccacatggaatagtaaggcacttactattctagttcttttgaatccattcatgataaagggtctaaaagaaactaggatcaatgactgtcatctgcacggcacagcaacatactcttgaaaagacgtgagagcataacattgccctgactttgcaagaaacagcacaaagaatgtactcaaggtgatgaggaaaagcagtggcaaggtagtatatagtatatctcattgctgttatcaatataatcttcagccagcatctttaagtggcttctaaaattgaattaattattcagtggaagcctcggaggcagcaagaactcacctttcagagttttatttaccctcatcacctgctgtttgctctgggtttatttaaaatcgtaatcatgtctcctgtgatggaggatttgggttactttgtggtcacatgtggaaaatattatatatccacatcaaatgtaaatgtggtctctcttagtagaaatccatgtcgtttctctggaattagaccatgttgaccctgtgggcatatgagatttaagtctacagggagtcctaaagaaaaaaaacgtccttgaagcatccaggagagaacagttcctcagtcctttcatagcactttgtaattaccgctcatcaccataaacagacaaacaaacaaacaaaaacttaaagaacaaaagaatgtactgatttgcaacattatcttggtccaaaggggttgttttgcattatgcatgcaagaacaatgaggaaatcctccacacctgttaaaaaacgacagccctacaaccaagagccctacagttccttttgcgtctatgggggaggagcaaaaaggactcattcctaaacccagggcaggcttcagggcgtgtgaccagtggagtcgcacagggcccttcctcaaaagggccctgcactaggttattaagactcgtcaatcactgtcttgaatttcttagtaagttcagcttggaagttatatagaagattcggagtcccagctcacatgcagtcccttctctggcacctccatacccctccgagatgggttctcagtcagcttcctcggcccctgacaacctgaacttgatccagtttccccctcctggctccctgcccagcccctgctgccgccctccaatggggcccactgagtcaagtgcaccgacagagaggcccgcattccgggaggtgcctgcgcagggaggagccaggtcggacgcacccatggtccccaactctccccaacacgtgtctcaaggaaagacatggccttggcggcaccgccgtgggttgggcaaatgactctgctagcggcagcctcttgcctactctgatcctgctaccaagtgcagtctatttaggcgttgccatgaccggggattgaggttgtggactgtgagaaactgggattgaccaccgcccacagagccggtgggaagcggacctcagtagcctgtgctctgcccacatgccccgctgcctgggaaggctaaaagaacgcaacattaagtatcaaattaaaaataccgtgatcagtcgagagagagacagggtagcaagttttatattttattacctttaaggccacttttctcttgtttttttgaaaaaaaggcccccacattttcattttgccctgggccctgcagagtatataccctgccttccctagaccaaggctgtgccaggcaacacgtagaccaaagaggctagaacttgagctcttgagtcagactgcctaggcacatacctgaaatgcatcttgtgtaacgtgggaaaatgcatttaacatctctgcttcagtttccccttctacaaaatggggataatgtcttagagtgcctttgtgaggattatgccatttataacatgaaatacttagtatctgaaatatagtaaggcttcaataaaggttagcaattattatatattaaatattatatatggtatctgcatagattccataatacaattccaaataaaattatttccctttacagatgaaaaaactaaggcatagtggaaagcagctttacctaatcctaaatagcaaagcaaagactttaaagcagtctcttctaattcaagggtatctatgtcctcccactaattatgcagcctgcagctttgtacgatacacagttatgaaacaccttgaaatcatgtgcacaatattgaaactgatctctgcagaagcgtgctcttaagctcaagatggctacaatacccaggacagtgttgatgctcaaataatgtttgacgaaaatgagtggaggatgaacaaatgcctctaaagtggcatttcttttttccccacacttttatgaccaaatggcagaggagagtaaactcttaaggggcatgggtgagggctggagcagtgcttgttgaggtaggaactggatgcatagctgtaagattaccatttctttatttaatgtttcatttaaactgaaataattgtgcgtgcttggcattctactgaagaagttatatttttaaggaaaatagtaggggggtgttctatttttttcttttcttttttttttttttttgagacagagtctcactttgtcgcccaggctggagtgcagtggggcaatctcggctcactgcaacctccgcctcctgggttcaaatgattctcctgcctcaacctcccaagcagctgagattacaggtgcccaccaccacacccagctaatttttagatttttagtgcagatggggtttcaccatgttgcccaggctggtctcaaactcctgatctcagttgatccttcctcctcagcctcccagagttctgggattacaggcatgagacaccacacttggctgatattctcaaaatatttaagtaaatgcatttcccatgaaaatatgccatatttaaaacttgggataacaattatttttatggatccctttccacaaaccacagccaggaaaaccacatgttgcttatatttccccagctgtcacaacctggttcaggtgaaatccagcagcagaaaattctaaagtttcctcaaacatttttcagttaaatagaagaagtccaaagaagtagcagtgattgaaacaataaaggaaaaaatataataacatatcagttcttgaagagattttagctccagccaggcgcagtggctcacgactgtaatcccagcactttgggaggccgagacaggtggatcacgaggtcaagagttcaagaccagcctggccaacatggtgaaagcccatctttactaaaaatacaaaaattagctgggcagggtggtgtgtgcctgtaatcctggctactcaggaggttgaggcaggagaattgcttcaactgggacctgggaggcaaaggttgcagtgagctgaaatcgcaccactgcactccagtctggtctacagagcgagactccatctcaaataaataaataaataatttttaaaaaaagagattttagctgcatatttcgccaagcttggtgtcccagacacctgcgctggaggtagggagaggggccacatggaaggatatttgtcaaaaattcggattcgtggcttccaccacagacatattgaatcttaaaatatgaggagaggtctctgaatctgcatttgtaccagctgtctagttgcccctcacactaatgtagcagggggcgccattcctccatgaggtttctatcatttggagcatcaagtctcaaaaactcagtatttatgggagtcaaactgaagttcttagtaaaaatccagactctctgagcaagaagccccccagaaatttggattcagtaagtctgaaatctgcactgtagcaagcagctcaccacctttcccaccccgctatccttctgatgcaagtggcgctaagaccatatcttgagaaatactaacataaaatataaagccccaaattattaacttttagtattttagaacatccataattaaacttcaaacttttaaaatccaacacatgttttttgaagagattctatgtgctagggtcagggaaaggaagatgaatttgcccttttctaaagggaatcagagttgaagaaagagaaatagccaggtaagcaatagctgccatacactttaattgggtggtacatgtgcatgaccccttaaagtgctgattaacattgttgattgtataccttgaatctacaacatatatagtaaaacaactcatagttcttacaataagagcagtcaccatgtattgagctcctggtgtgtgctaactgctgagacagagatatttttcaaacaataactacccaatccaacaaacctgcatagttttcagatcctctttttacatattaagaaactggctcaaaggacttcagtaatatctcagtgcaagatttcaaagtgagtaaaaagctggggtggattgcaaacctaggtctgttctaccctaaaaactgtcttccttcttgagttcatgtcctttgcagggccatggatgaagctggaaaccatcattctcagcaaactatcacaaggacagaagaccaaacaccgcatgttctcactctgaggtgggaattgaacaatcagaacacttgcacacagggtggggaacatcacacacgggggcctgttggggagtaggggactggggcagtgatagcattaggagaaatacctaatgtaaatgacaagttgatgggtgcagcaaaccatggcacacatataactatgtaacaaacctgcacgttgcgcacatgcaccctagaacttaaactataataataaaaaaaaaaaatgtcttccttgtaagagaagctgcctccttaaatttacacattttggaagtttataatgtattttaaattacagtattctaattaattttcacggcaatggtaacaattattttttattcctatcttgctgataagaaaactgatttctgagaagtcaaggaacatgcccatgaaacatgaaaaatcaaacttgaaaccaagactctatgaaaactgatgatatcttcataacactatatatattgatcagtttaagttatgcttgatggaaaacaacaaacaaaaaaataaccccacaatctcagtgttgatgacaacaaaggtatatttcttgttcatattaatgtctgttgcagacgggtttcagttgaacttcatatctttggcattccagggtagttctttttctgggaagtgagtctgcccttgcagcaaaggaaaaagcaatgatggaaccatgcaatagctctgaacgcttccatttgggagtgacgtatgtcacttcttttacttttaaatagacaaagcaagtcacatggccaggctgctattcagaagctactgagaaatgacactgctttcctgagcgaacagatttgacatacctctgcacttctaccactgaaatcttgtctgagctgggaggcagcatcattctctgacatcagcaggaacaccaactataacgtttcatggcattctgacacaagaaatcaaagacacaggggaagagaggtagagaaacatttctttggagcctcaagagtgataatcacaagagaatatgttcagatttgggggttgccctctgcctgagacagaggtactcataggctctttgataactatgtttgtgtatgtatttgtgagacccaacaaaaccttggtaacaattattgcataaatcagcacctttccaattctaaaatgtgaagtcagttgtgaagtatgttgtgagtaattcattactaataataatgttactactactaataacactactaataactaaagtttttaaataattgacatttgtaaacaaatgaggataaatttaaggacaacctttacattctagcctgcttatttccttactcacatgctaatgttttcttaaataggagagaaagtgttggggctatagctactttctaaagaattgtgtttaaccaaccattattacacccctgagtgtgtgtcacaaacgtgaacttcaatttacatgtgtgttgtggccaaaaacaggttgaaaactacttatctaaaccacaatcccatttatcacttctatatcatagcaagtagctccatgtctgttctcactagccagacagtaagcatcccaagaacaagaaccatatttccccgtttccttgtattgatcacagttgaatctgatactactagaaggaatcattattggcagaggtagggaatctgtttattcctcttaagggccactgacccatggaggaggaaaatctaatgataagcatatagcaatataactttttattgaaacatggtgtcttagtccatttagtgttagtataaagaaataattgagggtgggtaatttataaggaaaaggggtttgtttggctcacccttctgcaggctgtgctagatgcctggtaccagcatctgcttctgatgatggcctatggctgcttccactcacagcagaaggtgaagcagggtcagtgtgtgtagagacacatggcgagagaggtagcaagagagacaggggtggtgccaggctctttttaacaaccagctcccatgagattgaggtcagtgagaactctattcccacaaggactgcactaaaccattcatgagggctctgcctccatgacccaagcacctcctattagtccccacctccaacattggggataagtttcatcatgggatttgggaggacagacatccaaactacagcacatggagaaaaaaagagcattttatctacaaattttttaagttatcaacagagctaaatgatacgatgagaattttcccttcatctcatcgagatcaaccaacaaaatatttttgaataattatggtagagattacagactgccaaaaaaaaaaaaagaactagcattagtgcacttgtccaagccagaaaaaattaagttgtggacagtatctaatgattagctttttctcacaccttgatctgaaccggggaatgggcagtgagtaccccaacagttatatttgcaatcagagattctgaagagtcaagcaacaaaagactcccaccctgccaagtacaggcccagagctgagacttcaaaaatggaaaagaggaattatttgttcaatgaccagaatacatttcacttaccttaatttcaactcaagtctttttgggctatccagatacaaaaagtcaactgatacagaaaaagggaaagcatacattggatatcccgttcccaacttaaaacattaaactgtaagaaatctgagttgacatttatgatgatagctgctcctgagcaagcaaggaaatagaaaggcttttattttctttaaaaaggcagacaagcttctgaggccctccccaaaacagaaacttgatgtgtattttttccctttgaagtcaataggaattaaatcttggagatacacaaggcagagaaatgccagtattctgaacattcagtaacaaccaagctgcagacggctttgcctgataacgtaaagaaaccaaataattcaaatatagacccatttccccatgacatggtcttctattttatttttaattttattatatgctaggcagattgactgcaagaaaggcgtgagtcaaatacaacaacaactttcttttaaaaaatgatagctcaaatgttgaatccttcctaaaggctttaccaatggtagcacatctagcaaatgaaaatatatgtacaattgaaaaagatttacaatggctgggggaggggatgctatttaattctttcaaggaagccatttttacatagatcttttcaagtatggttaaggcccaaaatttatgatagacttccacttgaaagaagggaaaaacactgggtgccttattagatgcctacgttgaatgaagtacctatttatttgaataaggaaatggcccctctcttctccattagtttatatcttcctatttcccctctctgtttggctgaagctgaagctaagccctgatttacaccagttcttaaaaaaaaaaatcctgtgaccctttccacaaatcctaactagaagtgatggcttagcctgcatagaatggctccagctaataaactcctctctccagccagattcctcactgtgacgttgaactcatatctcccacacaaggttgaggatgtgtgggagagacacaggcagtgaaacagctaaagtcagaaccacagtgtagagtaagaagtctttgggtctaaccaaagcactgagcttctcaaagacttcttattcttttatttatttatttatttttcgcaatgccaccttggcatgcaaaacattaaactgtaagaaaccttggcattgcaaaaaaaaaaaaaagaataagaagtctttgggaagctcagtgctttggaggtgaagatcacagctgtcatacgggcctttacagtgacaggtactttacatacacgaggctgtataatcctgtcagctcacctaggaggcctctgttttagggttgaagaaactgaggcctagagagtttgaataagttgcccatattagcatttttaaagctagatctgtttaaattcaaattccccgttttaaccactcattttgcccaaggtgctattagaaggttatctctgaaagaataaataagacattgataatagcagttccttgaggatgggggtggagggatacaagaaccagaaatctaaggagacggaaaaggagacatatttttcactgtacacccctttgtacatttttatttttttaccttgcattgttgatcttcattattcatggatttcctgtttgcagatttgtctaccagctataatttatgtgtaaccccaaaatcaatactagcatgccttcaccgtcattcacagacattcatacattggcagaaattttggattgccccaacaagcacattcccagctgaggtggaacccggaaaagctctgccttcggcttcagttctcatacagagatgagtcgagggtggtgacagcaaggaactgatctgggcagtgctggaaactccagctctgggctggttggatggggttgagtcccagtctggcacctattagtggggtggcctcagacaagtcacttaacacttctgatgcttgttttctcttttgaaaaagtaaagaaaatagaatctactagcatgaattgggttcgggatttatattataatctatgtatatatgtgtacatatttccctgggagaaatagttctgtattcactaattcagtgttcacagcaactctgtagagcataactaccatggataatgagaatcgacttcatatgcatttttaatactgtgtctgagggagtacgtatatgtgtgtattatatatgtgatttttatgattatgtgagcacaatggttgggggggcttttaaaaaagggggtatatatccttaagtgttaaggatgaagtcaagaacatagtctaggttgtcaaccctaaatttgagacaaagagctcatatggactaaggaagacaggaaaaggtgccagttgaccatgtggacaaggcacgttaatagatctaaacacattaatagaagtaatctcatcctttagatagtctaggaattaatactcagtgaggattcagagatagttctgagattggaagtgaactatagaggccctgaagggcaaaacataaatactcttagccaaggtatctttcaagcgaaagtatgcttgcagctgctgaaccatgagtctatccaagaaggaggacaagcaatggcagaagagctccaggtgtcatcaagtgggaagctgtggaggtgctgcagcagcagatattgggagcccagctgcgggaaagctgggggctcaggaagctaagacgaggccaatgggtcatgctagagtccatagctgaaatcaagtgctgaatgggtcccatgacccaaaaaaggttaagaattttacctaaaaaaatgtataaaatatttgattttttttataattccatcaccactcttagcagttttctttttaaggcaatgttttgaaaagaaacagaaaatccttgcaaacgtccaactgcaaggaatatgtggccccagcagctgtgctctaagatccattgccatgtttgtgccgaggttgggcttcccattggctgctttgcatggggcagggatgcggaggcaggctctttattgggggacagaagactgtgctgaccatgactctggcttgaggacccatggcctttccgaaccttccttagactgcacagtggcctagggcactttcacacaaccctccctccctctttccttgtctatgttgcaactgcatcccagtcccgtggcctcaccctgctcactctccatttcctctcacaaggctgttcccctaataaaatccttacatgtttattcatgtcttttcatctgcttctcagatgacctgcactaacaaaagaaccaaacttcgaatgcttcataaaagttgccgagctgtgaacaacaattaaaaaaaaaaaaaaaaacagagaacttggaaaccacactgtgtgctctgccgtcacttgttcactgcccctccgtttccaaactcaaagccacaggatgtagattcaaggcttctaaatcaagattataggttactgtacatctcagactgtatacttaatttgaaacctttaacaatctcatgtaagtgaatttgaaatctcctcatgttatgagatccattccactgagcatctaaagtactctgggcatctaaaaccacattgtagtctagagaggccagggccctcatgcctccaggccattctacgtgcctttcctggatgcccttccctgccatttcttcctagtgaatttctacttgttcttcaaaacaaagctcaaagttcaccttatctaggagaccctctctcattcccccagctaaattaccttcttgtctcctgtgcttctttagggatttgtacctaactttactgaaatacctatcaagtagagttttttttcaggtgccggtaatttaataagtaactagaagtgcctgaagcaagaggagattattatcactactacctcacagaacaagaattctggagaaagttggtagcacggttagttcagttctacattgttatcaaggacgatctcctttctatctgtccatcaaccatccccaacgagttagaaaattgctcctcaagctccaaccaccatcacctcaaaaccactctcaaaagcaggaagagaaggagcgatatcctacccacttgtctccatttttgattagtggaaaggatttcctttccaggtatgcttttccagaagagtctaacttttgtctcactggccaggaagaaggccacatggccattccagccaatcatggtaaaggggaacaggattacctaagtggctttaaccaatcataatgcatccctgaataatgaggcctaccttctttgggcatcttgctgctttatttatttatttatttttaaatcagggcccagttagccaggaagacagaaagagtgactgttgaacagagaaccaatggtgtctgcctcatccctgacttggaattgccaggttactgcctctctttgccaccacagctctacagttcttggagggcaggagccttgtcttattcatctttacatcatccataactggcccgtagtagcattcagtatgagttttaacatttgaaacattcatttgtctgaatacaaacaaatacagtaaacatggaaaactactaaaatgcttaaaaatatgcttacaaaataaaacattagatagattctgcaacgcctcccatgaaagattaataggaatgctatcttgattgtagacagtatgagagtcggttgaagaggataattaaccaaggtgaaataacaacaaaaacattctgactcaatagcctatagtcaaaatcccatacccactggctttctgatgtgtgcttcaaatacagtgttagtgcctcactatttaaatagtgaccatggaatacatggtgcaccaaagagatgcttacactagtgaaaacgaacactaatgaaattttactggaggccacagacaaccacaattattgattttacatgagatctactacttattaaagccttttgcaattcttggacttcagaggttatcaagaaacagactaaatctctctgaattgggtcctttcaacaattctgattacactcacctgatatttcattttaaatttcatgtttataaacacattcccctctcattctaagaccagaggtcagacattaattgctctccaaggatggctttgcccaatttgggaacgggccagattgttgtgttagaaattttcctcagtcaacaacctttttgaaaagaccaattcatagaaggcgtggatacatttagagaaaaacagctctctaaaggatgtaagaagggtataaaaatcactataaactcaactatgtgtgtaagaacatttgcaactgtacattttccgtaaaataatttaattttattataagctcccattgggccatgcaggtagaaaatttaactcagtcattaaggttccctgtccaccaataccaacatgggtctgtggcgtgcttccaagattctatgcaggtccaagatatcttgagggtagaagaggccctctggttacacatcatctatccacacattttctcacgtctacagattgctgtgaggccatttttccactgatgtgggaaattattttctcatctctacccctttctcccagcctagagaaatctttctttccttgggaagtaactattgtagttaaacataaaggataactctaaagaaataaggttgctttctgtataattcacacatcattctacacatttaaaaaaaaaatttaccagaacatgaaattgtttctaatgctataaaaagggaacaaggcatcgaggttatgaacacgaactgtgagccagtctgcctgggtttgatatatgaccttgggaaatttattttacctcactttcttcatctgtaaaatagagacaatgcaactatttcaaaggagctgtcacgaggtttatatgagataaacatataaagtattcaaaacagtacttagcatttaataagtattgtaactattgccatttttatttctataataatattgaaaattaaaatataaaaatgtatacaggctgagcatccctagtccaaaactccaaaatgctcacaaatccaaaactttctaagtaccaacatgacaacataagtggaaaaatttacaccaaacctcatgtgatgggtctcagtcaaaatgcaggcaaaactttgcacaaaattatttaaaatattgtacaaaattacactcaggctatgtatataaagtgtttatgaaacataaatgagttttgtgtttagatttggactccatccccaagacgtctcattatgtacatgcaaatatttcaacatccaaaaacttttgaaatccaaaacactctgttcccaagcatttcagataaagaatactaagtctgtattttacatttttttgtacattcagtaaaggacctattatgaatcatatgctgaggcttccatgataaataagttgggaatggattagctagacatgtcaagatgcttgggatagttaagccctttgaaagaggtaacacaggatgcagtgaaacaagggtcatttaactatcttagaggatgagactgggtttttcaggcgaagaacagaggaagtctctctcaagaagagtagcagcgtgtaaactctggaagtaaaaagaaatacggcttatttgaaaaattgctaagcataactaggagatcaaggcaatagtcttgctttagagagaaataaagttcaagacagaagtaagggccaaatcatcaaagccctgtgtgcgcagtggtgtttgcacttcatcttgaaagctcgggggagctatcaaagagcaatgttgaggatcagatgaatgcaacaggcatatgactatggaaaacagaagaattgaaaggataaggctgggtatgggaacgattctctggagtccatggcagttatcctggtgggaaaaataaaacaactgaaggatggattaaagtatagtagtggtaatggagctaaagaaaagaggaaagcctcaagagagattaaggtcaaaaacatgataagtcttatgactttggggcatgggagtgaagaagggattcataaacacccaacatcctaggctgagcaactaagtggaaggtagacagagaagcaaatctggagaaagtcctctgcctagaacctctccctgcagagagcccgtgactctcttatttaccttgctacagtctgggctccaggccacctctctgagagggcttccttgactctcccacctaaaatgcaaataccgtcatcctccattaccttgattaattagtggtatttttcttcaatgcattcatctgttcctgacaacatactgtattgttttctgctcatctcgcccatcagaacacaagttccatgtaggtaggaacagtgtatttctcatttgctccagagtgaatctccagagatgtatatgcctgggacagagtagctgctcagtaaatattaattgtgtgagtgagcgatgagttcagtgcaggacatgttgaattttaggtttctgcagcacctacggtaggacttactgagatgctgagtaagcagtgaaaatgcaggtctgatgctcggaaggaaagcggggctacatccatcagtgccgcatgcatcagcccagtgatgaggatagccgggatgagggggctgtgggtgatatcctccccaggggagtggaaaagagaagccaaggatgaattcctgagatcttctacatttaatggagaagaataagagtctgaaaagcatctggggcagttaaagaaaacccaggaggtagcgataccatgaaagccgagaaaacagtttcaaggaaaaggtttgattaacaacagggccaaaaccacagaagagtcaagagaaagatgtcctgttaaacacatatatatatatatagttttctctctctctctgtctccctccctctcttcccccagcaaaatacctaatgcaagaagtcaagattggagaaccaaagcatttttcttctgatctttaaccacaatcccacattatccatcatttctttaactgtaaatttctattatagcttcttatcacagtttctagcccatagattactgtattttacaaatatatatatttagaagcatatatatatgtagagagagagagagaagcagccttacaaaattaattctaattattttcaaaatcaaaagtcatttcagttctaggtcagagctcccaggatcgcctatgaaaagttctgaaggaaaaacctggataacatttctctttccacaagtctcgcaaggacattcagaccatctgattcataactcccaggagatcaggctgatccagcacttgtccttgtaaaagccgaaaccctttccttgggatgcagcagccttatcacatgacctcggctggcctagcagagcaggtgggtgtgacataataaaatgcattatgaaggccaccctaggaactttgggaagggactggacttgcctcaaaaagtatgcacatccagttggggcgcaggagggaggaggggcctgagagggtaaataaagccagagctgctaggagctgaattccctttccagcagcatcctgaagtctttgtttcagaataaactggtgacaaggagaaaggagaggaggggagggacaagctggtgtcctttggcccattacgtgcctttaggtttccagtggttctcaggcttgctactcattggaattacctggggagctttgaaaaccctggtatccagggacaggacccagacattagtatgtttttaagctttccaggtgatcccaatgtgcaaccaaatttagaactttaatacaactgcctagcctaggatcactcctggaatgtcctgggagggcattctccagacccggttatcacggacccctggagagggtcaatggtcatcacagagtgcagggaaattccctgaccttgtctcgttaagcagtgcaagcagcagcagtttcacagggcacatgacccccatggcagccaaaaagggaattagccacttcagcggagacgttgcttaaggcaaaggaatttccccttgtgctcctcatttgcccaaacagaacacacggtttactcatccattctgaagaaagattttgagttctcaaggatgtagtcattgttctataaagccttacaatttaaagtgtgagcccaaaacaggagttttgtcatctttgggaagcttggtgtgaattcagaatctctggttctaccctagacctgcccaaaactgtgtaaatactgctggactggatggaacacaggatgtattagaatatttttcctgtatttaaatgtacacaagaaaggaagacatgctcatggattgacacatcttgagaaagacttgggagaaaaagacaaaacaaatgtgtcaaaaagagagaatgtaatacacaaccttgcttcatttgaaactgatttttgttgtttgtttttgtttcgttttgttttttacttaccaccaggaaatagctaaattgagtaagaacatcttaaaacttaagggagaaaaactgagtgatcaaccaaaacctcaagaggaaataattaagaatttctggggggaaaatagtgatagtctgtgaatgaggaccctaccgtattagcgcaataattaatgagcctaaaagacactggttaccatatgactttccctaagcctcaatttctttaggtgtaaaacaatacatttaaatgaataatcattgtggtctcttcttgctcaaaattttaccatttgaagatccttgacattgaatcaaatatccaaacccaaatgaaaataattgtgcacagttttaaggattattttaccactaggtggcaatgttgattaaaaaatgtgagaaaccaatgtaaacatcattttattgtattttgtggctgacctaaatctgttttccaaggttcgggacatcaaaaaattgaagaattgcactactatgcactcgagaccaagaactgaaacgtagatttggaaaatattcagtaaagggacaactggaaaggaaagaaaagcagctgcctgaggttgacagagacagtgaaacgcagcaggccaagcatagaagctcacgggatgaatgaccagggaggaaattcagtaaacctgggtagccaaaggattccagatgctggtaatgtccccaaggagattgctggcccttcatccatgcttggtaccttgagagggccctaggctaaacacatgccatgagctctgattgctggcaagcaaatctcatcacaatttttctaatttgttttatatctgattcctagctactatcttcaatgtctggctattcctatggatttctgattttgctgtgctctaggacatagcacttcggctgtccctaggaattcatgcttcaactgcaccgccttaccttgcttctacctcctggacctcacacaaacgaccctaactcaggcaatgtttgcacaccccctccagattccatgtctgctaaagcatcgcatcttgaaactccacagaaccacttcaagcaaagaattaccaatcgttagggctggaagaaatttagagatgtcatcataccattcccttttcattttcaaaataaagggaaagaaacagatataataattacttaatatttaataagttcttggctgaaggagatttattaactcttataacaaaagttccaatacaagcagctccagttaattcaatggttcagcaaccctatcagggcccaggttccctccactctctcaactttgctgtctgcagtggactgcctaagatgcctttgcatgccaagaaagctgtctcagctccaagcaccacatccggacacaccaaagtccaaaagaatgggtcattttccccttgtgcatctcttatttaaaaatgagaaaaagctttcacggaaacataccaacagatgtgccttcacaatttattgaccagaactgggtcacctgcccaatcctccacaagtcactgttgagagaacggaaggatcataattggctttgacaaatcagatctgactcatgtggagaagaggtggacattggcacaaaacgggtactgccagcatgcaagaaaagaaaaataaatcttgggtaagtgaaccagcactgattgctgtattggggtagtgtaactaaacactaggacatcactgtgttcaagaaataggagagatcagaaaagaaggaatgggcacttgcctgtactaccactttgttgggaggatgaggcgggaggatcctttgagcccaggggttcaaggctacagtgagctatgattacaccactgctttccagcctgggcaacagactgaggccccatctctttaaaaggttaaaaagaaaaagcaagaaagaaaacaggggacattcaggcaactcagactcaaagaatattcctttagcatcggatattagtcccactatgaccttcactagtcagctgataggaagctgatagctgctgctacttctcacacatcagcatactttgctcagatgtatgcatcattgttcacttgtcaagctgttatgagcagcagtttttcacaatgaaccaaatgaggatggaagttcaaattaggctcttaatttgtcatccgttgattcatgcactgaaattgagcaagcattattgcatgctgtgacccctcactctcacagaatttacactcaatcattctgtaattataaaagccctatttggtagctgagccgagagatatcaagactgaacagaagctctcctggaactttctctaagccgatggttctcacaattcaggtgtgtatcagaaccacctggagggctggttaaaacacggactgctgggctccaccaccagacttgtggatgcagtaggtatgggatggggtccaagaatttgcatttctaacttccaggagatgctgatacagctaccctggggacatcattgaggactatggctctaggcgagtctgaaagactcccaaactgttcaaaactgctacagccttggctttaaccatttctgtgacagaaactttctaagtcccaaaagctgccataagacctagctctctcacacaaagtcaattccatttctatggatcttgaaggtattacatctatatctggtggatcctagactacacatactctgctaacatatgcacagacacacacacagctggctttggatgctcgggtattcacttatttacttaaaaaaaattactgaatgctgctgtatgccacacaatgagctaggcttttctagaagaaattaaaatacatataggcccttcttaatggccttgtgtgacatcagagaagaccaaagcatgtacacacatgtagttatatgtgtacatgtgtaactacaatgcaagcttgcaatacaagccataaagaatatataaagggaggtgggatgtcaggacataaaacagcgttttatggagataagaagaggttccaagaaaagatgtgatggttaagctggacctttaaagaatgggcaccggggtggaattgggacacaggagataaatcacaggccacttcaaagtgtaaacaatatgagtcaaagaacatttttaaaaagcactaagtatccagtatattgaaaataagcaactcagtattatcaaggtgaagatgctgaagttacactaactaaagtgttgagaaggcttttcagtaccaggacaagggagcaaccaaaagttttttaagcagggagctgaaatactaagtactattaacccaacagtgttagactcgttggcagctagctacctttaagaaacagccaagatgtaagattaaatcaaaaattcaactgagaatttccttaggattccctggggatagctaggaagtcattcagtgtgctacatgtatttttagatggaagaaaaaaaaagctaatgcaaaaagatatataaataacccatgcaagcaaaccccaagctgaaacttcacttgcaaaaaaggcatttaatcaagtccactataatattaaaaaatcaacatgtcagagtcaaaacctctttgaattttagagcaaatcacatatttaatgctttttttaaaagcgtaaagtcaaaagaactagtttccactttttcatggtgacatcgcgatcaaccagaaaagttcttttgtaaatagcagctttacacatctgagtttttaaccaaaactcctcagggctttcacagtatttccccaggtattcctggaagaatacaaagtgggtttagatgacaggattaactatattattattttaatagttgaatacttattttaacatacaatgaaaaatacgactagtctaccagattcattaatttgcagatattattgtttataaaatattaagtaataatagtaatatggtcatgtcaaaaatctgctattcaagacctctggcttgtcagatctttaatgcctctaaggagatcagatgctacctaaagcaagggctgctgggggtcatttcatctcatgccaaaatgcagaccagtgaaaacactgattccagttaaaggcagttataataccaagagttcttttagtgttttattttcaagctgggtttgatggggggaaaaatttcaaagactcctgggcatacaaacttgttctggagcctcttgaagctattgtttctcttgaacctctctgaccaggtaactcccagacaaacaaatcaacaaatataagatatatttaaaactgccttattttcagaagcaaatactgctgctgaaaggcaacactccacggtacacccctctgcaaccataaattcatcaaaattaaaacccttctttgctctttctgtgagaatactctacatctaagctccagcttccagagcaaaatgccatagactgggtggcttaaacaacaaacatgtatgtctcatagttctggaggctgaaagttcaagatcagggtgccagcagggatgggttgtggcaagggccctttcctggcttgcagatggctgcctttttgctgtgcactcacacggcctttccgcagtgcactttgcgtcctggatctctgtcttcctcttcttatgaaggcactaatcttatcatattaggaccgcacccttatgatgtcatttaacttaatgacttccttaaaggctctatctccaataccgtcacacaggaagttagggcatccatatataaatttgggggtggggacacaattcagtccatagcaccccacttttagaaccttgcttttctttcacaaaaaatctaccactctctcaatcacacatgattattcactgactgcctcaaatgaattggcagtgtgttttctagttcactttctatccactttgatatggtgaatttaaatggagagaattactactgatttttttgttttgttttgtttttgagataaggtctcactctgttacccaggctagagtgcagtagtatgatccctgccacctccacttcccaggctcaaagtcaaatctggccttagattgattctcctatctcagcctccggagtaacttgactataggtgtgtgctaccatgcccagctaattttttgtatttttagtagagacagggtcttaccaggttgcccaggctggtcttaaactcttggactcaagtaatccacccccctcggcctcccagtttgttgagattacaggagtgagccaccacgcctggccactactgtattttgaactacaggtctctaaatgttctctaaagatccgtaaagtgccaagaattctaagcagtttcaggtgtgaattaaccggctgctttctccaacccctctatgtcaggggcagccatagatattcatggaacacatggagattctccatccactaccatctgggttacaaacaaaacactcaaactcagaaggataaccttgttgcaaatgtggtcaccccagcaatctgagaagatgctcacactgactagtccccataattttgataaattgaaatcattatcctgcagcaacaagagaaagctacatcttcttcctgtccgttgtacccaggctctgcttgagtgtagtgccatcctggggactttacccatctctaataatatcttaatacctactcaatctgttcaccagcctttttcaaaactttttcaaatatctttttcagatattctatgcccacttataggtagtttagtactgtctaaatgttcagatgttgaattgtgtcatctgtatgctacgctggattttagagacagttccatggccttggggagtgtatcaggagaaagcagacttttagctgtaaatcacgcaataccccccaaaatagtggcttatgcaaaagacaataagttatctcgtataacccacatctggaggatagcagtgcctggcattcactcaacagacttcactatgttaggaccagcatgtaggagtctcctgtcctcttcttggtagtctgcaaagtcaaatctgaccttggagaattaatattctctcttattcactcaaaaaatattggttgaacgctactatatttcaggcactatgtatgctaggcttttctggggagtataaatatatacacaggcctgcttagaaagccttatatgacagcagagaaaaacagacatggagaccataagaaccataaaggaggtatagataccatgtcatggagacataggagatagaataatcactgtattcaggaagactagaaaaggtttccaggaaagaggcgataattgagctcggttcacaagtatgagaaggattgggacatggtggcaggagatggagtacgcaggctgctcccagctgaataaattatgtgagacaatgaacgtcactagaaaagcattaaggactttgggggaaacaactgctgagcctcacacttgtgcaagttgcctgaagacgaataggcatcctcaagacaggaagaaaagggaaaaggggggcaaagtctcccctaaaagttcccatcaccctcctacttgtctcatagccaaacactgtgtcccagggccacccctagccaaaagagaggtttgagaaagtgactcttcagttcttcctgtctctacaatgaagatggacaagggagaaaggggtgggagtgtgtgagattagcagccaaggatgtctatcacagcaagtcacttaatctttctgggtccctgatttcttctctgaaaatgggaataatgatgccttcctagcgggcctattgtgaggattaaatgaaacatgaaacacctatatgtgtcccagcatctagcatataataggagctcagtatgttcgccttccctcctagtttatgtttctcagtcacatctagtttttgctctcagtgattatggacccaatgtgacatttacaattatgacaagttaattgacaggataattaattttgctctcattaaatagggactctttctttctttttttttttaacaagagaaaaaaaagttttaattatgaacgaatacgcatgcacgggagttcacagagaaaacaatgtatctctaggaggtagccagatgattgaggcttatataccatcttaggctaaacaaaggaaaaggagtttgggccttctagggagggggggaggtggcaagttatgggagagtgaccaagaaaagcatggtcaacaaaggttatttagtaagattcgttatgcaggtttacatcagtaccttccccatggatagagttggtatagtcctcctcttcctggtcctcctctcctggagaaagagacaggtttacaaatagagatgttctttataaatgtaaatttcctttacagaaagaacaattttccccatttttaaagcttttcctgcatctgctggttctcaatggcctttagctcaaaataatccatatgctaaagaggcatactttggttggcatattccaggtcccttcagcagaatttgagtgtccccgatgatccttcccatgaaagccaagctctgctttgtatctgtggtgagtcttcctgccttcccctagtgatgggagatcctaatggtgatagtgtaggattctggcccagggcattttgtaacccccagagtaaagagtttgcgtttcctcagcagcaatgagtctgtatctgccttagatgctgcaaatgttgctgcctcctcttccggcagcttaagacttttgctttgggtaaaggatcaggcagaaaggtggggcttcctgcttcccccactcctacctgccactcccacccctgcaatggtatctaaacatgccctgtggccctgcactaccaagaaggctctctccaacctcttatcccaatctttctggaaaagactcttttcttccttacagtaagagaattgccaaggctttactctccttaccccagagattttgtgttgcagggctaaattctgcattgcctggtatccaaaaatcaatgtccaaccaccaccttaccacatcttcactattctttgatatttatgcataggaaacttagctcattcaggagaattatgccagatactctgagaggtaaacggatagaagaatgggattagagttgaagatgtgggcatatcagaaggagatatacaatattgatggtttctgacgaggttggctgaccaatgcaagaggattgcttgaggccaggagtttgagaccacccaggaacagaggacaacgtagtgtgataccatctctaaaaaaaaattttttttttttattagccagggtatagtggtgtgagcctgtagtcccagctattcaggaggctgaggtgggaagatcgcttgagcccaggagtcttaaaaaaaaatgttgacagttccctctcaggatcaggaagggagtgaagcctttgctaatctctgcagtacagcttagcaagacatcttaccttgtcaaagcccatcttcgagcttggcctaaaagaagtcaaggtatttgcctttaaagaaccaagtgggccaagataaataaaatatctatagtaattactataaactcaagcggccacagggctttctttaaatgctctggacaatgagtggagctagggtcttcatagatcctggggccgaggtaaagaaaatagaaatagaaatttccacccaccttacagaatgggaacttaggttaaatttgatgtaaataaataaaagaaacatgatatgccttacaccttgtactgaagaataaaattaatgcctcttcaatttatatgatacaataggaatgataggaggctccttcagcacctaggacagccaaatacgaaggtcatccatctgtgaaaggaaaaattcccaacaagaccttcagcacacaccaaatagatttaatttatagttgacattggttcacagaacagtcaaggtcattggcaccttaattacaacacacttggcccacactccttacccagcaggtaatagcactaacatgcatgatgaaactcctgtccatcatccaaattcaagatgataagttttgattcggttactgagactattatcgtctgttttatcttgatgaaatagtgactacaaacacagctccaggctaatttggaacaatgtcaacacctaaaaaattatctccttggaagaaacgtgggtaaattagaataaaccttttatgcattagtaagtattaatgtacttaaggtgattcttgctggtgtgtgattccaagatttaagcaggaatatttacattctttaacactcttactttgctccattgaaagactttccctcaagctcccactcctgtgtcccctgagactactgtaagtttctagagctgatgaaaccacctgtagggtagaaagaccagaatagggcgtgtggtttagcaagtcttttctagagttattcttggccctgagcaccactagcatggtgggtgtttctggctgaatctgtctggttgtcctcatgctgcacactctgacgggtgacctgaggccatgagtcagcattgtggtaacattccttctcattacaccagccattctgcttgagtagtcctcagaaaagggaaccattttttaggtaggaaaacaagcttctcgttgtggtctataacctcttctctcctctgggttcagggcgggagagttacaatgcccagagaagggcatgcctcttccagccccctaatacatataaccacatttgattctcatcataaccctgcaatgttgttcccagcaagatggtctgtcacagaatccttgtatgtgtatgtccttgtaggtcaaggcttcttagctttctgccatttgacaattctccctttgtatggggaacgagtgaacttgacatgacctgaatacacagaatcccaaggcttggaccattccagtcccaagagataatttatataaaataaatcaaaggaggagtagaaagtatgtgattgcttcagtctttgttttgtcctgtgttgtgatagttttaccaagcacatggctcagaggaggaccaaatgagaaagtgaagcatttataacaagataccatcactgtagattaacctgagtacaaaggaagaaggtggacaccttaccctggggggaagcaggaaacagaccctatacctggagctggcctgcggatatctccatgtctgcctcccaagattgtagggttgacagatttacactgtttcaacatgtaaaacgaagaggtgaaaacttcaccagcagaaggctgagaaaccactatgagcaatgcctgctcttaattcatgttaccttaagtataaaataaaaaggacttagttgaaaaaactcctaccagattcctgttttatgaaattctgaatttttttatgtcttaatcaaaaaacctaaatattttagggcatggaaaggagaatagattcacccttgagcactagcctaaattagttatgaattattatgtttattttgcaggtgagaaaattgaggctcagaaagtctggaactttctctttcctcacatccctttcgacagtagggcacacgtcaaaactggtcatttgggaacagtatgttttggtacaattcttcctttctttcatggacaagagtaatattaatttgatcaaaataaggcaaatggactttggctttaatagaatttttatatcaaatatttccagataacaatgaagttctaatctgcaaaagctgcaggtgttgttagaagaaccatccttctatgggtggggtgcagtggatcacgcctgtagtcccagcactttgggggccaaggagttcaagaccaacctggacaacatggtgaaaccccatctctactaaaaatacaaaaattagccaggcatggaggcacatgcctgttaatcccagctactcaggaggctgaggtatgaaaactgtttgaacctgggaggcagagattgcagtgggccgagatggtgccactgcactccagcccgggtgaaagagcgagactccatctcaaaagaaagaatcatcgtcctatgaattggaatcttataaaaatagcgcatcaaccaaattgggacagaattattatatatatacatacgaagagaaaaatgggagactgccatgtgggtcagtgccctcaggagtccccagccagaatccctcccccagcaccacatccaactcctaactgtccacaccttggccaaactctgggcatatctggacactgggaacatgtcccttccctgccccctacaaaccatcggccacatttccacaatatgggcatggttctgcctgtccctggctgctggagacatcctggtgtcagagctcctgttggcagtgcacagtgttgacggggagccatgagtgctgatgtagctaacagtgctcaccaactggtattgtgcaggcctcaccctgctaggtttgccctctgaggcaccctgagcaagccagctaacagccaaaggtgctgttcctgggagtctcagccacccagtttctgaatgaccccaagggttagagagatccacagtttgaagcaccaccacaatgcatttgcaacactgtggttggtagactccagtgtaggtatcacggataagcagaggttgttttacaatcagtatttctgatttctaaagccatctctttccactaggccccaaagctacagagggtgaaggctaagatcaaaggagtggtgttcttggaaaaaccagaagcagaactcatagcatcaacacaactgaccacaagagcaacagtgcagcagaagaatggcctcccacaatgtaagttataaggtgacaacctggagataggtctcatccctctcatgcctcagagtagggagaagatatcaagcagattacactaggccccgctgacatctaggactttcctttgcagactacttctatgctctctggcatctatagctccatgaaccttattctgctcatttcatttgtttctaattcagaggtggtcactttcaattgcccagtcttttaaaggtggggaatttttggatggactgagcaaagccttgaagcaaaagcaaggatctttctggtcccaaatacaagtgggatttgaaggtacctgttgctgagtaacctccgctgtttcctctctgctccctctcaagaacaaatcctccaccaaagtcggcttggatctcacaatgcttcatcatgaagacgtgagcaatctttcaaactgatctccttctgcaaagttggggtgcaaaagtcttccagcccaggaggtcattgaaacctttagcctaactcttcccatattctcttttcaagtttgttgttgtagctgttgctgctgttttggtgttatcactactgaaatatagttcatttgccataaaagtttactcttttaaggtgtacaattcagcgattttttttttagtatattcacttgtgcagccatatccactaactcgagaacctcttcattacctgagagaaaccctttaaccattagtaatcacctcaattccctccttttcccagctgtggcaaccaataatctatattttgtctatggatttaccttgtctggacatttcatgtgagtggaatcatacaaaatgtggccttttatatctggctgttttcacttttgttttcaacgttcacccccattgtagcacgtgtcagtactttatgcctttgatggctaaataacattccactgtatgaacataccacattgtgcttatccatccatccatggatgacatttagattgtttccaccttttagataagatgaaaaatcctgctatgaacattcatttacaagtttttatgtatttgtaaaatttttcaaaaacatactcaaaaacttttttttcaaatagaaagctttagctttaataactattgcctctgggaataattttggtcttattgcctgtcttgtcaaggctgaacaatgatcctttattactctttttttttttttttttttgagacggagtctcgctctggcacccaggctggagtgcggtggtgcaatctcggctcactgcaagctctgcctcccgggttcacgccattctcctgcctcagcctcccaagtagctgggactacaggcgcccgccaccacacctggctaattttttgtatttttagtagagacagggtttcaccgtgttagccaggatggtctcgatctcctgacctggtgatccacccgcctcggcctcccaaagtgctgggattacagacttgagccactgtgctggaccgatcctttattattcttaaacatctctagaaacttagcctcaccaaggtaatacggtacttggttgacttgagaaaggttttctaccgtggtgtacataagagaaagtatatcaatatttcaaaatagtatcagcctatacatcaataatggttggtcactcaaagtgacacttatttccactgaggaaacttgcaattttttaagagtcttgctctgtttgcccaggctgcaatgcaatggtgtcatcatagttctctgcagcctcgaactcttggggttcaagagatccttccacataggtctcccaagtagctgggactacaggcatacgctgccatgcccagataattttaaacttttttgtaaagatggggtcttgttatgtggtccagaccggtctcaaactcctgccctcaagcaattttcctgccttggtgtcccaaagtgctgggattacaggcatgagcctgtgcctggctattcttcaactggacaaaagcaaccaaccagacactaattcccattccttaaatagggtttattttttaaacttaaagatttaaatcttttttaaccttaagaaattaaaaatgtttaaaatcttaaagatttaaatcttttttactcttaaggaattaaaaattttggccgggtgcagtggctcacgcctgtaatcccaacattttgggaggccgaggcaggtggatcacgaggtcaggagttcgagaccagcctggccaacatggtgaaacctcgtctctactaaaaataacaaaagttagccaggcgtggtaatgggcgcctgtagtcccagctacttaggaggctgaggcaggagaatcgcttgaacctgggaggcagaggttgcagtgagccgagatcacgccattgtactccagcctgggtgacagcaagactcagcctaaaaaaaaaaaaaaaaaaaaaaaaaaaagaaattaaaatttttttaaatcttaaagacttaatctttattaaaatctttataaaatctttattaaaatcttctataagattttgatctgttgtacagtattcattacaaagcccagtgctgtgccaaaagtaaattcaaaacaaatagctgtcaaataaaaaaatgaatgagtaaataaatgtacatttaacagctaggagactacccataaggggaaattaagaactatttaggtaccatttatttttttaaaaagccaaacaccggatattttttaaatgtacaaatgtaaaattttatacacacaatacccaatttgtgatggtttatcttgttttcaagataagttttgctaatatcttattgttcaaagaacagcaacaagctgcacaagctggtttacacaagctgtagattccaacgtagactttctcaacttcatgacgatgcaaaagcaatacgcattcagtagcaaccatactttgagtacccatgcaactattttgtttttcactttctatacagtattcaataaattacatgaaatattcaacaccatataataaaatagcctttgtgttagttaattttctcaattataggctaatatagatgttctcagcacattcaaggtaggtgaggctaagttatgatgttcaataggttaggttcataaaatatatttctaactaggatattttcaacttatgatgggttcgtcaggatataactgtattgtaagtcaaggagcatctgtactttacagtagtgtttctggaagtacaaaataggttaggatgaaagaatattgttttcaagatgagttttgctagtaatattgttcaaaggaactgcaacaacctgcacaggctggctgatacaagctgtagattctttgtcacctggaccaacacagactttctgatggacatgtcaacactcacactggcctcaattcattgacaagagctaagagttaatgaatcagaaaatgaaagataaaagcagaaaagaaagagatcaactagagaaaaagaaggaactattccagatggcagatgctcctgtgtcatggaagcattcagtttcagtttgttctattcttgacttcacttataagttatctggtggcatgggacaaattgcttagatttcttctgcctcagtttctcagtgtgcaaattggggccaacattactcccctttaaggagttcaaagagcactgaggtaaaaagttggaaaggcccagcctgtgtctgtaaagtatatttacaactccctggagtaatgcaggtattgatgctaaaagcatcattatttttgtagttggaaagtcagaatccatcctccatcatattctaagcctttgaaagagccctttgttttcctgcctcagctttggcccacaggcaaaaatattctgtctttcaaaaggtttctttcataaacagttcattctttttaagtgggtttcactgactacgtttattaacatgtagtaacacttaaggaaggtttcgtttggtactgggaagaaagcagtgtgggcagcctgccactccttagcctaaaaagaaatattgtctagaacaaggcccgaggcactcagagaggccaggactattgcaggttgccgcttgcgacttgcatcactcaacccaagcagtgcaaacaatgacgggtgtcccaggggcccctcctagacaaggccagtggtgaaaattactcagcctttctcagtcactgaaatgatttcaccagagagacatctatgtcaataaaagggaagatgaagatattcaacttgataaacagcagaaaatttaatttaacaagctgtctttccatgttttttttctgtccatgaggttgaattcaccactgttctctaagttaaacatctctatctttgatttatgtcatgactgagtctgtgaactctccttgttattttcttctgacctcatatctcactacttgtcttaatttgagccttttctttttttcttttgcaagaaatggaaatccattcagtgaagaccatctctagagatttctgggccttaataaatatctatagaatcatgggtgactgcagagtcatccatgaatatctctacagtcacccaagaaattcttaacaaaggtaaaatcaggtcaggatgtgcctccagagcagttttgaatgaagaaaattcatcaggaaggggcaacctgctgccaaggggtgcgtgagaggcagagggtcaatcacattggccagggtagcaaatggtgctgaatgaagatgaccagctggggaggcctttcctgtcctctccacagggactttgtccctgagtgctcgtcagtcaccagcaaaacccaaagcttgaagccaatgttttgtcttcatggaaggatatgtactgcctgttctgtcaagctctaatctcttcaaacttcattccagaatcctgagatttttttccttgccctatgacctcagaaactaatagaagatttttctgaagccaggaaattagactctgaccataatttgatcagaggcaacaccctcccagggctggatgaagatctttaaaagtcttgagcattaaagagattatgcttcacatcccacaactatccaccatatgtaatacaatatttttttaagatctaaaccctgaagtaaaagagaatttcaacaaagttcaaactcttagcatgataatgatgcaataccttttttaaaacatcaaaatctgtatctaaattttgttctatttgcatgtccccatttactggtgatctaagcatttattcagtctatctactgggaattctgtcgccacctctgcctactctgcacatacccgctaaatgtctgtcatttgattagtccagtaatttgtatcacaagtgtttccattggaacaatcatctttgatgtgaccttctctctgtggaaggagctctgaagaagcaggagtaggtttttctaatgtttttaacatagggtcaatgcattcatttaatgcacatttttgaacgctcatgctgttccaagtacggcataggaagtcaaccacattacaaagataatactaggtatgatgttacagagggacaaggtcctaaaaaacaaggagttataagagacaaggaggtgacctcagcaacttggcagaataggaggcccttgcctctccctccactcttgggcacaccaaataaacatctattcacagatcaattctctctgagagaaagtaagaaatcaattgagaaactctgacccaaccaggcaactgaaaaatatccacaccgaacagatgggaaaaaccgaggcatggtcaggcaaagatgccatcccaggcaccacatcatacaatcaggaaaggaatccccaaactcagcttctcactgtggcgagtagggtatagacctcatatgtaatgccctaactcttagcttccccacattttggctcttacttaaccagctttaggagtgaaggagattaagcatatacaattctcactagactataggggaaaagtggcagttttgtagacatccacagctcttccagaagctccatccctaggagcagtgtggagaaggggcttttaaaaagcagcttcctgtttctctgcagaagggatttatgccgtgcattgagtgccccaactttcatagctactgtctgaagaactgcatcctaaaaacctcctagccctgagagcagaagagacgaggcatatgtgagtacttctagataatagaacataaaggtggttttaaatggacacagaaacacttccagaggccatacttcctgggaacagtgcagaaatgaggctgaaatacagctaccatttttctctccagaaggggctcactacacacccttccagtggctatatgacagcctggctccaaataaacttgcatcagggagctaataggtgagacaaactttagccctccagcagtcagcgccagagctgggcagttctcaagcctttcctcacaccaaggtctacctatttttcctggaaggagtttgtccatgcaccaaatgccacaaatgtatagctctcaccaaagggactgtctccctaacgacctagctctgaaagttgatggggctttgcattcctgagtggccctagaccacagaaaacaaagaggtggacatacaacaggcctacttccatcagatatctcctcaagctcagaagatgcagcctgaactccagtacaggattttgtcacagatcctctccctagcttagtgcagaaagagtgggagataaacagcaacactcagcttcaccatgaggatagcagctaaaatacatacccaacacccaccgccccccaccctccagcttttccagctacatcagagagactggctcctaccttactggtcttcgggtattgacagaacatggcccatcctaatttgggagggggagcagcaccaaaaacagagacaaacacaagatttgaaaggcatcttaaaatctttggcaaagcaaattggtgagatttttctcttacagtaggccagtctgacaagactggaagaggcagatgtcttatctaatgcacagacccaacacagtgagtcaagaaaaatgaataaataaggagatatattccaaataaaataacaacatgaatctccagaaactggcccaagtgaagtgaagatatgtggtctgcccaacagggaattcaaaatgatgactgtaaagttgcacatcaaggtaggaaagcaatgcaagactgaaaattccaacaaagaaatagaaaatatctaaaagtaccaaacagaaatcatagagctaaagaatactataactgaattgaaaactttagtaaagaaatttgacaacagattctgcaaaagggaggatcagtgaatttgaagacaggtcactggaaatcacccaagctgaggagagaaaaaaaactaaaaagagtgaagatagcttagaggccttatgggacaacattaagcagaacaaattaggaattattgatatgctaaaagaataggaagagagagaaaacattttaaaagaaataatggcagaaaacatcccaagcctgaggagaaaatattcagaaagcttaatgtacatgaggtaaaattagtccaaagagactcacaccagggcacgtcataatcaaattgtcaaaagttagacaaagggattcttgaaagctgcaagaaaaaagcacattattatgtacaagggagcccctgaaagattatctggatttttcagcgccttgcaagccaaaagagagtgggatgctgtattcagaattctgatagaaaaaaaaaaacaaaacctgccaaccaagaatactgtgcccagcaattctatctttcaaaaataaaggagtgataaagactttctctgacgaacaaaagttgagagaatttatcaacactagacatgtcataagaaatgctgaaggtagttcttaaaactgaaggaagaagacacaaattagtaacatgaaaacatatgaaattataaaactaactggtaaaagtaattacattgtcaaacccaaaacactctgaccctgtaatgatgatggataaatcaattatatctttagtatacaggttaaaaaggcaaaactattaaaaacaactaaagctacaataatttgttaacgaatacaaataataaaaagatgtaaaatgtgacagcaaaaatataaagcatgggagtagggggagaaatcctgtagagtttatgtatttgacaaaaattaagtgttacaagcttaacatagctggttataagtttaaaatactttatgaaaccattagggtagccatagaacaaaagcctacaatagatacaaaaaagataataaaaaaaaaaagattcaaagcacaccactacaggaggccatcaaaccacagagaaagcaagcaagaggggaagaaaaaagaaggatctacaaaaccatcagaaaacaatggacaaaatggactaatgagttcttatctatcagtaattactcttaatgtgaatgcattaaattatctaaacaaaaggcatagagtggctaaattgatttaaaaaagaaagacccaactgtattctgcctacaagaaactcacttcaacttaaaaaacactcagaatgaaagtgaaaggatgaaaaataatatcacatgcaaatagaaaccaaaggagaacagaagtagccatacttattttagataaaaactttaggtaaaaaactgtaaaaagtgagaataaagtcattatgtagtgattaaagggtcaattcttcaagagtatgtaagaattattaaatatataggtacctaacattggtacacctaaatatacaaagcaaacattaatagatctgaggggaggcatagactgtaacacagcaatagtagggaatttcagtaatcactttcaacaatatcaacgaatcaatcagagagaaaatcaataaggcaacaatggacttaacagacattgcagaacattctacccaacagcaatataatacacattctgttcatgtgcacacagaaaattctccaggatagatcatatattaggccacaaaacaagttttaacaaatttaagaagattaaaatcatatcaaatattttttccaatgataatgacatgaaactagaaatcaatacaggaggaaaatggaaaatcaacaaatatgtggaaattaaacagtgtgcttctgaacaactatagagtcaaggacaaaattttaaaatatcttgagacaaatgaaaatggaaacacaacacaccaaaacatgagatgcagcaaaagcatttctaagagggatgtttatagcaataaatgcctacctcaaaaaagaaagatctcaaataaacagcctaacactgcacctcaaggaactacaaaaggaaaaacaaactgagctcaaagttagcataaggaaggaaatagtgaaaattagactagaagtaaatgggactagaaaaccaataacaaagatccacaaactgaaagttgttttttttttttgagaaatcaaaaaaaaattgacaaacccttagccaaatcaactaagataaaaagaaagaagactcaaataaataaaatgaaagaaaagacattagaattgataacacagaaatgcaaaggatcataggagactactatgaataactatataccaaaaaagtctaataacctagaaaaaaatggataaatttgtagacacatacaacctaatcaggaagaaattgtaaatctatataaatcaataatgagtgagaagactggatcagtaattaaaagtctcccatcatagaaatgtccagcactagatggtttcctggctgaattctaccaaacatttaaagaattattaccaatccttcttaatgtcttcaaaaaaagttgaaaagaaggcaatacttccaaactaattttttaggccaacttcaccctgataccaaagccagaaaatgtcactgcaagataagaaaaccatagaataatatcactgattaacatagatgtgaaaaatcctcaacaaaatactagcaaaccatattcaatagtacattataagattcattcaccatgatcaagtgggatttatccctagaatgaaagaatggttcaagatagatcaaaaaatgatattcctcatattaacagaatgaagaacaaaattcatagaaaaagcatttgacaaaattcaacatcctttcacagtaaaaactctcattgaattaggtatagacggaatgtcctcaacacaataaagttcttatgtgacagtcccacagacaacatcacactgaatggtgaaaagttgaaagattttcctccaagatgaggaacaaaataaagatactcactgtcaccacttctgctcaacacagtactgtaagtcccagccagagcaattaggaaaaaaaaaatccatatagaaaaggaagtataattgtttgtttgctaacaacacgatctcatatatagaaaatcctaacgatttcactaaaaaacttagaactgataaaggaattcagtaaagttgagttcacaaactcagcttacaaaaaaacagtagtgtttctatcaataacacgaactacctgaaaaagaaattctcccatttacaatagcacaacaaaagatacttaggagtaaacttaacccaggaggtaaaaatctacactgaaaactataaaatattgatgaaggaaattaaagaagacacaaataagtggaaggatatcctatattcacgaattagaagaatcaatagtctaaaaatgcctatattacacaaagcaatctacagattgaacacaatctctatcaaaattcaaatggcatttttcacaaaaatagaaaaatacaaaaatttatatagaaccaaaatagaccttgatagataaagcaatcttgaacaagaagaaaaaatctagaggcatcgttctgtattacaaagctgtagtaatcaaaacagtacggtaccaggataaaaacagacacattcataaatggaacagaatagagaactaataataaatccatgtatctacagtcacctagtctttgagaaaggtgccaagaacacacaataggaaaaggacaatctcttctataaatgatgctggggaaacaatatccatatgcaaataaaatgaaactagatgattgtcttacaccacacacataaatcaactgaaaaatacctgaatatttaaacataaaacctgaaactgtaacactcctaaagaaaaacacaggagaaaaactctatgacatttgtcttagttattattattattattattattattattattatttgttttttacacttactgaattagaaaagccaaagccattggaaattattttttggatgtaataccaaaagcacaggcaacaaaaacaaactacatcaaactaaaatgtttctgcacagaaaaggaaacaatcaacaaaaagaaaaggcaacctacagaatggaagaaaatatttacagaccatatatctaataaagggttaatatccaaaatatataagaaatagcaataataacctgattgaaaatgggcaaaggacataaatagacatttttccaaaggaggcatacaaatggccaataggtatatgaaaaggtactcaatatttctaatcaatagggaaatgcaaatcaaaactacaatgaaatattaccacatacctgttaggacaggtattgtcaaaaattcaaaagataaggtccagctcagtggttcgcaactgtaatcccagcacttctgggaggccaaggcaggagggtcacttgaggccagagttcaagaccagcttgatcaacatagtaagaccccgtctccatggaaaaaatatatatatatattagccaggcacggtggcatgtggcatatgtctgtagtctcagctactcaggaggctgaacccaggagttcaacgctacagtgagctatgtttgtaccactgcactttagcctgggtgacaaaaaaaaaaaaattaaaagacaatgttggcaaggatgtagaaaaatggaaacccttagacattatttgtgggaatgagaaaatgagagttgatacaaccactatggaaaacagtatggagggtcctcaaaaaattaaaattaaaactaccatatgatccagcaatcccacttctgggtgcatatcaaaggaaataaaattgctctttccaaaagatatctgcattcccatgttcattgcagcattattcacagtagtcaaaatatgacatcaacctatgtgtccattgctagatgaacggataaagaaaatatggcatgtataaacacatacacacacacacacacacacacgtacaatggaatattattattagacttaaataagaaggaaattctgtcatttgagacaacacggatgaacctggaggatgttatgctaaatgaaataagccgggtacacaaggacaaatactgcatgatctcatttacaggtgaaatgttaaaaagtcaaactcatagaaacagaagtagagtggtggttggcagggatggagggctggggaaaatcggaagatgttggttaaagggtacaaactttccgttataagttgaataattcctgcagagacctagtgtacagtatggtgactatacttaataataatgtattatatatttgctatttgctaagagaatagacgttaagtgttctcaccacaaagataactatgtgaggtgatggatatgttaattagcttgattgtggtaatcattccacaatgtgtacctgtatcaaaacatcacattgtatacggtaaatatatacaattttatttgttaattatacctcaataaagctgccaaaaataaaaataaaatacaataaatgataagaaatagtatactttactaaaagtaaatgaaagaaaacacaaggtagagcatgtaataagagtgaatacttattgagcacttacggtgtgctaatttgtgtgtgtgtgcgtaaaatttcacttcatcctcataacaacctatgaagctaaaaacaaaaagttaattatgcccaagctcatacagctgaaaagaagcagaactggaatgacccatccacctggcttcaaacctcacggtgctattgcctctcataggtacccatttctctccggcagccagttcattgaaataggaaaaaggtcacaataaactaagtatccgtttctgcttaagacctgtctattttgcagctaacacactcaactcttttatttggagcacaatttaaatctataaaatatcttaaagctgggaaatgtcacagttcaaaacgtgtgttgaatgaaaggagaaaaagcactcatccaacattgcttctgctgatttgcagtttacaagtacagcctgctgcactaaacaatgtgctgtggataactaagcatcttgtgttccaacctgataagatgtagatgaaaatgaatgagaggcatgtgaataagaaaagtccacagggccttgtagtaatatattacctgacacatggaacatctaataaacatttgctgaatggaaaaaggagcccgaggaatgggacaacagacatgagttgttagaagtattgaagtattgatagcattatttatgtattaaggagagtcctgcttggacagcaataattcctattggcaatactttgtattgatgttatagtttcattaaatgcaaacactatttatataactaataaatcaaaacctatagtttaacacgaaaaaatgatgagtgagaaagcccttcatattcaatgttgctcacaatgccagtctgtcaggaagatagaaacgttatggaagcagcttctgcctttaagaaattacatcctgtcacattctgtagcaataacaggctgcactgagatgcaagagacaaggactctgaaccaggtgctttgctaatttctgaacttctctggacctctggtttctcatccacaaaaatgaggggcagtatctctgaaacaaactgacaatctacatcgattttcctgccttcttctttacggtcaatttcctactgtcatgaagcattcattactgagggaaaaaacatagttgaagttgtttaactacaccagtttgtgaaacacattgagattttagaaacctaaaaaatattaaattgctggggatagaggaagagagagaagattgtgattattagaatgccgggaatgttcttgttcttttaggatgaaaattgagtatctctagaaggttctgtgaacctgtggtagaaactggtggttcacaaaatttaggtttcgactggagtgcagtttttattacagacaggcagcacttaaattgaggggactttttcaagctggtccttttggagtttgctcacaagagggcagtgctgtttaacagttgcagccttcaagtgggcaaggagaagaaggctggctggctacccaattgttctagctccacacaggtaaagctaaagaattttgtttggtacacgaccacagtatagggaaatcttagcaaaaggtactttttgtcttctcagaagatagagtaatcctggcttaaaaaatagacaaaaatttcgtttcaaccctggaaatgatgacaaatgatgttggttagtgacaagatgaagttgggttaacaaaatccttttgctgatcgaatgcattttgcactttataggaacatttgaaaactgtgaaattcaccagacacacgtaatgcttagtacacaatacccctgggacatgaaagtatcttcagggtatagccgagatgtattttatggaagcaatttttaaaatttaatttattatatagagatggggtcttgctatgttgctcaagctggtctcaaatttctggcatcaagcaatcctcccgccttggcctctcaacatgctgggatcacaggcatgaggcactgcacccagcctggaagcaacttataccttataacagtctatctggataacatgaaagttactaatcaaatttaggagttacaatgactaatctgaaaaataagatattttccaaaatgatctggaaatgaatgctttgtgtacctctcttaatttgtactagcacgattgtctcattgataacactacaaagatgtatatgcatactctacctcctctaaagagattaaactcaattttagaagtgtaagttcaagttttgaggagttacaaaaaaattatctacgaggggttactgttcccactaaattcttcatgccataaaaggcatcttttctgttaagccatatttgagagtgacttcctaaggactatttcaatcaaattgaaagttcattcttggacaaaataaaatgtgctcacaagcaatgaacaatccaaatattaaattaagaaaacaactccatttacaatagcatcaaaaaattcttagtatttaacaaaggaactatataggcttacacactgaaaactacaaaacaccaatgaaagaaactgaagaagacctatttattataggaaaatatctcaaatttatggattggaagatactgctaagatcttccaaatttgttaagatggtaatacttaaattgatttacagattcaacacagttcctatcaaaatcttagctggcttttttttttggatattgacaacctaattctaagatttatatggaaatgcaaaaaacacagaatagccaaaacaatcttgataaagaagaaccaagttggagattttgcacttcctgattttaaaatgtactccaaagctatagtaattaatactatgtggtactggtataagtgtagacgtatagaccaatagaatagaagtgaaagtccagaaataaattcacacatttatggtcagttgattcttgacaaggatgctaagacaaggaataagaatgttaatggtgctgagatgatattcacaagcaaatgaatgcatttggatctttacttcacatcatatacaaaaattaactcaaaatgaatcaaaatgtaaaacccaaatttaagaggtaaaactccaaaactcttacaagaaaatataggtgtaaatgtttgtgactttgaattaggcaatttattttttaaatgacacccaaatcacaagcaacaagagggaaaaatacataaagtggacttcatcaaaatttaaaggttttggaagcaaagctaacaaatgcttggggatttttacaaaagtattaatgtgtgtatttgtgtgtgttccttataaatgtaattttgtttggtggcgtctttttttagtatttttatatgactactctgtaatagttactttaaaaaatttaatccactgaagtttttattaagtaggcaacacctagagacaagtagccatgaaaaaattaaacagcaaaaatcccagtgcggcagcaagcagacagtctcgaatttcagctctcttgtcaggaggacatttgttagtgatagactagaaaacaaccacagcagaaaggatttctggaagatgcccaatcaagaggtatcttttttttttttttttgtctgaaggctgaga

SEQ ID NO: 768 - DNA, 16316 bp, Homo sapiens
agaagggtctgtcaaggaaaaaaccaagtcacgaaagtataatttagcatgttcttttctttactcttgtaaaaacttaattattattttatatgtgggggttatgtgtacaagtttgttacacagatatattgtgtgatgctgaagtttgggcttcagctgaacccaacaccctaatagtgaacatagtagccaacagttagtttttcatcctttggctccctccctccttcccccgttttggagttcctattgtctatttttcctctctttatgtccatgtgtaaccagtgtttagctcatatttatatgtgtgaacattcactatttggttttctgtttctgtgttcatttgcttaggataatggcctctggctacatccataaaacgttcttaaaatcatttttgtttcttaatctaaaacaaatgtcaaaccaatttataatctaaaacaaatgtcaaaccaatttataagcaaaattagttttcatacatgtcagttcatgaattaacctgaattctccttttagtgtgtcataggtctctgtcaatctagtctggggcactgtgttgaaagtacattgggatatagatttaatagcatacatgctttgaaaaaatatttaaaattttcaaattacagatatagtggattttgattgtagaactaacaagagctgatattattggattagaaatgacttctctttaaaaagaatagtacttgaactagcatttaaaaataaaagcaagaatgctgatttctactaattttgtagatctgatgaaatgagatcacatacatacctacaaacatgattctaggcacatattgcccatcaggtgataaattcttatcagtggtttcatgctagcaggagaagaaaaaaaaagaatgttattggattcatttgtttttgatagtttcaagatgattttgtgtgactgtcagtaaattctattttggccttttataattccatacaactttctgtattaaccaatatttagctctttgtgctttaaaaatagaaaaaaaggaggctgggcatggtggctcatgcctgtaatcccagcactttgggaggctgaggcgggtggatcacctgaggtcaggagtttgagaccagcctaaccaacaaggtgaaaccctgtctctactaaaaatacaaaaattagctgggcatggtggcaggtgcctgtagtcccagctacttgggaggctgagacaggagaactgcttgaaccagggaggctgaggttgctgtgagcccagattacgccactgcactccagcctgggtgacagagcgagactctgtctaaaaaaaaaaaaaaaaaagaaaaaaacggattcaaaatttccatgaaattatagtattaagaaaacatcacaaagtttatgtaccataaggtttagcatgatgaacttattctgagccatttcttgtatttcttcattttgggcaaatactttctttagtgctataggggaaaacaaaattgccagttagttttaaggatcaagagacctttaatgtaacatagcaaaataaagctaatatttagcatttgtttgcatatataactcaggtgtaaatattaatagttcattggcctattgccactttgtccctcattggaaagcaatgagggacagtctgttcaaggagacatcaaaggataatcacagtgaagacactagtttttataattttatgtaactcattgactcattggttaagacaacgactttttttcagtgtttctacaccttctcagctcacccctttcttttcatgggaagaagaggaatatgtaattcccaagggaatataatagaaatattcagtagattggtaacaatcattgtggtctttaagcaccttagtaaaatgatggtactctggcagttgtctattttttttaatgggatttgctgagcgccttcttagctattattaccaggtcacttttcctattttatattggaaatattatatattataataagatatcaggggctaaaattaccttgagagtattgacaatcctccaggtgatgaataaccattaatggcttcttactaaacaaagaaagtatggaattaagtcaaatgattaactttgggtcaaaatatacagtagagttagatttaaaattttattagcttcaataaggcttacagtagtaatctcagatttacaaatcatagcactatagtcaatagcagtgttactctatttgtggcctcagaactgatagtatcagtatcactaggtagcttattaggaatttaaattcaaaggctccgttcccaaatcaggaaagcctccattccaaaattagctgggcacagtggtgtgagcctgtagtcccagctgctctggaggctgagacatgagaatcgcttgaacccaggaggtgaggttgcggtgagccgagatggcgccactgcactccagcctgggtgacagagcgagactctgtctcaaacagacaaacaaacaaaaaaccaaaggcttcatcccagacccactcaatcagaatctctggggttaggggtggtttcaggaatctgtagcttaacaaacttattaggtaattcttatgtactctatagtgcagttagagaaaatcaattctgtatccagagataaagggttattatgaacaatgtattcatttccaatgaacacttagtataagatttcaggaaagtcaaagacttttacatttagttttttaaaaagtttttacaaaaaagctgttaatatttggctattttcacatcctttcattcttgcacgttgcagaatatacaaacaacctgagtgggagttccctatttcatacatttttggggggtcattttgattttaaccataaaaagttaaaaagataaaaattcttcctcctactgctaacttctataactatgctgtattactttttcttatattttctcccagaggttttcaggtcatataactgaaaatctatatgaatatgtttatatattgtatatacccagatgcatgttcacatttatgtgtatgtatttctttttaaaaaacaaaaatactagcacacaagtatctacattttgcttttaaaatataaatcttagatatgccactgttcttttatattatattctattatattaatattttatcttattagtctccccaaagatggatatttaaattgtttccaatctcttgtgtttagattgttcctaaacatttacatttgtacacttatttgctaaacatgctttttttttaaggcacgcagtttctttacacccataattgcatcctaaactcttgtatagttcatatttacagccccccataaagtttttgcattctgaattagtccttcacattttgatatttggcataatgttcaaacacactttatacacactgacctctccttaaaccactcatagatttaataaatcctacagaaaaacattcagagattacttgaaagcttgatcttctatttacttcaaggtgacagaagagttagtttttcgtgatgaaagactacaggaacggagaattaacaaactgttgtgtaattcatcagagaagtatattaactctgctgaagtaccactgaatgaaacaaaaatgaatctgtgaagtagcaatctgattagcaggctggcttctatgtcccatcactctcatagtcttctattattatattttcttccacgtctccttgggctgaaaagagctgaggctggctggcaggcagttcactggcactattctgactcagaggaagagaccaggtttccagctctgtgtcctgtgcgggttcacccagagattcctctgcagaatgtcctccgttaagctgggcttcatctccactgtcagggtcgatcattccatgttccctgtcagtcagggcttccattttcagtcttccgaagtgttgcttcagagggagccttccaatatcttggataagagaaatctgagcttgatttctcattggaatggttattagagcaaggtatggcagtagctgagtttggaggcataaagctggtaggcagaagtcaggaaaaagtgcttttgctgccaggcaattttccccatactttttatgtattagaaaccactgcggtgtgtgcgagggtcaaaaacttgatccttctccttggcaatgagcatatcctccggctttgttggaatgtatcacacctcttgtagctatagatgtcctatatttcctgagtaaagagcgtgtattccagtcaccactgaggatacctgcaaaacttagaaattcactggctctcacaatatcatcaatttccatgaagaagtctatgtagttttggtgaagatataaattaaataagtctcctggcatgtgtgacatttctactacctcctcaggttcaacaagtatgtatcctgttcatattctgataaatgagagggcaaccaagatgagtctgattctgttaaagatgctcttttactgtataaaattttccccaaagctcggaagagaaacagagaaacgtctttgccaccagtagcttggacctcttgactttcaaaaaccctatcagttttttttctttgttttgattttgacagcgtagcatttgattttaaagacattctttttttccttggccataagttgttttctccttttgaagaagaaatctggaggctgtttattgcacttctcatatcaccagaacatccttgacagagcacctctagagaagttttgtcagggacagtaatttttcctccattcttgttagcctctatagtcactattcgattaagaaatttcatcgtaattgttggtgccacagggttgaaactaatatttgaggtagaatgctcttcccgaatttctttggggaacaagaaactttgattatttttaccactgagactgtcacagattataaatataaaaggatatcgaccaatcttcacatacttccttagaacttcatgtaaagtatgagaatccctataaactggttaggtaaatcttcaaccagaattatcttcttatcagttctcagatgatctccaagcatttgtaacttgttatactttgttgctcttagtagaaactctttgcaaactgctatctgagactgatagggaaacatatggaagcttgattcagtatgaaacatttccttgaaatcatctttttggaaatctggtaaaactggattaatccactcttgtacttgaataccattctcctttgatagcgtttttttggtcgttgtctttccacatccaggaggacctgttattaataaaatagatccatcctgttttggttgcctttctaagacttgagctttttaccaggtttcaacttcttcaattatcttttcatgcacagccaagttcatgctaactttctggtttatatttatctacccatggttcattttcagacagatagtcttttgaattttctaaaccatatatctgttctaaggaagacagatttcctatttttctagctggaaatatcttactttctaatgtagaaggctcatttttttctctatgacttgagttattcacacctaatgatgtggcagtaatagtagagatgtctctatactctagaaaatcattgaatgatgggtcaatccagtctgttacctttgtggaagatatctttggtctaagaaaagtttttgacattataaactgtaatagttcccatccatagtataggacctgtagtacattaaactataattcacctcctttaaaaagcaggtaactgtccctgaagatgccaggttcctgaaatgagagaccatgctgttgttttaaaaaatgattttgcacataggtgggtatgtttgtgaatacatttccagaagtagaatttctgagtcagagtgtgtgcatttataattctgatatatactctccatagaagctgtaccaattcatattctctctggtagtgtgagcagtaattgtttttgctattctcactaaagctggttattagtttaaattttttttatccaacaggtgaaaagagggaaacgaatgtggtttgtctttcttataaaaaatagtcaatcttatatgtttgagttacttatttttctgttctgtgaacttccatattctttgctcatttttttctgttgacttgttgacctttttcttgttaatatataggagtacgttgtatattagagaaagtcacccttctaatatgtgctgcagttttccatttaaaagaatatttttcctttgtaagtttttggttatccagaaaattccgtgtaattgaaaatattagtaatttctttttagactttttcttttatcttctccttttctttgtttggctatgctcaagcctagcagacagcactagcatgaggccaggggagcatctacaggactaaaattagaggctttatttttgtaccccaggtatctttcttgcctcactataatcttggctctcccctattccaagcatttaaagaaataaaattttgcagtggtatcttctagcaccttaatgatttaattttcataattatatctttctaatttatttttgcataaatgtgagatatggatacaaatttatttgtttttcccagatgactatcaacttctgacactaattattacataatctgtctcccctattcctgatttaaaataccacttcctgtattaaaaaattcctgtagtatctatctatctatggagtttgtcaactacctatcaataatctatttatttatttgacaagtaaaagttgtatatatttatggtgtacagtatgctgttttgatatatggatatgttgtacagtggctaaatcaagctatttaacatattcatcatctcacatacttattttttgtggtgagaatatttaaaatttactgtcagcaattttcatgtataaaatatattgttattaactattattcccacaatgtacaacagatctcttcaatttatttcacttaactgaaatgtgtgtcctttgagcaagaactccccatcctcacccccagactttagtaaccaccattttcctttgtttctatgagtttgacttttttagattacacatgtgagattacgtgacatttgtctttctgtatctggcttgtttcactcaccataatgttctccaggttcttctatgttgttgcaaatgacagtgaacatgggagtgcagatatctcttagacataccgattttatctttttgatacatgcccagcagggaattgctggatcatatggtagttctatttttaatttttttgagtaatctctatacattatgctttccataatggctgtactaatttacattcccaccaacagtgtaaaagggttctcttttctccacattcttgccaacacttgctattattcatctttttgataatagcctttctaaaaggagtgaggtggtatttcattgtggtattaatttgcatttccctgatgattagtgatgttaagtattgttttcatctacctgttggccctttgtatgtcttttttttttgagatggagtttcgctcttgttgcccaggctggagtgcaatggtgcgatctcggctcaccacaacctccgcctcccaggttcaagtgattgtcctgcctcagactcccgagtagctgggattaaaggcatgcaccactatgcctggctaattttgtatttttagtagagatggggtttctccatgttggtcaggctagtctcgaactcccgacctcaagtgatctgcccaccttggcctcccaaagtgctgggattacaggtatgagccacggcgcccagcctgtatgtcttcttttaagaaatgtctatttaggtcttttgtccatttttaaaacacaaattccatttttgttttgttattgagtttcttgcatatttgcttcttttcagatgtatggctttcatatattgtcttctattctgttggttatttcttcactctgttattgtctcctttgctgtacagaagctttttagtttgatgtaatctcacttgcctatttttgcttttgtttctcatgtttttgaggtcatatgaaaaaaaatcattgcccagactaatgtctgggtatatagaatgatttttaaataccgctttaattttaagtggattgtgagcatcaaaggagataggctctttggatagctattcaggatttccttcatttcaatggctgaatagtattttattgtgtacatataccatattttatcaattcatctgttgatggtcagaaaagatagttgatataatttaagtcttcttaaatttgttagacttgtttcatgtgtcatgtgatctgttctaaaaaataattcctacgctatgagaacgtatcttctcttgctgtttgattaaatgctctgtatatgtttgttaggtccatttggtctaaagtgtagttcaagtccaatgtttccttattgactttttggatgatctattcattgttgaaagtggggtgttgaagtcccttactattattgtgttgtaatctattcctcttttcagatctattaacatctgctttatgtatttaggtactgtgatgttggatgaacatatatttataattgttataccttcttggtaaattaatctctgtgttattatataatgaccttctttgtttctgtttacattttttgatttaaagtctgttttatctaagtatagctactttgttttgttttgttttgtttccatttatatagtatatattttttgatcctttcaattgcagttaataaacatccttcaaggtgaagtgaggcctggcatggtggctcatgcctgtaatcccagcactttgggaggccaaggtaggaggattgcttgagcttaggagtttgagactagtctgggcaacatgatgaaaccctgtctctaccaaaagtacaaaaattggcccatgtggtggcacacatttgtagtcctagccacttgaaaggctgaggcaggaggatcgcttgagcctatagttggggcttgtgagtttgtttttttttttttttttttttgcagggggcagggggaacctgttttttaatccattgagtcactctatgtcttttgattggaggtccaaatccatttacattcaaagttttatttctatacttttattatattttatttatttacaagtaatatactgtttattattgctttgtaaaatgtttaataatgattaaggcctaatccctattgctctcttttcagaatgttcctaactatcctaactactcatgtctattattttttcatttcaactttagaattatctttttaaaaaatcttatcacaatttattgtgatcatcttaaaaagttttttaagtatagagagaattggcatttttatgatgttaagtctttctatccaagaatataatatgcactgccattggtttggaaatttcttttttcttttcagtgtatttaggttcttatagattttgcatatcttctgtcaagtttattctggggtattttcttttttgtcattgtaaatgaggtatttaacaagtttttttggatgtgtttttctatatataaatgcagtcaatttttaaatatcaatttattctcatctaattcaacagaatttttgttattctgaatatttaaatttttttagtttttcacgtatataaattatcatttgcacataaagataattttaacttttcctttctacattttctactttttccttctataattgtgttagtacttcagaaaaatgttagtaattgttgtggttgtagatatacttgtcttatccacactttaatgggacacttctatttgttttcccagtaagcataatgttggttttttgttgttgttgctactgttggaatgctgttgttgggattaatttaaagaaattaatattgtcaaatacaaagtcttaaaaattcaaatatagatgttttattctataatgcattttcagaattggtggagattagacatacttgtatgaattgtctccttataaatattaaattattttaattagtacatttcttaatcctaaaccactctggcattcccaggctaaatctcaatttgtcagggtatatttttaaatgttctgctggtgctccttactaatatgttgtttgtttgttacaccgatatttggaagtgagattcttctgtagacttctttcttttctaatgcttgtccaatattgaaacaatagttaatttggaatcttaatttatctttaaagagtattgcaatagaatgttctttagatatttcattcattcttggggagcttttaataatatgtttctcagcttcattcccaaagacttagtaggtctttaagaataaaaatggtatacttggttattgagcctagaacagtgtctggtacatagcagtggacattcaaggaatacttgactgattaattataaatttggatttttaaaaaagctactcaaattgctctaatattcaaacaggcaggccttagaactgctgccctaaaccagttttctgtctaagcttgtatactgcctaataaataatactgctttgtttatacaacatactcaaaagcttgattgagtaatgaagacattaatacagaggtatttagagcttttgtttataaaatgtattctaatagcaactattagtccctttggcatacaatagcagagcaaatacttgtggcatccttttgaaaactaaaatgcttttttttgattcatcaatgaggtatctatatgatctgttaaaattaacggagagtggaggatacaaaatcaacatgcaaaaccagtagcatttctatacaacaataacaaactagctgaaaaaaagaaacaagaaagcaatgctatttacaataaccacaaaaaggccaggcgtggtggctaacgcctgtaatcccagcactttgggaggttgaggtggacgtatcacctgagatcaagagttcgagaccagcctggccaacatggtgaaaccctgtttctactaataataaaaaattagctgggcatggtggcatgtgcctataatcccagctactcaggaggctgaggcaggtgaatcactggaacctgggaggcagaggttgcagcgagctgagatcgcgccactgtactccagcctggtgacagagcaagactccatctcaaaaaaacaacaagcaaacaaaaaccacacacacacacctaggaatatattaaccaaggaggtgaaagatccctacaagaaaaactataaaacattgatgaaagaaattgaagagaacaccaaaaaatggaaagacatcccatgccatggattggaagaatgaattttgctaaaatgaccataccaccaaaggcaatctacagattcaatgcaatctctatcaaaataccaatgatatttttcacagaaacagaaagaaaaaaatcttcaaatttgtatagaaccacaacagactccaaatagttcaaagcaatactgagtgaaaagaacaaaactgcaggcatcatactacttgacttcaaaatatactgcaaagctatagtaaacaaaacagcatggtatttgtataaaaacagaaacctagaccaatggaatagaatagagaacccagaaataaatccacgtatttaaagtcagctgatttttaacaaaggtggcaagaacatgcattggggaaaggacaccctcttcaataaatggtgctggaaaacctggatatccatatgtagaagaatgaaactagactcctaactcttaccatatgcagaaatcaattcaaaatggactaaagacttgaatgtaagaccccaaactataacactcctagaagaaaatataagggaagcccttcggacattgttccctgcaaaaaaatgtatgggtaagatttcaaaagcacaggcaacaaaaacaaaaatagacaaatgggactatgtcacctgagaagcatctgaacagcaaaggaaacaaaagcataaggggacaaactgtagaataggagaaattatttgcaaactattcattcgacatgggcctatatctagaatatacaaggaactcaaacaactcaacaacaaaaaaccccaaatgatttgattttaaaatgggcaaaagatctgaatagacatttctcaaaagaagacacacaaatggccaaggatatgaagaaattctcaacatctctaatcatcggggaaaggcagatcaaaaccacaatgagatattatcccaccacagttagaactgatattatcaaaaagacaaaaaataacaaatgctggtgaggatgcagagaagagggaattcttatacactgttggtaggaatgtaaattagtacagccattatgcaaacatatagaggattctcagaaaactaaaaatataactaccatatgatccagctttcctactactgagtatttatttaaaaaatcagtatatcaaagagatatttgcatctccatatttatggaatcactattcacaatagccaagatatagaatcaacctaaatgtccatcaatggatggatggataaagagaacatgttatatattcacagtggactactacccagacataaaaataatgaaatgctctcattcacagcagcatgaatgagcctggaggatgtgttaagtgaaataagtcagatatagaaagataaataccacaaattctgactcatatagagtagcttaaaaaaaagttgtactaatagaagtagagagtagaactctggttattagaagctggggagggttcagagctggaaggataaggagaggttgattaatagatgcaaaaatatagctagataggaggaataagtttgagtagtattctacagcactatagggtacatacagttaacaatagtttattgtatatatttaaaaagctagtagagaggattttgagtgttcccaccagaaagaaatgatatgtttcaggtgatgcatatgctaattacactgatttgatcactacacattgtgtacatgtatcagcatatcactctatattccataaatatgtacaattattatgagtctactacaaataaaaggaaaaaaatgagctgagaagcatgttaccttttttgagcataaaagagaccttcttcataagtttgtacccaagtgatgtcatctccccatcctgaaatagaagagagaaatcaatgcagtaacccagaactagagaagagctcggaaatgggtatctaataatcagatatctacctacagatatttaactaagccatcaagctgttggctgacatatggtgcagaggacacacaattttcacaagatatggaggtgatttccctttagattgcagtactgaggttttgctactgcatttcaaacctcgaggcccatggccttgaacccagtaagtactcaatacatgttgttatgattagagctgattgaaaggacatctttggataatgtaaaagctgtggctttaggaacgcttggaaagtaacagttcatctttgcatactttgtaatattattaggaatcctttcggctgtactctacaatgccctcctattttgggtcccaagagatgttgacctcttctaagtcagtatacgttgtgaaataagggaattccaagttttgctttgaattctgacatggaaaaaattcttgtgtgggaatttcatggccaagagacataataaaacgcatgtgttttggaaacacccaaaagaatggagagaaaaaacagaaagcaatgaatatagagagaacccattagccttaaagaaatggtatgaatagttgggaatgtgtataagcaattaaagataaaatcatcaagtagaagaatgtgcagaacctccaaaaacattactgagtattttcaggaagtgtctcagtctacgaatgagagagattgaattaatgtgaaaattagcaatatttggaagtcagtttgggcccaggttttcttgtacatttcaaatgttgtcagaccacagtttctggctttaatatcatggtaaatatgatagtaatttgataaatatgattccatgatttttgcttgtttttcatgtttgttttctggcgacagctttattgaaataaaattcatacgccaatacaactcacctattgaaaacgtatacttttggccaggcatggtggctcatgactgtaatcctagcactttgtgagaccaaggtgggtggatcatttgaggtcaggagttcaagactagcctggtcaatacagtgtaatctgtctctactaaaaatgcaaaaattagctgggtgtggtggcatgtgcctgtagtcccagctactcgggaggctgaggcaggagaatcgcttgaacctgggggtggatgttgcagtgagccaagattgcgccactgctctccagcctgggtaacagagcgagactccatctcaaaaaaaaaaaaaaaaagaaaaaaagaaaatgtgtgcttttttcagtatatccacgaagttgtgcaaccatcatcacatcaattttagaacattttcatctcctcaaaaagaaaccctataccatttagctatcacctgctccccattttcttcaaatgccacagccctaagaaacccctaatctactttctgtctctatagatttgcttatgctggacatttcatataaatggaatcatacaatatgtaggcttttgtgactagattttttcactcagcataacctttttaaggttcatccttatagtgccatgtattattatttaattcattttttatggtcaaatattattccattgtatgaatataccatattttatttatctgttcatcagttaatgatatttgggttgtttccactttttgtcttttatgaataatgatgctatgaacatacatatacaagtttttcagtggtatatattttcatttatcttgggtatatacctaggagtggaactgctgatcaaatggtcactctgtatttagctttttgaggagctgccgggttattttctaaagtagatgcatcattttatatactcaccagcaacatttttgttttttgtttttttttgcctgatttaaaatcttaacattgaaaaacatctcttgttagtttaatgccacatcttaacaggaactcttgctctctgtaataatcctgaaagattctctttccaactttggttgaacacatgcaatatctatacatcacattttgcattaagtaaaagttattctaaaacagcaagtgagacgaggcctctgctgaattttccctcttctgttgcaaatatcattcaatgatggagcattagcagtggggaaaatttctattctctgctcctgctcaatttagttccacaaacagtaaaggaacatctgctgcataacttactccacaaagcagtgggaatacaaacatagagcaatataatccctattctcaacaaattgtccatagctctgtagaaaagccatattgcattataatgattttttatttactctgttataatcacaataggtcaaagctgttacacagtttaaatgcacttcatggcttctgctcattactctaattctagccctatctctatctctggctatattttcttgtcttttgagattttattcatttatctaacatatatttattaaatatttactatccgccaatcactggactaggtactcagcaattctgattcaaaggaaattggattttttttggatcattctatgtgtgtgtatttttttctccctgaaccttcttctacctttttctaattaatcttccttttctccttactgccttctctacttaactagtgctgccctgtgctctaaggggctccatatgccactctttatactgtatccagacttctcccactcacccctacctttaatcttcattcattctgagcctcattctctccattatctcccatgtagcaatagatggtaaaagactttgccaaatataaaccaattctcaataatggtgttctcagctaatatcagtcatcttctgtgttaaattagtttcttatcaattgaaataatagaacctttaagttgtttaaaatagggcatacaaatgtaatatattttttcaaaacattcaacaagagttttaaataaatatttagaagtgagcacacagaatgttgatgccttgacgtatagttatcacagtgctgcttaatg

SEQ ID NO: 769 - DNA, 310725 bp, Homo sapiens
ttggcaatcagcggtataatgttcacctattaagacaaaagacaaaatctcagcatcaaggattccttgttcatcctatagtttttatagtaaagccttcacaaactctgacaacaaattgtgaaactagataatcactggctgtcatgcctttcttaaaaattattttccaaagttatcaatacttttgaagattcatcttctatctaaattcaggtttacaagtctcaaccttgttgctcttttaaaaatcccttacacctctacacatatggagttagtaaaatgtaaatagtaggacaatgtaaattatttattttcaactttcttattaagctgagtgattaaagacaaattgaatgacatttcatcaaaattatggaagagattttgtctttctactttttccatcactttttccatcaattaatcttaattaatgtcccattttcacacactcttgccccacctagatgtgtttgcagatagatttgattttgttttccaaaggccacctaaaaagaattttttttttttgagacggagtcttgctctgtcacccaggctggagtgcaatggcatgatcttggctcactgcaacatccaccttccaggtttaagcgagtctctgcctcagcctcccgagtagctgagattacaggggcatgccaccacaccctgttgatttttgtatttttagtagagatggggtttctccatgttggccaggctggtctcgaacccctgacctcaggtgatctgcccacctcggcctcccaaagtgctgggattatgggtatgagccaccgcacccagcctgattaccacagtctaaaggctgtgtgtgtgtgtatgtgtgtatgtgtgtgtaagagcactttgcaaacaaatatactcattcttttgtaaaaagatgtaatttccacattggaagttgaatagttgcatatttgaggttgaatttttacccacaacattttttcctagtgcttcaacatgatcactgctgtgttttgcatttgcacttaaataaactttttagaaaataacaatatacaaaattataaaatgttttattactgttaaaacatcttattaaattatagctccacaaaatcagtatctgtaatacagtacaaatatataaatataaattttaggcagactgcttttgttttagattgctcaaagcatatttttcaaaaaatccatggacaagccaggcacagtggctcacgcctgtaacccagcactttggcagcccgaggcgggtggatcacctgaggtcaggagtttgagacgagcttcgccaacgtggtgaagccctgtctctactaaaaatgcaaaaattagctgggcatggtagtgggcacctgtagtcccagctactcaggaggttgaggcaggagaatcacttaaacccgggaggcggaggttgcagtgagccaagttcatgccattgcactccagcctgggcaacaagagcaaaactccatctaaaaaaaaaacattagccaggtgtgttggcagcacctgtagccccagctgctcaggtggctagggtgggaggatcacttcagcccaggaagttgaggctgcagtgagccgtgatctgacaaaaaacaaaaacaaagaaacaaaaaacaaacaaaaacaaaaactccataacctgacctcctcgctatgaacaaagctagataggacatctcttttctcccactgtccatcacgaggactgccacagcactctgtaagctccctcataaaggctttggactgatcaccctggcattttagtagttcgccctgtggaattcagccctatctccggaccatttggggtactcctttgtgggaattcccctgcaccacttttggggcagctctagccagccttgaatttgacatgacataacacagtgatggtaaatcattaacataaagaaatggaaacttttggctgggcacggtggctcaggcctgtaatcccaacactgggaggctgaggcgggtggatcacctgaggtcatgagttcgagaccagcctggccaacagggtggaaccccatctctactaaaaatacaaaaattagccaggcatggtggtaggtgcctgtaatcctagctacttgggagactgagggaggagaatcccttgaacccgggaggtggaggtggcaatgagccaagatggtgccactgcacttcagcctgggccacagagtgagactttgtcttgaaaaaaaaaagagagagagagagagaaagaaagaaagaaatggaaactttctatgtcaataattcctcaggtgttcagatttaagaggaaaggcattcattgcaaggagaacagaccaacttgaaaaagaagacaagcagggcatggtggctcacacctgcaatcccagcactttgggaggctgagaccagcagattgcttgagcccaggagtttcagacccatctggacaatatggcaagacccctctctctccaaaaaattaaaaattagccaggcgtgcaggcacacgcctgtggtcccagctacttgaggctgaggtgggagaactccttgagcctggacgatcaaggctgccatgagcctggttcatgtcactgcactcctgcctgggcaacagagtgagatcttgtctcaaagaaagagaaaagaaaaagacagtagccatatactcttgcctatccctttatataatggttttgtgaaaattagagattttatattctggaaaatggtttgatgataacagatgaacatgaaattaaaagtgtgtatcccagttgagtgtggtggctcatgcctgtaatcccagcactttgggaggctgaagtgggcaggtcacctgagttcaggagctcgagatcagcatgaacaacatggagaaaccctgtctctactaaaagtaaaaataaaaaagtagccgggtgtggtggtgcaagcctgtgtcccagcttcttgggaggctgaggcaggccaggcgtggcggcacaagcctgtaatcccagctacttgggaggctgaggcaggagaatcgcttgaacctgggaggtggaggttgcagtgggccgagactgtgccactgcactccagcctgatcaacagagtgagactccatctcgaaaaaaaaaaaagtcctatgcagtatgaatccacgttatatgtattatacaatatgtaataaatattatatatgcatatataatatagtacatggtacgtatactctatcatttacatatatgtgtataaatatttatatatctatacaaccacataaaaggataaacattatatcctgtcatataaagaataaacatttatccacataaaaggataaacataataccaagtagtattgaactcttaatacgttccttaatatactcacatactctcctactctatgttctatatgccatttaagtcttaaatttattttatacaaaatcatatacgcaaaagtgtggatctaacatgtgtacaatgcagacaataaaaataaatagggccaggcatagtggctcatgtgtgtaatcctagcactttgggaggccaaagcaggaggataactttaggtcaggagtttaagactagcctgggcaacatagggagataccatctttatcaaaaataaaataaaggccaagcgtggtggctcatgcctgtaatcccagaactttgggaggccaaggcaggcggatcacccgaggtcgggagttcgagactagcctgaccaacatggagaaaccccatctctactaaaaaatacaaaattagccgggcatggtggcacatgcctgtaatcccagctactaggggggctgaggcaggagacttgcttgaacccagaaggcagaggttgcagtgagccaagatcgcgccattgcactccagcctgggcaacaagagtgaaactgcgtctcaaaaaaataaaaataaaaataaaataaaataaaataaaataaaaagttagcaggctaggtgccgtggctcaggcctgtaatcccagaattttgggagactgaggcaggtggatcacctgaggcaggagttcgaaaccagcctggccaacatggtgaaaccccctctctgctaaaaatacaaaaattagccaggcatattggcacatgtctgcaatcccagctactcagcaggctgaggcaggagaatggcttgaacctgggaggcagagattgcagtgagccaagattatgccactgtactccaacctgggtgacaagagtgaaactccacctcacaaaaacaaacaaacgaaaaacattagccaggcatggtgacacatgcctgtggtcccagctgccatgggggctgaggtaagaggattgcttgagcctgggaggtcaaggctgcagtcagctatgattgtgcatcactacgctccagcctgggtgacagagtgagacactgtctaaaaaaaaaaaaagaaaagaaaagaaaaattaaaataaaaagaactttcatgtacccatttctcagctttggctagaacacaaacaagacctttatgctttccttgattgcaggtcaccatacccgcttggaagtctctgctatactgaaatttgcattaactctcttgcttatgtttattcattttctatggtggttactaaaacacgtaacataagggctatcctcttaaatttgtaagtgtacattacaatatttttaactataagcacagtgttgcacagcagacctctggaacttttcaatcttgcataatttaaactttatactcattgaacagcaacttcattttcctccacccacccccagcccctggtaaccagcattctactttctacttcaatgggtttggcaaccttagatacctcggattggtggaattaggctatgtttgttttttctgactggctcattcattcactttgcataatgtcctcaaggttcatgcacgtcattgcaaatgacaggatttctctctttttataaggctaattaatattccatttatgtatatgccatattttctctatccatttatcagtcgttggacatttacattacttccatgtattggctattgcaaataatgcttccaaggacgtgggaataaaaatatctcttcagcatcctgatttcaattttttggaataaatactcagaatctgggttgctggatcttatgacatgttttttgagacaggatctcattctgttggctgagtgcagttgtgtgattatggctaactgtggccttgaatgtctgggctcaagcaatccttctgcctcagccttcccagtagttgagactacaggcatgtgccaccatgcctggctaatttttttttttttttttggagagattgggtcttgttctattgcccaggctggtctggaactcctagcctcaagtgtctttctgccttggcctcccaaatgctaggattacaggtgtgaagcattgcacccatccaagaattcttggatcatgaaatcaacctaatttatttgagatgtgtggccacttttaatacattgctggtatcaatttgctattattttgattaatctttttgcatctatgcaagttcctcatttgattcttgcatggtgttgcatcaagtttatgctagattcataaaataaattgtagagtgctgctctttttccttgtccctaaaatagtttggataatattagaattatttctttcttgaatatttttaaacttcgtgaataaaactttctcagcttagtgctatctttgtgaaagttcttaaactgtaattttcattttgtaaaaagttattggttcattttgattttctattatttctaaaatatgtacgtttcaagttttctcttaggtatttgctcatttcactaagttttaatccattacttttttcaaaaaaagtttttacattttatttgtgctcttcttctgggactctaagaacacagatgttagaacttttgttattattccatgggtctctgacactgtcttaatttttttaaattattatttttgtttattctcttctgttcagattaatttctcattatctttttccacgatcatcaatttttctttgtcttctttatcttgctcctgagccccttcagtaatttttagagaattttggtagttgcataaaattttgattccattcttttaaaataccttctatttttctggtgaaactttctcaatttcattctatttcaacagtgttcaatcttacttcttgaagtatagttataacagctgctccaaagtctttgataatcccaccttctgtgtcaacttggtattcgtgtctgttggttgtctttttagctttgtgagatgttcagatttttctaattataaaaaattagaggccaggtgtgttggctcacaccttttatcccagcactttgggaggccgaggcaggtggatcacctgaggtaaggagtttgagaccagcctggccaatgcggtgaaaccccatctcttctaaaaatacaaaaaattagcaaggcctggtggtggaggcctgtaatcccagctacttgagaggctgaagcaggagaattgcttgaacccaggaggcagagggtttagtcagccaagattacaccactgcactgcagcctgggcaacaagagtgacactccatctcaaaaaaaaaaaattagaaattttaaaagttttctaattttctaattcttaatgtgttgagtaattttttattgtattctggacatcttacacactatgctctgtgaatctgagtcttgataaaatgctatagagtttttttttatttaacaggtagtaaccttgctagagtcagccacaaattcctaccgaccttctgtttgcattggttcattctagtgccaattctgtttacaaggcccttataagaggtattgagatgtgtcccactggtgcaccacctaagggccagtttgggattatgggattatgggatctgggtagagttctaacccatccttcagttctcaaaaactacagtttagcatcagattttatatatatatatatatatatatatatatatatatatatatatatatatatatatatatattttctatctatatatataataataaatatattctatctatatataataatatatatattcagttttcccctccaattttaatactttcaaattctagtggttcattgagatctttttcaaatcttcctgattatctgtacattctcttgtttatcattttcaatccacttttattattttgatatattcatttttatagcgttgctcataatcctagtatctatagtctttgtagatctgactttatactttgttgtttctgttggccgttgttcatagtgacttgttttcttcagagatgtgtttgtttattccgggttccaagagaatatacctatgtgagtttgctttaacctaacattttgagttgaagttttccaggacatatatgtggtatgaattctggcccaacttttcattatatatttgtcatcagggattctcagaggctatgttcttttttcagtcattcaacacagacctaagaaaaaaaccaatgaatttgtcaacattcatctctagagaacaggattttcatttaatgtatccagtgagggtttcattgctctaggcccccttctctatgacgaggcttctgacctgtccttctgttatgttgggacttcagactttgtttacatttttgtgtgtatgtttctctaacacccatgatagacaaacagtcatcctcagggaaaaagccagcttcaaaaactgcttatcattcttgtatcaatctttattattttttttaatttttttttttgagacggagtctcactctgtcacccaggctggagtgcggtggtgcaacctcagctgactgcaacctccacttccccggttcaagtgattcttctgcctcagcctcctgagtagctgggattacaggtgcatgccaccatgtccagctaatttttgcatttttagtagagacggggtttcatcacgttggtcaggatggtcatgaactcctgacctcatgatccacctgctttggcctcccaaagtgctgggattacaggcatgagccactgtgcccagcatcattctttattattgtttttcacttccaacttctatttaagctcagcatacttaaaatatgctttagatatgttgttgagcatttttaggtgttctatattaggaggtgcttgtgtgtgtgtgtgtgtgtgtgtgtgtgtgtgcgcgcgcgcgcgcatgcttggtctgatatatagctttaagtaaaagtttgttcataattttttcctaaattcactataaaataatgctaataagcacaccaaatatcagcagtggtttaattttgaaagtacttatgagttattttttctttaagttcttttaaattttcagaaatttaaagaggatcatttgttatttttataattagaaaaaagttatgaaagaaacattatcacaaggaattacatggtgtaaaggcagcaaaacaggaagttagcaataaataaaagaatgagatgagagaattcttcaaaagaaggaaattgttgagctgattataaaactagtactcgaattctgttaagtacacaatgaaatttccaataaattacatcgcaaagaagtatatgttaattttttttgttaaaagtaatttgaagtgtacttcccatacttgtcctgaatataaccttgactaaatctgacttcatataatttttgcaaaacttaaatgagataatagttgaaaaatgctagctcagatgaaacacccagttttgaaaattttagtagcattatattatggcaataagacttaagtaatgaaatgataaagcttctggttattaagctgctgattgtatcagagtcaaatggcatatacttgtgtttgaaattcaggtgcagactttcaatataagagagttcactttcctatattccagtaaacagtatcctaatcaccatcaatagcatttgtcaagcacatgatatgggtgtcagtgtttgctaagagagggaaaggttatataaggaagtatttacccttgaatttcaaataattgttatggggatatgaaaacatagacaattcccttatgcagctcagaatttattagaggccaaacaatatagacacaagtgaaaaacagagttgagctacataatctttaaatatcttgtaactaggccaggcgcggtggctcacgcctgtcatcccagcacttcgggaggccaaggcgggcggatcacaaggtcaggagatcgagatcatcctggctaacacagtgaaaccctgtctctactaaaaatacaaaaaattagccgggcgtggtggcgggtacctgtaatcccagctactcaggaaactgaggcaggagaatcacttgaacctgggaggtggaggttgcagtgagccgagatcgcgccactgcactccagcctgggtgacaaagtgagactccatctccaaaaaacaaacaaaaagaatgagagagaaagcagtttcagggttaatatggctaggaagcagtcatcagagagcttaaagtattctgtagcagtagttctcaaactttatcacctgtaaggcttgttaaaccacagattgcacggttttagtctcagcattcctaatctagaagggcatgggcagggtataagaatttacattctagggccgggcacagtggctcatgcctgtaatcccagcactttgggaggcttaggtgggtggattacttaaggtcaggagttcaagaccagcctggccaacacagtgaaaccccatctctacttaaaataaaataaaataaaaagctgggtgtggtagcacgtgcctgtaatcccagctactcgggaagctgaggcatgagaattacttgaacctgggaggggaggttgcagtgagccaagactgcaccactgctctcaaacctgggtgacagagcaagactctgtaaaaaaaaaaaaaataggttttacattttaacaggtttccaagtgatgctgatgctgatatttctggttctggggctgcactttgagaacctctgctctttaaaaaaaaaaaaaaaaaaaaaaaaaggatgcccttttgtgtaaatgggtctctaccctcacaccaatagtcccagaaccatatccagaacgagcttatctagaactaactacctattgcaatttgaaaacaaagatccctactctcacttcaaataaattaatcacatgttactcttattgggtgatggggagagtaaggaagaggagagtccaggacataatttgggagatggagtaatagagcccagggaagtcaagagacttgttcaagctccacagctcatggccaatagatagtctgtcaaattttcactatataaaattggcacaaaatgtgccaaatctgcatttagaacattcgtttctgattgccatagagaagacagaactaaattccaagtagaaatgatacttaagagatctaaatgccaaaggaacattggcggttttttttgtttttgtttttgtttttttttttgagacggagtctcggtctgtcgcccaggctggagtgcagtggcgcgatctcggctcactgcaagctccgcctcctgggtttacaccattctcctgcctcagcctcccgagtagctgggaccacaggcgcccgccacgacgcccagctaattttttgtattttttagtagagacggagtttcaccgtgttagccaggatggtctcgatctcctgaccttgtgatccacccacctcggcctcccaaagtgctgggattacaggcgtgagccaccacgcctggcctttttttttttattttttattttttacattattgtttttctgaaagcaagatatactactgagcaatggagaaaaaaattagaaacaataaaagtgtttatgataatgggagagaaacccattaagaattttattggataaggatgacaaaattaactttccctgttttcattttagaatcactgaacatttgtgtttccataataaaaatagcaatgaaaagaaaattggacacagcattacccttttctctctgtggggtggaggaggatgatttgtccttccttgaaagatgaggaaggcctaccatgggtttaattaaggaggacgttgtatgcagaaaaagagcaaggcttaaggtatcaccctgcaactgagttccccatgttgcatagtagttatgcgcttgggctctgcacttggactctgcacttggactatgtgattttgaatattgccatgggggccctccatttcagagcccctgtaccacctcatcaactctttctcacggttggaatagctctgactttctctttgcctactcttttaaatgagtttaaatggtacgtgtgattagattgtgcccacctggggaaacctcccttttgcttaattcaaagtcaactgtctagtgcaataatttggtagggtgccatcacaaaataccagaaactgggtggtttaaacaacagaaatgtatcatctcagcagttctggaggctgaaagtctgaaatagaggcatctggtgggttggaaccttctgaagactgtgagggagaatccattccatgcctctctcctaggttctcccagccttatgcactgacttgtagacagccttctccctgtgtctttacattgtcttccccttactagtatctgtctgtatacaaatttctcccccttttaaaaatcaggacataagtcataatggattagggcccaccctagtgacttaccccatcttcctatcttaacttgaacatctgtcaagaccctatttcttttctttttctttcctcctttttttttttttgagacagagtcttaatctgtcacccaagctggagcacaatggtgccatcatggctcacagcagaagttccagggttcaagtgattctcctgcctcagcctcccgagtagcagggattacaggtgtgtgcctaatttttgtatttttagtagagagaggattttaccacgttggtcaggctggtctcgaactcctgacctcaagtgatccacctgcctcggcctcccaaagtgctggtattacagacatgagccattgtgcccagcccatatttctaaataaggtcacattcacagggactgggagttaggaactcagcatcctttaaaacccataagaattagtaacctgaattaatctgcaaaataaatgaggaaacagaggccaaagaggataaaccactatcagatagactagaacccaggcacgagggctcgttacttcagcccttcatcctctgcgtgtgttcacaatctccatttaaatatatatgttgtattaaggactacagtagtaatttggagtttgggaaaatttcatatcctgctttgatggactggaagatgagacgtgctttacgcagagcctcttcatcaataggtgagtggctatgaaatgggggtaggaacccatagggaagaaactagatgatctgctgaaaatgagaagaaaaatgagctactggacctgccagctggcaccactgctcaagtggattatgaactgaatatagaaaatattagggaacaaagagttacatgaatgttcacagctgctctcctcaagtgcgtgacctcttcccaaacacattttctgaacgaatcactctcagcaggaaagtggtctctctactaggaataacaaacaagacagtctctacagctacttgggcaaagaagagcttttccatggaggggtctgctcttacctatgttttgcagaatgctctgcagagaaatactcactttgttcatgacttgtctaattcctggaaaacatcagcactgtaatttaggattagaatctgttgaaaagatgtgccagcattaaaaaaaattaagaaacaatgctgtgaacttcagactttctgagaaagtcagaattatctggaataatttggcccacacatttcctctcaattgagaacacaaggtttggaatcaggccaggtgacctaggttatagctctggctctaactagatgaccttgtccaagttacttaatgttcataaacctccatttatctatcaataaacaggcccaataatacatacatacctcatgaggatgctgtgaagatgagatgaaatccatcatcaagggatgttagccagaatcagaatcctcatcaccactacattctcaaagtctcttttgatccaaattgaacattttcaggaataatttttaaaaataaaatctatcttttctttgtaaatttgctttttactttaatgcttaatgttttggtcagttgaatgaactctttcagcatcctaaaattatgttaatattcaggaaaatattgcttactaaatttttttggattagaaaatagtgcatgaatgcagtaaattctcttgtcaggactgcaagctcactcaattgaaggaatagtgttttatttttcttatttatttatttatttagacagagtctctgtagcccaggctggagtgcagtggtgtgatcatagctcactgcagccctgaatatcagggttcaagtaatcctcccagctcagcctcccaagtagctggaaccacagatgtgtgctaccatgcctggctaattttaaattttttgtagagatggtgtcttgctatgttgcccaggctggtctcaaactcctgaacttaagttatcccccaaccttcacctcccaaagtgttggaattacaggcgtgagccaccacgcctagccagggaaaagaatactaaatgtgaacatcaagaaccttgatgttatttaacaaccttgtcactagccagggagatgtcctccagtgccttaaatcttggcttccttattcatcagatttagtgactaatgaggcataacggagtaagcaacaaaggactcataaaagaaaaggtctccatttggacaattgcaagaatgataatatttctacattgaaatatggaatttagaagaaaaaatggcttatgtaaaagaaaaactttttttagacatcgagttcaagaacgagtttaagaacagaaatttctagaaattagttggcaatctacaactggatttcagcagtaaagactgaaaacaaaattaggataatcgcttggacagaacatttgacgttattagagtgaatggtaagtttgataaatttatcgatatgaaaagaactagatggccataaattatctttgggaagaagagtgggaactagaggaagagaggtcaggggagattcacaatagcctatgcatcattataaatgtgcacatgtcctgtggtcaggcagtaatgtgtgaagatacaagtgagtgcatgcaatgaagaaatacaacttttgctaaaacaacatgctgatcaaaaagaaaaataaaaagaaggctagttgcggtggctcacatctgtaatcccagcactttgggaggccgaggtgggtgatcacctgaggtcaggagttcaggaccagcctggccaacatggtgaaaccctgtctctgctaaaaataaaaaaaattagctgggcattagtggcacgtgcctgtaatcccagctactggggggctgaggcagaagatcacttgaacctgggaggcagaggttgcagtgagccgagatcgtgccactgcactccagcctgggcaacagagcaagtctccatctcaaaaaaaataaataaataaaagaagaagaaaaagaaaagaaagacaagagaaaaccgtctttgggcctaacaaagcactgagtaggcatgaggttggggagtcaatgtccattgaatttaacccttaagaaaattttttgtggctttcaacactgctggttcattagaggagcagacaggttacaaaccatcttgctgggaatcaataggaaagtaaatgatgggaaagtagagagaaattctatgagtttaggtgtgaaaagaaggaaagactccatatggtagccaaaaggaatgaggaggggaagggaagagaaatatggaatctgcagggctagagggaaggaagcatattatcagggaacggtttaggtgagatcacagggcactcacatagtcaagtggagttaagctttgaaatgttagcctaaaatagtaataatctttaaatatttacttatttggcagaatgattagcttagaagcaaactctttgttaaaagcaacttctctgtttctggaattcatccttattattctaaataaaggtagagtgtaactagactaagttataatgtgttggtcttaaaaggtgtgatattaccttattaatttgaatgactggtgctgatttcctccaatttaaaaattttgtttagctagttctaacaatccccagggagtcttgttttgcttgatagctgcctctgatgctggcgcacagtcacctctttccaaccttctgcatccagcctttattttttttattttatttattttattttattttatttttgagacagagtctcgctctgtcgcccaggctggagtgcaatggcgcgatctcggctcactgcaagctccgcctcccgggttcgcgacattctcctgcctcagcctcccgagtagctgggactacaggcacctgccaccatgcccggctaattttttgtaatttttagtagagacggggtttcactgtgttagccagtatggtcttgatctcctgacctcgtgatctgcccacctcggcctcccaaagtgctgggattacaggcgtgagccactgcacccggccagcatccagccgttatgagaaggggagctaacaaactaattagactggtagtttaaaaaaatatcaatcttggtacatacccaggccaaaaagtcttacatttaccgaaacagaacatttgcgtctgcccaactatccaagactgttaacctcaggcttttatctcacacttaaaaactggttttattttgcactttggcatactgtatagaagtttgacacatttgcaagataagaactacattcgaaatgatgagatctacattgggaaaattatgtgtgaacaaatttggagacataactgaacagtttgtcattgatggaaatgtgcaagctctgcctcccaacttcaagtgattctcctgcctcagcctcctgagtagctgggactacaggtgtccaccaccatgcctggctaatttttgtatttttagtagagatggggtttctccatgttggccagcctggtctcgaactcctggcctcatgcaatctgcccgccttggtgtcccagagtgttgggattacagccatgaaccactgcacctgcccaaaaaggggttaatttcttgtactgcttaaagaaaaaaatttaaaaattaaaaataaaataaaataaaaacatgtattaatagttggcttgtgaaatatggtattttttgcccagctcctggtaaaattgtttttactgaacatgactatcatgtcagtagggttttagttatcagtgccagaaaggaagtcaaagataagacacaatatttctcaatccactggccacctgcatcagaattacttaaggtgttgttttaaaaaatgcagcttctggccgagcatggtggctcacgcttgtaatcccagcactctgggaggccaaggtgggtggatcacgaggtcaggaattcgagaccagcctggccaatatggtgaaaccccatctctactaaaaatacaaaaattaactgggtgtggcggtgggcgcctgtagtcccagctgctcaggaggctgaggcaggagaatggattgaactcgggaggcagaggttgcagtgagccgagatggtgccactgcactccagcctgggcaacagagcaagactccgtctcaaaaaacaaaaaattgcagattccaagttttcatactggatctactgaatctctgcaggagagtcctgctaatttactattttaataaggtcttaggtggttcttatgaaaaccgaagtttgagaactagattttgaaacatacaactatacttagattcagcactgttcagagggagcaaaaattgtcgtatcctttataatgtgccaatttttcatgcaatctctttaccagaatttaaaatgtacacatcctttgacacagccattccatttctaggaatttatctgacagaataattgaataaatgtgcaaggatatatgttaaaaaaaaaccatccattacaaaattgtctattgtaggagaaaagtcttaataacttaaatgcctatcaaggaatgttacatatcaggtactgttctaagcacttcaaaagcagttaagtcatttcatcctcataacattatatagtaatagaatataaaatatatattaaaatataatcttaataatattattatccctcattttacagatgacaaagctgaggcacagaacagttaagcacttgtccaaaatcacactgctggtacgtggcacagccaggtcacaaagccaggttgtctggttctagagtctgtgggcttaatcctgcactatttgcctctctcaacattctgctgccttcacataatcattatataaattttttaatttacaaaaattaaatttaaaacatgagcgagctagtataggtggctttctttttctttttatttatttattatcctttaagtcctgggatacatgtgcagaacatgcaggtttgttacataggtatacatgtgccgtggtggtttgctgcacgcatcaaagtgtcatctacattaggtatttctcctaatgctatccctcccctagccctccaccctgtgaaaggccccagtgtgtgatgttcccctccctgtgtccatgtgttctcactgttcaactcccacttatgagtgagaacatttggtatttagttttctgttcctgtgatagtttgctgagaatgatggtttccagcttcatccacgtccctgcaaaggacatgaactcatacgtttttatggctgcatagtattccatggtgtatatgtgccacattttctttatccagtgtatcaatgatgggcatttgcattggttccaggtctttgctattgtgaacagtgccacaataaacatacgtgtgcatgtgtctttatagtagaacgatttataatcttttgggtatatacacagtaatgggattcgtgggtcaaatggtatttctggttctagatccttgaggaatcgccacagtgtcttccgcaatggttgaactagtttacactcccaccaacagtgtaaaagtgttcctatttctccacatcctctccagcatctattgtttcctaactttttaatgatcaccactctaactggtatgagatggtatcttattgtggttttgatttgcatttctctaatgaccagtgatgatgagctttttttcacatatttgttggccgcataaatgtctttttttgaaaagtgtccgttcatatcctttgcccacttttgaatggagttgtttttttttttttcttgtaaattggtttaagttctttgtagattctggatattagccctttgtcagatggatagattgcaaaaattttctcccattctgtaggttgcctttcgctctgatgatagtttcttttgctgtgcagaagctcttgagtttaattagatcccatttgtggattttggcttttgttgccattgcttttggtgttttagtcatgaagtctttgtccatgcctatgtcctgaatggtattgcctaggtgttcttctagggtttttatggttataggttttacatttaagtgtttaatccatcttgagttaatttttgtataaggtgtaaggaaagggtcgagtttcaattttctgcatacggctagccagttttcccaacaccatttattaaatagggaatccttttcccattgcttgtttttgtctgctttggcaaatatcagatagttgtagatgtgtggcattatttctgaggcttctgttctgttccattgatctatgtatctgttttggtaccagtatcatgctgttttggttactatagccttgcagtatagtttgaagtcaggtagcatgatgactctagcttttttctttttgcttaggattgtcttgctatatgggctcttttttggttccatataaaatttaaagtaattttttctaattctgtacagaaagtctatggtagcttgatggggatagcattgagtctacaaattactttgggcagtatggccattttcatgatattgattcttcctatccatgagcatgggatgtttttccatttgtttgtgtcctcttttatttcatggagcagtggtttgtagttctccttgaagaggtccttcacatcccttgtaagttgtattcctaggtattttattctcttagtagcaattgtgaatgggagttcacttatgatttggctctctgtttgtctattattggtgtctaggaatgcttgtggtttttgcacattgattttgtatcctgagattttgctgaaattgcttatcagcataaggagattttgggctgaggtgatggggttttctaaatatacaatcatgtcatctgcaaacagagacagtttgacttcctctcttccttttatttgtaagcccctgactggggctgctgcctttctttcagagatgccctgcccagagaggaggaatctctagaggcagtttggctgcagcagctttgctgagctgcagtgggctctgcccagttcgaacttcctggtagctttgtttacactgtgaggggaaaaccgcctactgaagcctcagcaatggtaaatgcccctccccccaccaagcttgagcatcccaggtcaacttcagactgctgtgctggcagtgaggatttcaagccagtggatcttggcttgctgggctccatgggggtgggattctctgagctagatcacttgtctccctggcttcagccccctttccatgggagtgaatggttctgtcttgctggtgtcccaggtgccactggggtatgaaaaaaactcctgcagctagctcagtgtctgcccaaatggccgcccagttttgtgcttgaaatctagggccctggtggcataggcacctgagggaatctcctggtttgcgggttgtgaagactatgggaaaatcatagtatctgggccagaatgcactgttcctcacggcacagtccctcactgcttcccttggctaggggagggagttctctgaccccttgtgcttcctgggtgaggcaacaccccaacctgcttcggctccccctccataggctgcacccactgtttaaccaggcccgatgagatgagccaggtacctcagttggaaatgcagaaatcacctgtcttctgcgttaatctcgctgggaggtgcagactggagctgttcctatttggccatcttgccagccacctagacctgtttttctgaattagaaattttattttctattcaatctttcttttactctaccacaaagaaataagttttctcttttgaaataaataacatttgaaaaaatatgtttgatatgatcatgttcatgtggaaatgcatatttatgtatgcattttaaaattaaagaatttttaagaaaaggataggccttagaagtgggcacacaaagttgaagacagtggtctgtgagtgaagttctgagtgttttctattttctgccttttgcttgtctatggttccttttcattttcccactaattaacatactttgttcttgtaaaatgaaaaacacaacagcaatatgtgaatgtgcctaccatgcaaatatgtataaagtttatgcttttgtaagagtggcttttaaggataaatagatgaaattacaaatagagatgagggaaaatatatcttcttacactgttttatagttttgcttcttaaaactgtagagctcatgcatcaagtagactggaaggtcttctgatgctcaaacttgcttattttcatcatcgatccacttcagtaagagcagatctcagagaacaaataaacttttctattcccatattctccttcctgcatactagtccactgtgtttcttgcctgccactcttctcagctaggtttctttttcatgagcaaacaagtataggtggctttcctttttcttaattagcaattttattttctattcaatctttctttttctctaccacaaaagaataagatttctcttttgaaataaataactttctttgcctcatctattaactggatgtgatacatttatttcatgaagttatcttgggtccttcagggaagccagctttattcagaacaatctgaattatatgcattgataaaccaatcagttgtgattcatccaaggtgacagaatttacgagggcttcaaagtggctatcacactaaactctgggcaatattaatgttgggctaactgaaaattataactaggacatttcttgaacttattttcctttagtacaggcaggtaaaattggttctcttcgttttataaatgtcattcttcaaaaagaatctggtagtacaagatgacttgcttgctttctgaatattttaattatggattgtcgctggtaagttatttaagttattttaattgatcatattgcttttaaaaatgagactttaaaaatatttttaatttgttctcaatttggggggtacatacacaggtttgtttcaagggtatgttgtgtgatgctgaggtttgggcttcacccagatagtgaaccaagtgccaaatgggaagtttttaaagccttgcccctctcccttcctctctccttttagagtcctcagtgtcgattgttcccatctttatgtatgtgtataaccaagatatagcgcccacttataagtgagaatgtgtgatatttgattttctatttctgtattaattcgcttaggataatgacttctaggtgcatctgtgttgctgcaaaggacatgatatcattcttttttatggctgtgtagtattccatgatgtataaataccacattttctttatccagtccactgttgatgggcacctacattgattctctgtctttgctattgtgaacagtgctgtagtgaacatacagtgcatgtgtctttttggtggaataatttatattctgttgggtatgtaaccataatgggattactgaattaaatggtagttctatttttagttctttgagaaatcttcaaactgccttccacagtggctgaactaatttacattcccaccagcagtgtataggcattcccttttctccatagccttgccaacatctgttagtttttgactttttagtaatagccattctgactgatgtgagctgctatctcactgtggttttaatttgcatctgtctgataattagtgatgttgagcattttttcatgttagttggctccttatatgtcttcttttaaggagtgtctgtttatgtctcttgcccactttttaaatgaagtgttttttttattctcattgagtttaagttccttatagattctggatatttgtcctttgttgtacgcatagtttgtaaatattttctcccattctgtaggttgtctgtttactctgttgatagtttcttttgctgtgcagaagctctttagttcaattaggtcccgcttgtcaaattttgcttttgttgcaactgcttttggagactttgtcatgaaatctttgctaaggcttatgtctagaaaggtatttcttagattttttcctagggcttatatagttttaggtcttacatttaagtctttattccattttgagttatttttgtatattacgaaagaaggggtccagtttcaatcttctgcaacgttctgtatatggctagccacttatcccaacaccatttatcaaatagggtcttctttttctattgtatgttatgttcgactttgttgaagatcagatggttttaggtgtgcagctttatttctggattctctaggtctatgtgtctctttttgtaccagcaccatgctgttccggctactgtagccttgtagtatagtttgaaattgggtagtgtgatgccgctgttcttttagcttaggattcctttggctattcaggctctttgttggttccatatgaattttagaatagttttttctaattctgtgcaaaatgacagtggtagtttgattgtaatagcattgaatctgtaaattggtttgggcagtatggcctatataacgatattgattcttcttatctatgagcatggaatgtttttctgtttgtttgtgtcatttctgatttctttcagcagtgttttgtaattcttactgcagatcatttacttccccagttagctatattcctagttattttaatctttttatgggttaccaattttctagcaaaatgttaaatattaactaatgaacattaatcctttttgaaagatattttttctaaaatatattactacgtattttacattttcctaccattgtaattttgataattttgtctgtttcctttttaaatcaaacatataaattaactttattgttaaatatagaaaattccttattgaatgactataatgattataagcacacacgtaattatgttctctgaaacattctgcataatttacaatgaacaataactctttaaaaagtatttcaggtgattgtatataggatcaaagtcttctgcatttacataatgtcaaggagaagtagttattggacatgttccaaagagctaaacaggtgggtaattgaactataactggtaaagtatattgcttggtcttttatgatacaagtcctttccattctgagtttttaaatccaccctcaccccaaattttagatattaaaaaattatttctactattgccgtttcacctgccataaaaaatgctcattcttagcaataggtaagtatataatatctaaataattgaaaaaaaagactcaaatattttaattgagtctattcgctataggtagtccattcagtggtataactgagaggaactcaggatttattgctctgggtaagtaggaaaaactctgaaaaatgtggctaatattgagtttcaaatggctcttgaaattgctcgtgattatccacaaaagcatacactgagttgatgtacgctaaggtaacaaggtaaagcgttaaggcaatgctttttgagttggtgtatctgtttgattctcatttttccatatcctcatatataaaacgagacaataataatgatctatcaagattactggaaggtggtaaataatgcataggaaactgcctgccacataactcacaattagtattagcctcttccccttgcatgataaatatcagtggaatatctacagactttttaatatgatggaattatttttcattcattctgcaaatctttattgaacaagtcagtcagggattaggcatgaaagcagaagcctctcaatatattccaagtatgaatattttcaatgcagggaattagaggcttacccagttgttagaaggctgcagaaaccaacgtgaagaaggctgtcagcaacaatctcagcctttgcactatgaggttctcaagagcttgcacaaaagacccctgaaagaacctctgggagattccctctgacctctcagtctgcaggagtgatgcaggtgattttcaggaagctcacctggaaactgcctcaaatcttgtatcttggtcatgtggctgcagccgcttccagaaaataatgacccctttctcttccaaatcttgtgcacgtgcttcccattgcaatgggtttttgggaaatgtcattctcagcttctcctgcagtggagaccttagagaggggtagcagtgatgccaagttgaccctaggtaatccagcacaccaactaagtgcagagccctgtgctcaatgttgtgaggaatacaatggtaactcatatgtggatcttgtttccatcctgctcccaatgggaaagggaggataagacatgtaaataaaaccagtagtccaaggcagaagactcaggtggaggcagaggcaggaacaacgctgggcaaattggtgaaagaaagatgtttttcagtcagggaagggagaatcagggaaggcttcatggaataggtggactgtggattcaacttggaagaaccagtaagtttggggtataagtaaatatggaaaagcagggaattccaggaacatgaaaacattacgaagagaaacacagaaatagaaaagagtgtagtgggttttgagaatattattaaatggaagaaaagtattattgaaaaggaataaaatggaggggatatcccgaaaagtagttattatttaatcagaagatactattgccaaatatgagtttgaaatctctttaataggaaatggggaggaatttaaggttttgagagtatcatgattcacttgtcccatgaggatgactccttaccacaattctattatgcctgtattactcctgcaatacctccactagacgctactacatattctggatgtgtgcaaattcagtacgcacaactatacttaggcaccctcttaatcctccatttaataggttgatagaagaaattgaagctcagaaaaataatggaacttcccacgaccacacagttgatggaactggaatttgaggctagtactttctgattccaaagctaaaattatttccactacaagtttctataccaaaccttcccccatcctaccaccggcagccccaccaaattaaaataaaaatcccctcagctgctttttactccctttttctaactgtatagatcttattctgaatcctgagaaatagtcagggggtagtaagtttgatctccagttgaagatcaaacttacaatcttggtttctcttcatatacatattacagtacaaatattatgaagttttacataataagagaagattctgaaagttgtttttcatccaacctaatttcaaggaaactcagtcagcaaatgttctgataatgcaaatactctcaacccatgtccttcaggcatgaaaatggttctgggttaaaggtgactattctgcttagtagatcatataacaaatcttaaaaaaatcacttcgtctttacttatacatgcattacaatacaatcatcatgtttaagatgaactcatgtcttgtcttgtcaaagtttacaatttcaaactgtgaccccaaacatacccagcccatgtttctgaccttactcatcaatatttgcattcttattcttggctgtttcaactctgtgccacgggtttctctgcctaaaattctcatctccatatatccaaattctactcattctttaaaccccaatataaattccattttctgatgaagtctttgttcatcagtcgcccattattaccccgctaaattttctttcctctgacaatcccataacactttatctgaatcactcctagtgatgtcgagtcacattttaattagttattttcattttttatttgtatacatttgaggagtacaagtgcaattttgttacatggtgtattagtcagggttctctagaaggacagaactaataggacagatgtctatataaaagggaatttattaaggagtattgactcacgccatcacaaggtgaggtcccacaatagactgtctgcaagctgaggagcaaggaagccagtccgagtcccaaagctgaagaacttggagtctgatgttcaagggcaagaagcatccagagtgggagaaagttgtaggcttggaaactaagccagtctagtcttttcacgttcttctgcctgcttgtattctggtcatgctggcagctgattagttggtgcccatccagattgagggtgggtctgcttttcccagttcactgactcaaatgttaatctcctttggcaacaccctcacagacacacccgggaacaatactttgcacccttcaatccaatcaagttgacacttaatattaaccatcacgcatggatatattgctcagtgaagtctgggtttttagtgggtccatcacctgaataatgcacattgtatccaaaaggtgatttctcatctcccaccctccccgaacctcccacccttctgagtcgccaatgactattattccacactgtgtgtccatgtgtacacattagtttacattttaattattaatgtatagtcatgcaccacatgatgcttccatcaacaatgaacctcgtataccatggtcctaatagtcctgaggtactgcactgtcccttatggttattttttacacacagatcagggctgtggtgcaggtataaataagggacttagtgtgaaggtgtttatggataagagtttgaaacagagtttgatagaacagaaattgatcagagccttttatttttcataactaaggttaaactccctaagggaattaccacatatgtcataaagctttaaatttgctgcctaacgttagcagtataccatgaattcttgtaaagaataaaattatgcttgcttctttaattccattctgtaactcagactcttactttgtcagtctacacatgcctacaattagaatgaataaataataaaaatagtaaacattcaacatagcactgtattatgcaccaggctctggtctgagcattttactaaacaatgcaattaatacagcaacactgagaggtaggtactattttttcttttttattttttcttttttttttttgagatggagttttgatcttggtgcccaggctggagtgcaatggcaccatcttggctcaccacaacctccacctcccgggttcaagcgattctcctgcctcagcttcctgagtagctgggattacaggcatgtgccaccacgcccggctaattttgtaattttagtagagatggggtttctccatgttggtcaggctggtctggaactcccgatctcaggtgatctgcccgcctcggcctcccaaagtgctgggcttacaggcgtgagccaccgtgcctgtccaaggtaggtactattatcaccattttaaaaatgagaacctgaggcccagagaggttaaataacttgtccaatgttacacagtgaatacttgtcaaagctagaatttaacgtcaggtagtcctagttaattccctagtcagctttttcaatcatactggatttgaagtccttcagaaacaaaagcaactcaaaacaggtaatcaaacaattccgactactgctgcaatcataaaagcagaaaactttcggccaggcacagtggctcatgcctgtaatcccagcactttgggaggccgagacgggcagatcacttgaggtcaggagttcaagagcagtctggccaacatggtgaagccctgtctctactaaaaatacaaaaattagccaggcgtggtggctcacgcctgtagtcccagctactcgggaggctgagatgggagaattgcttcaacctggcaggtggagcttgtagtgagccgagatcacaccactgcactccagcctgggtgacagagtgagactccgtctcaaaaaaaaattttaaaaaggcagaaaactttctcatcgatgctttatgaagtgaatcactgatttgagccaaagaacctgccactatttaaagtgaattctaatataaagttggacaatatattttattctcatatatgtgatagttaccattttataatttcagtaatgtgacttcttcatcacaagtattgctttttagttgatggatatgaaaatgtgtgagaaaaatccccaaacctctgaatctgtaaaatgcaacgtggagcttatcatcataatgaaatatgtccatacaaccaaagatagtcctcaacttatgattttgttactttccaatgggtttatcagggtattaaatgcattttcaacttatgatagttttttatttgcaacaggtttattgggatgtaaccccactgtaagtcaaggaacatctgtataattattttgttataaatatgtaaataccagaatgtggaagactatatagctaaataatattaacctttattgagtgtttaccaggggccacattctgtactaaatgttctgattgtgtcatctcgcctgattctcatgatatcgtgatgagatcagtctattaccctgattttagaaatgaggttgaagacattaacttgtgtatatgaagtttccgaggagataagcagtgggaccaggatctgagtatgtgtgggccccagctcagcaacgtaatgatgcaaaaccacggcaaacagtccaatccaaaatgagaacatgaaaccatgtccctggtggtcctcaatctccatgtctgtcagaattgcttgtggagcagtacaaaccaaacaaaaacttccatgcaggtctgtctatttttgtagattcttattctttaggactgaggtgatatccaggcctctagaattttaaattttaacaaaggtgattctgatgcacaatcagaatgaagaaccactacgttctgtacattctgcatagtgtctgtagagatgtagaaacatttctttttaattacatgaatgctacgtgaaattttcattgaaagattcaaacaatgtagaggtatacagagcaaaacaaatatagacacatttccattctatcatatacattgttattctatttcaggtatttctagcatgcgttcttattaatgcactgattacatcagttcttttgatctaagggtcagattaaaatgtaagatgagattttggccaaaacagatcgcacatttctattggtggattttgtattgctgtgtatcttgtcttccataaatcaatgtcattatcttccatattcaaaagttcctgctgattgtgcaggtacacacacaaggctgtggagtcggttgtgtgactcacagtaggtgccttcataatttgttccctgcttagtcattcttggcaggagctgtcactgtttgcagctctgcctcttttttcccatggactacatggccatttggtttaaaataattcaacttttatctgactgctttaagatatcttgatccatctgccaggcgtctcccagcctttcctgctgaggagctcatttggatttttctggaacttgtgttctttcctaatcctgggactggggataaagagaatggggttcattgacaaagtcacccacaagggaattctgactgtactggagtctaattcaggcagccgcctgccataccatcttccttgcgagattccccagcactgtggggaagggagtgagccaacttagagactgcagccagcttagagactgatcctgtaagggttcaagaacagccagtggatcactattgacttactagttcatccgagttcagtggcttttggtctcttataattatttctttctactctaaagaaggttctttggaaccactttatagtgtctctttaatcagtcagatctgatcaacaaaacaaacctcgttaagtcattccaagaagttatgaagatactgaaaagtgctattatctccaaaataaggtagaaaaacagaataagggagaatttccataccccatccagaatctcacagtgtacagatctttcatgcgcctctccagatccagtctctacccttcttcacctgctctgtgcccttggaggctcatctgtaggggctatgtcattgcttccagatgggcatactacatagggaccactggcaggaaatcagcaggaagaaagacaataaagttgaagtacttatttcctcgggtccctctttttggggtcacagggaaaagctggacccataaactaaagatacagtgccaggtaagtggctttgtctacacagccctcttttctttaaaatttcaccagctgttccctctcctctccctttcagcctttgatgaatagcagagtcctgctgctaccagcactgtggtgtcgtgctgatgtggtttgtctctgtgtccccacccaactctcacgtcaaattggaatccccagtattgacggaggggcctggtgggaggtgattggatcatgggggtggatttcccccttgctgttctcatgatagtgagtgaatctgcatgagatctggttgtttaaaagtgtgtagtgggccaggcacggtggctcacgcttgtaataccagcactttgggaggccaaggcaggtggatcacgaggtcaagagatcgagaccatcctggccaacatgatgaaatcccgtctctactaaaaataaaaaaaattagccgggtgtggtggagcacacctgtggtcccagctactcgggaggctgaggcaggagaatcgcttgaacccgggaggcagaggttgcagtgagccgaggtggcaccactgcactccagcctggtgacagagcaagactccgtctcaaaaaacaaacaaacaaacaaaaaacaaagtgtgtagcatctccccctgtgctctcccttcctcctgctccagccatgcaggacatgctggctttccctttgccttctgccatgattgtaagtttcctgaggcttccctagccatgcttcctgtacagcctgcagaactgtccgccaattagacttcttttctttatgaattacctggtctcagtagttctttatagcagtgtgagaatggactaatacatgttctcttcctagtaatttttccacatactgtccatgcttttgtacatcatccctttattaactactcttcttaaattgccttatttcagtgtgacatcttgttttgctgggacccatataaagcatttagaggacatctctgtaattctccaaaatagcacaatgcctagaaacacactagcattttggattatataaagtaggcagccctgaaggttgagtgcagcaatattctctctatatgatttccagaaagacatgttaatagggctttcacatgctgtagatttccaacaacacctgaaggaaacttctccctcatggataccagccccattctctttattgcctcaaccaatctccttggacttctacctcattcatttacaccaactacccaattatcttagcaatatattcattctgaaacttaatccaaagattttagtaaatatccattagtcagtttccaatgtaaaaaatataagcttttaccttaaggtaaaaaggttttatttgggaattatatataggaaggattagccgggagtggtgtctcacgcctgtaatccaagcactttgggaggccgaggcgggcagatcacctgagatcaggagttcaagaccagcctggccaacatagtttaccctgtctctactaaatatacaaaaattagtcaggtgtggtggcaggctcctgtaatcccagctgcttgagaggctgagtcaggagaaagaatctcttgaacctgggaggtggaggttgcagtgggctgagataaaaaaaaaaaaaaggattgcaatctggtacatacatacctacaaactagggtgacttttggtatgtctgaaaaacaagaaaagattagaatttattggggaaagagaaggttacacaacttgttttggaaaaaagcttattggcacccggagtgtcttacaagaattggctgagcataactatgtactaagcactgtgctattctaatattgggtattattgtaacaagacttaaggtaaattttccattggattaaaaacatacaaagcaaattatttatattggtagacactatatgcctatatgtgtacttagataaacttatgtatattaataagcaaaatctaatattaggacaatttttaaaccatattttaagaagtgcattttttgtcattgaaaaatgtcaaagaacaaaataagacacacttctataacctcatctggattcattaagcagtaacatttatgccatacctgatatctcttcccctatttcctccaaccccctcgctctctctccatatgcacacacacacacacacacacacacacacacacacacacggacacatagacagaaattcccttttctcaactgtccaaaaattaggctgcagacatcaggacacttcattcctaagtatttcagttctcaagaacaggacattcttctacagaaccacagtaccagtaccacaccttagaaaatcattactagccgggcatggtggcacatgcctgtaataccagctactccggaggctgaggcaggagaatcagttgaacctgggaggcagaggttgcagtgagccgagatcgcgccattgcactccagcctaggcaacaagagcgaaactccatcttggggaaaaaaaaaatcattacttcaatagtaacatccaacacgcagtccatacccaaatttcctcaattgttccattatgtcctttattgttagatttgttttttaatccaggatccaatcaaggttgataaattacacttggctgctgtatatgttcagactcctcatattttgatttgtaccattgcttccctggtttataataataaagtctttgaagagacctgcagaacaccccatattcagatttttttcctcgtcgttaggctcaatttgaacatttctggcaagaacaccttgtaggtgatgctatttccctcccactgcataagttcaggaggcagaacgtcaggctattccactagcagcaatgtcaagctcaaccacttggataatatggtgaactctctattataaagatgtattttgtccttttgcaattaataagttatctgggccaggcgtggtggctcacgcctctaatcccagcactttgggaggctgaggctggtggatcatgaggtcaggagatcgagaccacggtgaaacaccgtctctactaaaaatacacaaaaaaattagccaggcgtggtggcgggcacctgtattcccagctactcgggaggctgaggcaggagaatggcgtgaacctgggaggtggagcttgcactgagccaagatctcgccactgcactccagcctgggcgacagagcaagactccgtctaaaaaaaaaaaaaaaagttatctgtgggccgataccttaaaacagcaagagtattctgttcccccagaacttgtaacctaatgatttaagcatctatctatctatctatctatctatctatctatctatctatcatctatctatcatcatctatctatctatccatacatacatatatttttcgagacagtgtttcactctgttgcccaggctggagtgcagtggcacatcatagctctctgtagcttcaaactcctgggctcaagtgatcttctctttttgccttcccaaagcactgggattacaggcatgagccactgcacccagccctaagcatttatttttaatgactcaaatcaagttttacattggaggttaaaaaataattttctcattctatcagtccttttatatttattagtggatgaaataaatatgctttaataaacactgaataaccagccaggtgtggtgactcatgcctgtaatcccagtattttgggaggccaaggcaggaggatcacttgaggccaggagtttgagatcagcctctggtctctctctctctctctctctatatatatataatatatatatatatatattatattatatatatttatatgttatatatatacatttatatataaaaatctttctctatatatataaatttaaaaataaacactgaatgaaatgacaaaatttcatcaactaagcaaagtgataaaaattttatcaccaggccttaggacttatgaaattctgatctccagccgttcaactagtctctccaagttcaaaggtagataatggcatccaaaagtgcctgggatacctcaggatttcagttcatttccaactacaccacaccccgagccaatcacttaagccaagtactttcacacatcaatttgagtgttaccacctctaggaagtcggtcctcattagccccaggtagagacagttgctctcatttgtgcccaagccatccacaaagctctgtcagggcatctctgacacttcattgcacataattactgttgagtttatttccctcctctggagaagccaagggagaataagaatcttgtcttactggttttctcacccatagcatctaggatgatgtttaactgacgttgaattcacagacatactctatatcatctaagaaaacccctgacggtaaagtgggatgtatgtcatttgtttgttttatgcagagaaaaattcagagaggttattttcagaggtctgattttgtatctacccaagaataaatcccaatgatgctcattcagtagtttagggatttccaggaataggaaaacatcccacatgttctgtcataaaatgcctcgctcatttctccaaaccttcccatcttgaatattctttccatttttctgattttttttgagacaaagttttcactcttgtccccgaggctggagtgcaatggcgcgatctcagctcactgcaacctccacctcccaggttcaatcaattctcctgcctcagcctcccaagtagctgggatttacaggcacctgccactatgaccagctaattttttgtatttttagtagagacggggtttcaccatgttggccaggctggtctggaactcctgacctcaggtgatccacctgcctcggcctcccaaagtgctgggattacaggcttgagccaccatgcccggccatttttctgattattaaagctattatttggtaacagaaacagagacaaggaaagactacataacttgactccaccatatactcttagaacataaaggggccaggatttccttggacagtccacagcatgggcttgaacactttcataatagagccttcatcttgttttggtgcagaccgagtatcaggcctgagaaagaagaaccgcttaaagaggaattgttagtctcctcatttacgggaggaaatccatctcaaagggggatcaggtaacttcccaagtaatggctagtaactagtaaaactagggttctgaacccagatgacctgactccacaggtagaggtcttcatggttgatccactgcctctttaaattcccctttcaaagtccaagagcaccttctttcttataattagactttacagaggaagggaaatccgcagttgtgccaaggctaacaccagctaccatttattgagcacggactatgttccaggaagtgttctgagtattttaagcatgttaccacatttcttccccactttcagcctgtaaagtagatgttgctctaagcataaaagattcttccttaattctcacaaccaacattgttatgaaaatcatggaggttttaactcagaagtataactcttttatgaaaatgtgcacagaataagcaatacagtagagaaagactcacaactgtaacattccggataagaaagagaattctggactttcatttttttttttgagacaaggtcttgctctattgcccaaactggaatgcagtgtcatgatcatagttcactgagcattgacctccctggcttgagcaatcctcccacctcagccttccaaatagctgggaccacaggcgccatccccacacccagctaactgtattattagtagagatgggccttcaccatgttgcccagactagtcttgaactcctaggttcaaatgatctgctcgcctcagcctctgaaagtgttagaattactggtatgtgccactatgcctggcctgggcatctttttactatgaaaacagcaaaaagatcagtggttgccaggggttcaggggggtagagggagagacggacgggtggaacacaagggatttatagggcagtgaagccattctgtataatactgccatagtggatgcatgtcattatacatttgtcaaaacctatagaaggtacaatgcaaagagtgaacccaatgtaaactgtggactttagttaatagtagtatattaatattggctcatcaattgtaacagacataccgactaatgcaagatgttaataatagtggaaaatgggggtgggaatgtgtatgggaactctatgtactttccactcatttttctgtaaatctaaaactgcaccaaaaattgcctattaattaaaaatacatatctaggctcggcatggtggttcacacctgtaatctcagcactttgagaggccgaggcaggtggatcacctgaggtcaggagtttgagaccagcctggccaacatggtgaagcagcatctctactaaaaatacaaaaaattagccgggtgtggtggcaggtgcctgtaatcccagctacttgggaggttgaggcaggagaattgcttgtacccagcaggcagaagttgtagtgagccgagatcacaccactgcactccagcctgggcaacaagagtgaaaccccatctcaaaaaaaaaatgtgtatctataagtatagatacgtacacaagaataaggatgtgtagcaaagaaagaacagtatttgcaaggtgctcaatgtatcatatgttgcaatgttcttaaaattggttttattggcttctcagttagcttctcttcaacttgttcctagtgaaccacactgcttcaacagagttgacagcagcagacaccacatcccatggcaaaactaaagggagtttccctttcagtaagcaaaaagagttgcattattaacatgcatccctatggtctgcggaaagtggcttccagtatttctgaacttaaactagtcaaagtttatgcaataggaaaacccaggtcatttttgccctcagaaagactgacgtgggaaaatattcccattggcactgcgagtgacaacaaacaaacaatcaaacaaagtgttctcatggtttttaaattaggtgtacttactctttaaccaaagtttcttttctgaaagcaagttctagcagcagagatggtacaaggtacaccacaagggcagtcataacaatccatattggcctggagcccaaggcaggagtcatcagggacagaatcattgccgcaggtccttagttccgtctgtgctccgtggagtgtggagaaaagtgtcttccagatcagctggtgggggctggggagaggggggagacgtgcacaccttgaaactagggcatctttatggcgtgagctcattttacctcttttctttttaaagtctagatgaggcatgaatattatgaattggaaattagaaagagaggagaagtcaaagaaggagactttcagtgtcagttgagaaaaactacacccaacatgcactcatacacacaccagtaagatcttgcctagggcgtacttcaagagcctggaaattagagggcacaagcatgagaaagcgaaggtgaaggtcagtggccctaaatgaaggactagggagaaatagaaagatcttattatcaagttcttaggttttgtttttttcttagtggggtgggaatgggggagtgtgatttaaaaaagaaagtaacacaggtgctatcttaaattacatggatactgtcagtgctggaggcggaggtggtctttagatctaatgtagagcatgggctttcagatgcattccatgcagcccaagaattttctgaagttcctctagggccattttcagtggctaaagctcagctgtgggccacccttcttccgcttcaacctcaacagctctacattcatgtttttgatatttggaatgcacatagtttatttgtgtgcctgaaaaaggtttccacttcttcaaagaaaatattttttaaaaacaatcaatttagtcctaagttcaaagagacagaatcttctaaagctacctgtatttacctgttgtcactttttccagatccgaaataactgaatggagtcttattttttccactcttttgctaatggaaagcctactttgagtacacaggctaaatcacatgaaaagaaaaatctcatgggactatccaaatcatgatgcagtcttcagtattattctgatatgaagaaataccgactaatgcttaaaaattggaaatgttgtcaaaatgacatatttaaactgtaaattatcaccttttcaggaaatagattaatccagacccttaattttaataacctgttttgcctttgttttgatacatttttataaaataaatgagtagtaaatactctttatttaatttaatggaatcttatatgaaacaaagtcttacaatgcctcagtctttgctccgaaatcagtgttcactgtacttatgtagttgtgaatatagaaaatgtgataaatttggctgaatttgtactttccctgtgttacattttgcaaaatgactctttaactcatcccctagccccagccttgtgcgtttatatgccaggggcataatccttagtaacagaattgatggatcctaggatatgcaaagcttcaaatttactaaacaaatgaagccaaattttgtttatcctagtgtatagcttgctttatcgtattctttgtggtattgtttgaaaagctggttcttactaaagtttataacattttcttttatattttataaccttttatatgtcctaagaaatctttgcctgccttaaatatttcctgctggaagtattgtggctttgatttttcatttagtctctgatcaagttaattttgcttttgttatttttttggtgtagtgaagtatattatgagtcaagacccattttctttcttacaactggtatcttctatccagttgtttcagcattacttgttttaaaaagaagaaaaagaaaaaatgatccttttctcatgaagtaccttgatctctgtcaaaaatcaattgttcatatgtatgtggatttaccggtagtcactttattctgtttaattgctcaattattatatttatttttataccaatacctcacctttttggttactgtagttttataataaatcttgaaatcagatagttaaaaatgttcaaaattatattgttctctttcaaaattattttggctcttgttaggtctttgtgcttctgtattaaatttggttttatttatttatttatttatttgagatggagtctcactgtgtcgcccaggctggagtggagtggcatgatctcggctcattgcaacctctgctttcggggttcaagcgattcttgtgtctcagccttctgagtagctgggattacaggcccacgccaccacacctggctaattttttgtatttttggtagaaacggggtttccccatgttggccaggctggtctcaaactcctgagctcaggtgatccacccgcttcagcctcccaaagtgctgggattacaggcgtgagccaccgtgcgcagctgtattaaattttgaactggcttataaaaatttccaccaaaaaaagtctataaggattttggttgggattgaactgattccaaggtcaatatgggggacctaatatgttaaacatattgagtcttcatattgagcagaatatatatatctctatttatttttatatatgtctaaatatttcctgagatatatttataatatttctcagcaaagttttgtagttttcagtgcataggtcttgcacataatttgataaatttatctctaattacttcatgtatttggatgctagaaaatggtattttaatttcatttttcaatttgtattgctagtatgtagaaacactactgatttttgtttattggcctcatttcctgcagtcagctaatttaacttactagtggttccctaatcgatttttcttattagttctcctgccctgccctctcaacggtcagctatgctctctatgacatcttttctttttggtaaacaaaccaaacaccacgtttgcagctgagtagctttctcaactgaatttctgcttcctgccttaaagaaactgatgaattaagggccttttttcatttagtgccgtgtctctctttctttttttaatgcaaactgatggtgttttctccaacagaagtctccggaaaggtcctctatgtagcctcttgtcatccctgcaccgtggccacaggggagtggtctaagggagtgaaagtaaaacggataaactttgttttaatatagctgacttctctccccactcttctgggctattattgtctctataattatttctttgtacaactttatgtcttttaaaaaagctaagagatgccgggcgaggtggctcatgcctgtaatcccagcactttgggaggctgaggcagacggatcacttgaggtcaggagtgcgagaccagcggaaccccatctctactaaaaatacaaaaattagccaggcgcggtggcgggtgcctgtaataccagctgctccggaggctgacgcaggagaatcacttgaaccctggaggcggaggctgcagtgagccgagatcgcgccactgcactccagcctggcgacagagcaagacttcatctcaaaataaataaataaatacattaattaatttaaataaacaaagtaaaaagctaagaagaaggagacatatagtcttttatattaatccacatatctatcatttctgattttcatatctgcctatggattttagttgtctttttttttttttttttgagacaatttcactcttgttgctcaggctggagtgcagtggcgtgatctcggctcactgcaacctctgccgcctgggttcaagcgattcttttgccccagccttccgagtagctgggattacaggtgcctgccactacgcccggctaatttttgtatttttggtagaaacggggtttgccggtgttggccaggctggtctcgaactcctgacctcaggtgatccacccacctcggcatcccaaagtgctgggattacaggcgtgaagcaccgcacccagccgttactttctcattttatttccttgttccaatatatctctattctcccccgacctccactttgtggtattattggtacatattagatctttttaaaaaatgattacttttctgtttgtccctgcagtacatattaatctttatgtgtcattacccttgcaatatattttgataattatcatttcatgcaattatcttttaaatcagttaagagaagacatcatatttaattatgtaattaccagtgcttgttctttctttatataaatttgagttactatccagtgtcatttcctttcagcttaaagtacttatttagtatttcttgaaagccaggtatgttagcaacacatttgctcagcgtttgttcatctgggaatggtgttcatctggaatgtctttatttcagcatcatttttaaaacatagtcttgccgggcgcggtggctcactcctgtaatcacagcactttgggaggccgaggcgggtggatcacgaggtcaggagatcaagaccatcctggctaacatggtgaaaccctgtctgtactaaaaatacaaaaataaattagccgggtttggtggctactcaggaggctgaggcaggagaatggcgtgaacccagcaggcggaggttgcagtgagcagagattgcgccactgcactccagcctgggcgacagagcaagactccatctcaaaacaaacaaacaaacaaacaaaaaaacataatctttctggttacttctgggattagggcaaatcaagtgaggcactcaccttgagcacaaaatttaagggaaaccaaaaatctcagtaatcaaaataaataaaaatgttttaatgccatatttaaaaatgaaaatggatgcaataaaacctatgatgaacaaaataccaaaatttaaaatagagataggatcaatattgctgatttttccttttgcctcaggctccagtatggatggcatgacatggcactgttggataaaattcttcattttcttttagaattgtgaattacgttatcccattgccttttggtcaccactatttctttttttaattaattaattaatttttgagacagagtctcactgtcacccaggctggagtgcactggcgcgatctcggctcactgctgcctccgcctccagggttccagcaattttcctgcctcagcctcctgagtagctgagagtagccaccacacctggctaatttttgtatttttagtggagatggggtttcaccatgttggccaggctagtctcgaactcctgacctagatgatccaccaaccttggcctcccaaagtgctgggattacaggcgtgaaccacctcgcccagcctggtcaccactatttctaatgacaagtccattgataatattaatgtcgttcccttgcacataatgaattttttttcttgctacttttaaggttttctccttgtctttggctttcaacgatttgattctgacatctctaggtatggatctgttttctatctatcccacttggaattctttgaccttcttgggtatatagatgaatgtttttcatcatgtctgggaaacttttggctgttatttcttccaatacagttgacctttgaacaatgcaggggtaaggggtaccaaccccacacacaataaaaaatctgcatatgttgactcctcaaaaactactgttgaccagaagccttacctataatataaactgtcaattgatcatattttgtattttatgtgtattatatactgcattcttaaagtaagctagagaaaaaataaaattataaggaagagaaatatatttgttatgcatcaagtgaaagtggattatcataaaggtcttcatcctcatcatcttcacattgagtaggctgaggaggaggaggaagagaagggcaagggttggtcttgctgtctcagggtggctgagctagaagaggtgaagacgggagaaggggaggcagaggaggaaggcacactttatgtaagtttatggaaatacatcataatttctgtttccttttttatttctctaaaaatgtttctacatggtaccaatccttcttccacctttgctttagtttcagtgcctgtatcatgaaagggtacatgttgtaaaataagttaaaagcaatcttgattaatcagaacccttctgccagatggtctcatgtcaatttattttctgacactgcttcttctacatcttcttcctcatcatgtaagcctggttcggaagcacttctttccaccaacctgccttctgttaactcctctggtgtggtgtctgttcactcttgaatttccttgagatccttgtcttgaaactcttcactcaccacctttctttttcttttcttttctttccttttttttctctctctctctttatttctttgcgatagccacaatctttttcatgatttccttgattgactctgtcataaatcctgtgaaataatacactacatctggacacagttttctccagcaggaatttattccttcaggcctgttggctttcctggcgttttctatcacaatgatgacatcttcaatggtgtaatcatttcagactttcatgatgttctttcttttgaagttctcttccatagccttaacaatcctttccacagagtatggtatgtaatgagccttaaaggttcttatgactcctaatctacagactgaattagagacattgtgtttgggtcatgtagaccccttcagtgctttcagtgttgaactcatgggattctgggtggccaggagcattgtccaatatcaaaagaactttcaaagtaggtatgtttatatacaccatggaatactatgcagccataaaaaatgatgagttcatgtcctttgtagggacatggatgaagctggaaaccatcattctcagcaaactatcacaaggacaaaaaaccaaacaccacatgttctcactcataggtgggaattgaacagtgagaacacatggacacaggaagcggaacgtcacacaccggggcttgttgtggggtggggggaggggggagggatagcattaggagatatacctaatgttaaatgatgagttaatgggtgcagcacaccaacatggcacatgtatacgtatgtaataaacctgcacattgtgcacatgtaccctaaaacttaaagtataattaaaaaaaaacgtaggtatgtataatgtgtcccacaggtattcattttttcctttttgttcatattggatcatctccagagacccatcttcaagtctgccaattcttttttttctgctagttcaaattttcttttcttcttcttcttttttttttctttgttttgagacggagtcttgctctgtcacccaggctggagtgcagtggtgtgatttcagctcactgcaacctctgcctcccaggttcaagcaattctcctgcctcagcctcctgagtagctgggactacaggcacgtgcctacatgatctaatcatcctctataagccctatctccttttactatcatattggtaattatgtttcaacatatgaatcttcagcgaacacaaatgttcagaccataacaatatcatactttctttaattctttcattacaaagtttctgagttctaaaaacatatattgtaatagttgctttgaagtctttagcatccagtcccctcaaaatggcttctattgactttttgcccctgtacatagatcatactttcctgtgtttttctgtttgttgttttgtttttaattttgctctgtcatgaattttattgactttctgttcttacagtgcctcagtagctttgtttgtttgtttgtttcttttgaatagctgctcctcaaattgctgtgtgtctggtcaatttccactcttgaaatgattgtttttgaaaatttttatccagttttatcattgcattttgaggtaagtaggtgctaagtgtctctctcagccatttggaactcctgcttcctgcaagaccctttaagacccagcttttaaagccacacatcacttctgcctcattttattagtcaaagcaagtcacagggctgagaatgggaaaatagcaggagagattctgtggctaaatcagtttttgctataatactaaatacaaaatgatctgttttggattttgttttttaattatgtaatctttcagagactatttttttaaagagatgaggtccaggctcgggtagaactcctggctcgaactcatgagttcatgagttcaagtgatcctcccacctcagctttctgagtagctgggattatagggttttcagaggcttttatatgataatgtcaactatgtagtgtcccaaatatctgtgactgtggattcttttgtggggttcctaagagcagggatatatgtctctcatttcctgtttggcacacagtgagcactgaaatattgctaaatggaatatatggaaatattttcatataagctctcacatgactagcatcctctggcaaatgctgggacacattgcattaccacagctcctttcccataaacgagcctaacttccaccaataacatctctacattcccacttagggtgaaaattttcccttggttccttttctccctaccctgtggaagggaagagtttatatttgtacttaggaatgcaatctccgtagtttaaaggcagagaaacagtggaattgacaggaagtacaactggaattttaaagagatcatttctagtttgggcttccaagctgttcttcatagcactagtaggatttaagctgaattttgatgttacagtgggagttcagcagcagagacaagtgagaaagtaaaagcagtcaaaaaggaaaggcaacaagtcagaaaagcatagtggggacaagaaaattagtttgtaggggaagtttatatgaagaggctagctagatatcactgaggaaaacccatacggaagaaaaggaaaaatagccatgataggcattatgaaggagaaattacctggtgactttttggatacagatggtgaaagaaagagttaactcaactatacacttgggtatatgaaagatattgcaaaaatccaggaaagagaagataaggatcagataggaaaagtgatttcaggatagagaagagaggacacaatggagaaaacagtttggaggtaaagtagtcaagatttgacgattgattgactctgaggaaggatgagttaaagttatgggtctaagataccccagctagccttcacctcaattgatattgggaatagtttggaagttgccaggttagaagggaaggtcgtaagttcagtgtcagatgtgttgatggcttgtcagacatctaggaagagatgactagtaggcacttgcataagtaagtctgaagcacaaggttagagcttgtaataaagattaaggaattgagtggaaacattggtgagataatcatcattgagagagagagagagtgtgtgtgtgggatgtgttcttacgtgcatggatgtgtatgtgtactcaagcacatgtagttttgatcttgaaatgtttgttgtatgtcagtttgttcattatattcttgattggtatgctgggctattatcccattgtcaataaaaatgtcaataaagaatagatttgggcaaggtggctcatgcttgtaatcccagcattttgggaggccgaggtgagcggatcacctgaggttaggagtttgagaccagcctggccaacatggtgaaaccccatctctaccaaaaatataaaaattagcctggggtagtggcacatgcctgtaatcccagctactctggaggctgaggcgagagaatcacttgaacccaggaagcggaggttgcagtgagtcaagatcacaccgctgcactctagcctgggtgacagagtgagtgagactccatctcaaaaaaaaaagaatacattttctttttggtcttctttacttgttgcaggaggctaagtaaatttcttttattttggaagcaagaaaacaaaaagaaattttacttgaccttgaatatcttccacatagaaaaacagcaattggaaaataaagttaaataactaactgattcattcaaaccaccataaaaatacatagaggtctgaacaatttagaggggttgtttttcacccatcttctccgctacgtaattttggagccctttatttagtctatatagactcctagcaattgtgactacctgtcctgaatcagaagctctgtatttaaggatttcacccaaaacttgctgtttattttgctggttcaacttataaaattgctcaacacagccggagagtcttcactggaaatagtgcatgatttatgagataattaggtaccttttttggttttgtttttagagtcgattcagagtgatccaagccatagcttgtggcatcgccccttctccttcatttttctctaaagtcaccttgatctgatccactcagagatgccagaaaaatgctcttcccttttggtaatgactaaattgcatagactatcattttattgtgctaggtctagtaagtgacctattaatgtggcatagggaggcccttgtggggaagtggtttactccaacacatttgcctggtgtgataattattcaggacatacccacgagtcactcctgaatatattgtgctattagtcagcctttttctcttaatttgcaacacaagtcatctgattgtaatcactgaataaaaccttcccaaagaagttgtgatctagaattgttttgtataataataataaatatctcttatttcttgttttcaactttgcatacacttagaaaagtttagggccgactgatggaatttaggatatataaaaaggagcttttgagttattttgaagttaatgagaaaaagaacaggttaccattttaaaaatgcttatattgcctatagtgtatatacaccaagtaattttgttccagtatatattgcagtcaaatgacagaatttgaaagatttcagattgtgaaagtgctatgtcagaaagcacagttagcattctagatttataagatgtagaatgaggtatatcctaaccggattatgtaaattttaaggaagtttcaaatatattactacatgtaatctaccccttctcacttccctgtaatgctgtgaagaggccacacatgctctggtaaccaggttttacagatgaggacactaacagactgaggttttgtgactttgtcaagatcacacttaagtggctgaagtaggattagaatgtaagaatttttgctcttaggaaagggttttccccatgaaatcatattggttctgaactttaaaaaagaaaaagaaaataaacattatatagctcttctggttgatgaatgtcactgtatctatatctgcttcactgtgattgagttagacttgctgtgattgacatttgctgagaggaccactgagctggaccaaacacactgcacagagaaatctcccacactgttctgttccatgtccattggcatgctcaggaatatgctaatttaggaaggtagtttttgcctacaatcaagcagaatgtcttttgaagagagaaggtgagaaaatgattgaaaattcttttctttcctgggttcttaggattatacacacacacacacacacacacacacacacacacatgtatataatcctaagaacccaggaaaggattttatatatatatatatatatacacaccacacacacacatatacacacacatatatatacacatatataatacacatatacatacacatatatacatatatacatacatatatacacacatatataatatacacacacacacatacatatatacacacatatatacacacatatatacatatatacacatatatacacatatacacatatattcacatatatacacatatatacatatatacacatatgtacacacatatacactcatatacacaaatatacgcatatacatatatacacacacatatatacatatacacacatatacacatatatacatatatacacatatatacatatatacacatatatacatatatacacatatatacatatatacacatatatatacatatatatatgtgtgtatatatatatattctagcatccagccaagagtaaaatagagtatttgaaaatatatcccatgactatagcttaggaaagtgtgattccactccctccttcctctcacctcccacacatgatgtgtgtggtgtgcgcatgcatgcgcactcacacacacccatcttctcaaattagttagctggcctatttctgaggtctgactcacatgagacattcttgtggggagtgacttttccttttcctctgcctctggaagacatcagaagccagaagaattcagaagaaaagggcagctgactgaacatggggttggagcctggtggatcttattataaaactttcatactctgggaaagtatacagtcttgtttagagtctgatatttgccattaactacaatctgcaagatgtttagaaacttcaattgactaaactgttaatgtcacaaaactaatcagtgattgttctactgcagaatgaattcttaatttgaggcttttcttgggtaactttattgtgacataatttcaaattcataggaaagttataagaattgtactaggaattcctacaaatacttaacctagattcaccaactgtttacattttagcctgtaccccttccccttcctttccagagcacatggaaacatcctctccctttaccccttaacatcagagcatatttcttaagtacgggggtattctctaaaataaccatagtacgccatcaaaatcatgaaattcaacattgatacaattatgcaattcacagtctgtaatagaattttattaactaacctaatgatgtctttttgaatgttttttttccccagtgcagtacccagtctggaatgctgcattgcacttagcgtcatgcccttttagactcctttaaactgaaaccagtcccttagtccttctttgtctttctaaagttaatattttttgaagaatacaggccagctactttgagaatgtccctcagttttagtttgtctgattttcctcatgatttaaaaatgcaagttaagctttttgttgttgttgttgttgttgttgttgtcaggactatcacagaagtgatgtgtctctctcaggaaatcacattagagacacattgtgctggtttgaactattattactcatgcttcctttgatagcttgcttaaggtagtgtccaacaagtgtctccattgtaaagttacaatgtttctctttaggtaactttcagggagttgtttttgaaaccttgcaaatatcccttcctcaccaaattttcacccccttgttttggcatccactgatgattttttttaaatcaattttcccttcaaatatttttagtgggcaatctactggaaggaagaactttcccttctcacccatttatttattcatttaaaaaaatcagagtaaggactcagagattattaatttattcaatgagttataatcccattgtttattttgatgttccaatactcccatatttggccaaaggcagtcaaatcctggactgtaataaatccttgaaccaaaaataaaatgcatgctcttctcatgatctctgatattttcctgatctggcctctgctgacctcatgtcagattcatctctggctccagtccctctggttctgtgttctttagccacactggacacctttcgattgctcaaccacatcaggttctttttcatcttagggactttgcacttatggttccttctacttgaacatattttcctgaatctccacttgcctggctttttctcattattcagatcttggcaaaccaagagattgtgattactctacctaatgttgcttaccacatttcctagtcattctctgtctcctccagtgttttattttctatatagctatcatcactctcctaaattatttatttgtgtgtctcttgtctaacaccctgtaagcagtctggaatcttatctatacgtgtaaccgcccaatgggttcaccatgcccactgcctagacagagccgattttatcaagatgggggggaattgaaacggagaaagagtaattcacacagagctggctatgcaggagaccagaattttattattactcaactttgtctccccgagtatttggggatcagagtttttaagataatttggcgggcaggggcttgggaagtggggagtgctcattggtcaagttggagacggagtcatacagggttgaagtgagtttttcttggtgttttctgttcctgggtgggatggcagaactggttgagcccgattactggtctgggtggtgttagctgatccaacaagtacagagtctgcaaaatatctcaatcactaatattaggttttacagtagtaatgttatccctatgaggaatttgaggaggttgagactcttgcagccagaggctgcatgacccctaaactgtaatttctaatcttgtagctaatttgttagtcccacaaaggcagagtggtccccagggaagaaggaggtcttttcaggaaagggctattatcaattttgtttcagagtcaaaccatgaaccaaattccttcccaaaattagttcagcctatgctcaggaatgaacaagtacagcttaaaggttaaaagcaagatggagttggttaggtttgacttttttcactctcataatttcctctgttataattttgcaaaggcggtttcatacagcagctaggaaaatgtctgcaaatgtgtatatgcatgcataggtgcttgtgtgtgcatgtgtgtgtgtgtggaaggggctcaattaatatttcttggatgaatggatgatgtaataatttagcctgatattctttatgatatgtctttcttagttttaagaatcctgaaggacaaaatttttccttacacaaattattaatgaatagaaattaccatttctttacttttatactttttactttgcttcattttctaataagcaaatatacactattctcttactgcaatatgtttgcatgtaaaaagtgtatgcttattgatatttttgagcaattactcagaaaataatattttcaccttgaaattatgaaaatactaaacattaatattttagtttacacaaacatatgcctagttagagccataaaaaaaatgctggccgggcgcggtggctcatgcctgtaatcccggcactgtaggaggccgaggcgggcggatcacgaggtcaggagatcgagaccatcctggctaacacggtgaaacccccgtctctactaaaaatacaaaaaaattagtctggtgtggtgtcgggcgcctgtagtccaagctactccggaggctgaggcaggagaatggcgtgaatccgggaggcggagcttgcagtgagccgagattgcgccactgcactcccacctcggtgacagagcgagactccgtctcaaaaaaataaaattaaaaaaaaatactgctgtctctttttaagagtattaaactaggacaaaggttacttgacctaggagattactcagcactgcctctacacggaaatgaaactgggggttttgtctctggtgtaacataaataacaaagaatgagccattagggacagggactggggactctggaataaactccactctgtgacagaggacagctgttcacttcccataagggcagttagacacaagcttttaagtttggctttgtgtttacttgttgctcaatgggcttggggtggagagagtactagttcataattggatttatttttgctcctccacagatttttagttgtggcaccaaaatagctgttaggttggtgcaaaagtcactgcagtttttgacaaataaatatgtgaatgaaatatctgaagcaatctgtctcaggatttttaaaaaatttgttaacctaaaaattccaggaaaacctttgacaaatatttgatcgttttctagatggtacctcatttttagaaatgtaattgttataattgcatagctgatttttttcccctaggaatagagacataggggttgtcagaagaggcagcatgcattttgtttgtgtgtttgtttctaaggagcttagcagccaccgatcatgaaccgacagatgccaggaaatcctttccttgttttgatgagtgcaacaaaaaggcaacttatacaatatctttcacccatcccaaaggatctgaggcatttcaaatatgccagtggcggtaagtgttttttaaatgtcttgtttgtgcagagtctgttgacaacattaggtcaattaccttattttctgtgaaagaaaacccattgaattctaaaactaaatgtgcactaatagtttattaagctgagtaaaatacattttggcaatatttttctttgagtcctggaagtttttaagataccacagtccagtaagaaagccacattggtgtttctacacaggagacaatgccatggacacatacatcagcttgagagtcgtgacaaattacagtaatagcaaactaatggaattacagacttgaaaatatttgagggctactcactatttagttttcaggtgaatataaatccagtttttttcgttttgttttgtttttaagataaagctactataaaaaaaacatcacttaaatactgggttgtggaagcaaactccagggaatactttgcccatagactcctttggtgactgaaaagtacttgttaaatgtctggagaaaaaaataacaggctataaaaaaggatgagtttttgtcctttgcaaggacatgaatgaagctggaaaccatcattctcagcaaagtaacacaggaacagaaaaccaaacactgcatgttctcactcataagtgggagttgaacaataagaacacatggacatgtcgggggaatatcacacaccaaggcctgtcaagggctggggggccaggggagggataacattaggagaaatacctaatatggatgacggattgatgggagcagcaaaccaccatggcacatgtatacctgtgcaacaaacatgcacattctgcacatgtatcccagaacttaaagtatactaaacaaataaattaattaagttaaattataaaaagagaaaaaataacatgctgataatttctgcttgtctaaattattcattaacataaaacacttttctctgttatcgcgtcttatttccataatggataatgttgttacccagagtttcattacctcaaagttgaggtttacatactttatacatctgacatgtaaaagggtcaggctcatctttaggtataataatcattaggacacaggccccaaattatgtctcccatctttctgatccactatttgaaatattatcattaaaattcatctttttaaatgataaaatattccttgaaaaagcaacagtaaaataaagcaaataaaagcttaagaggattaaaatgtactcttagaggccatccatgcttcagtgagaattaattatcaacttgttttcttctaaggtttgattggagaagaaagaggaaaggataaacttaaaatatgacacaccaatctagatgaaggtggggggaaaaatggcaaattcaccaacttctgcttgagatattcccttatggccttttcactgtgcagagttacacttcaccttctactagatccagatagtagttctggaagaaggaggatattctgggttcttaggagatcaaaactaacactactaggtttttatggtagagtaatgtaacctggagcaccaccacaattatacaagggcgtgcacacacatgcttgaagtgtcagcagcacccattctagtccagcctccctcactttatctctttttaaaccacctcaaatagagtggctgcaggagatgtggaaatgtttaagtaatggaagcaggagttgggcaagtattcatggttgaagtcttaggataggtgatcggcagtgaggacagcagagctgacatggacaaaacaagccagataggtcagtagttgtgtcaagcaatagaatccttctctctgtccatggagaccgaggcactgactttggtcatcatacctttagtctttgatgtagacaacgaaagatggaaaagagaagccaatgttccacgaaactgggtacagcaattgccctcctgcacagtcgaatcagaaaatacttgagcacgagcctgtttttcattagatcagagtactctcagatattatagtcagtatgatgtgtttcgtgtagacagataaactcctattcaactgacagtccagtcaagattttatttctccctgaaaaacctaatacagtgtgtaattcagtcagtctttcacagttctaagaacagagtaaattttcctatagtcttatcaacatcaccacaaacaatttgacctctaagctttgacaaaggacttctgactagaaagcaaggtttggggcaatcgtttatttgtttgtcttgcatatatatgattgatcttttgatagataaaagttgatcttttcttttctatagaaacaagggtcagtggatgaaaaatggaatcaaacaactgtcgagaagtctgtccccatgagcatgtacctggtgtgctttgctgtacatcagttttgtcctgtaaagagaatatcaaatattggaaaacctgtgagtctcattatattttaaaaatttaccatcaatgcatttgtaatttattttctactttttttttttttttttttttgagacagagtcttgctctgtggcccaggctggagtgcagtggcacaatctcagctcactgcaagctccgcctgccgggttcaagccattctcctgcctcagcctcccgagtagctgggactacaggtgcccgccactgcgcccggctaattttttgtatttttagtggagatggggtttcaccgtgttagccaggatggtcttgatctcttgacctcatgatccacccgcctcggcctcccaaagtgctgggattacaggcatgaggcactgcacctggccaattttctacatttctggggagtagtgcttttttttttttcaaacaacatgccagaaaatcccattagtccccagggtctgtgaacttgataatacatagaacaatatagaaaaatgactgaaaggacacaggtaaaaaataaacaaacacaacagacatagatatttatggccttaaattatttcaaaggaaaaatttgctataagtcaaaagctagctcctaagtatgccagcaaaaatacattaaaatgtttgggtatgcccagtgtaataaaatgtttgagtatatgtgtacctctcccatatatagactagacagagaagaggaaacctgaggtaaaggaatatccttcgaatgacgaggcactgagaagtttatggctccattcctatatgtaatcaaaataggagagcaactgtgtatccaaaaccatttttttaaagcatgataaaatataaataagcattttttaaaatatgaagatgactagttcaatagtttcctttgtttttgttgttgctgttgctttttttttttttttttgagacagtctcgctctgtcacccaggctagagtgcagtggtgcgatctcagctgaatgcaacctctgcctcccaggttcaagcaagtctcctgcctcagcctcctaagtagctcagattataagcgcctgccaccaagcctggctaattattgtatttttagtagagacggggtttctccatgttgaccaggctggtctcgaactcctgacctcaggtgatccacccaccttggcctcccaaactgctgggattacaggtgtcagccaccatgcccggcctcattaatggcttcttcaagttgtcttctgtgcttttttttccccctgtggcaatggggaaaattttttttgtattttgggtagagacagggtttcaccatgttggccagcctggtctcaaactcctgacctcaagtgatccacccacctcagtctcccaaagtgctgggattacaggagtaagccactgtgcctggccttaatcagcaatttttatttatttattttacattaatttttttaagagacagggtctcattttgttgcccaggcttgagtgcagtggcacgatcatagctcatgcagcctctaactccaggctcaagtgatcctcccaccttagcctctggagtagctgggactacagatgcatgccaccattcttggctaattttttcaatttttcatagagacagggtctccctatgtttcccaggctggtcttgaattcctggcttcaagtgattctcttgcctcagccccctaaagtgctgggattacaggcatgagccactgtgcccagccttttgtactctgttgaggtgctcagtcattctatattttcttgaacattgccttactttctggcatcataaaatgttctgggctcatattacttttcttgccccagtcctggaatcaaccattttcccaggaagctctgggtttgtttgtttgttttgtttttgttttttggacaaaggtacatagaaaacaagatctgaatgctaggtatataaaaagcattttgtaacacgttgtggaaaaatagagaaaaaaatcagatgagggcagtgtgtcctctacgtttagcagagtgtactcactagacacccagtaagtgtttgatgttagtgtggctacacttgtaaccaaatatagtcagtgacaaaaatgcttcatctcgacagtatgggtaaggtgacccactagctctgcttaccaggtattgaggagtttcttgggacactggactttcagtatgaaaaccaggaaagtcccaggcaacctgggatgagttggtcaccctaatatggaatagggtcagtgaggaagggaaggaatcaatgttggctgcgttcagcagaggaaccttctggagggtgggaagcatagcttatgcagctctctgagacatcaggagttgctaagaatccctttctctgctccttaggcatctcagatgctgtcattctccatgagtagcatttgcagcatggacctcatccatagcttctgattctctgccctatcctcactgagctctaaataataactttgaacctttcaacacggctcagataagctgtgatgggaaacatggtctgtgccaatggagcacatggttctgccagcgacagactgttcgagaaagaggtgggaagtccagatgtacaattactactgggcttccaacagcatcccatccggggtttacagaagcgcaactcaatcaacaaaggttttgtttcaagcatcactgtccacagctgctgtggcgtctcagtttttcctatcaaatattttccaaaagggctgagtgtgaggctgaaggatcagaggaagaaaggtttagagatgaatgcatcttaggcttgagcagaaagtcagtcaaacatcttgttaaatcccctgccttgatgtattattgcccccattctgcagattcagaaactgaggcttcagaaccattaatggttatgcccaaactgcagctagagaagggatgagagaactctttcctctaagactagcgctcatttttccacacaaatgcttcctcagttatgttcctaaaacccacataatgtgtataatgagaaagtcctattaaaaaaatgtttactgaatctagatttcccatcttatttgcgcatgaagctttcttcaccagattcccattatgagaccacagagagctgagtctaagaaagtcgtcacgggtggggaatttgaggtttttttttaaaaagaagtgaaaaatcacagacatattagaagtactaaaatactgtaaccactcatgagggaattgtttgggttgataactctgtaggactgatacaacataagggcattttgattggctgagccatggtttactttagactacaaagtactgtccctatctttcagtgtggctgtttcagtagtatttgtttcaatcctatttttcagccagtgggtgaaggacagcagtcacataaaaactttcttcaagagatttcaggcttggcgcagtgtaatcccagcactttgggaggccaagctaggtggattgcatgatctcagaagtttgagaccagactgagcaacatggtgaaaccctgtatttacaaaaaaaaaaaaaaaaaatgcaaaaatgaaccagacgtggtggtgtgtgcctgtagtccctgctactcaagaggctgtggtgggagggtagcttgagtctgggaggttgaggctgcagtgagccatcttcatgccactgcactccagcccgggcaacatagcaagaccctgtctcaaaaaaagagagatttttagagactctgagtacacacagtgttactttggggtccaaagtgtgtgaggcagagtcactcaagagagccaatctcctcatcttgacacagtctttagtgcagggctggccctttgagaatttgtagttgtggaagcattaggagatagcacctctgacaaataccttgacactttggtacaaggaactcctgcctatcagtgataaatagagagcaatcccatttttttttaaaaaaagaggagagttgctatgaaaaggatatttgtagaatgggaagccaccaaggttttgaccataagatgagagcccaagtttgctggtaattagaaataagacaaatgcaaattcaaaccacagtgagctacttcttcatgcctactggactaggtgacaattagagagctagtggggctatgggaggccacatgctctgttggtgggtgggtggactggtactgccattgtggtgttactcatgcaaattatatatatgtttacacatgcctcagtaattccttgcctggtatttatttcagggtccataatggaacttgcacaaggaagttttttgcattatggtttatggtggggaagttggtggcaacctgggaattcattacaagaagtggagaggtagggataggcaggggtcatatagtttggatacttgtcccctccaaatctcatgttgaaatatgatccccaatgttagaggcagggtctggtgggaggtgatttgatcatgtattagttcattctcacactgctataaagatattacccgagaccgggtaatttataaataaaagaggtttaactgactcacagttcagtatggctgtggaggcctcaggaaacttacaattatggcagaaggggaagcagcctccctcttcacaaagtggcaggagagtgcgtgtgcataggagaaactgccaaccatttataaaaccatcagatctcatgagaactcactcactatcatgaggacagcatggggaaaccacccccatgatcctatcacctcccaccaggtctctccctcaacacctggggattacaattcaaggtgagatttgggtggggacacaaagcctaaccatatcagatcacgagtgtggatccctcatgaatggctgagcaccatcctttggtgataaatgagttctcactcagttcatgtgagatctggttgtttaacagggtctggaacctccttttccctcttgccacgtgttatgccagctgcctctatatcttctgccatgtttggaatcttcttgatgcctcaccaggagcagatgctggtgccatgcttcttgtacagcccacagaaccacgagccaaataaacctattttccttataaatgatccagccccaggtatttctttaaacaacacaagaacagactaacacaaagggtaatattcagctgataggcatgatacagccacacgggttgttgaactagtgaaacagtgtcctcatgtcatgtgggttgataacctgctgcttctcagcctactaaatgcctctccatctcccctacaaagtaccctaacctttcctgctgcagcaatttaagattaaattctgaatttcaggagcctctgggacccagttccagcccagcattgaggctccctcctcattaggtcatgtctgtgttgttcaagggttaaatattttgtacattaactgtgtggaggggtcaaccacaataaatttatacaatgggctactaggcagtagttagaagcaatggctgtagatacaagcttatatcttaaaaaactagttcttatgcaattgaattgttctatattatgtcatttacaaaaattaaaaattgcatgcacccaaactaaaatgtgcattttataagaacacattcaaaaggtgagacacacaaacgatacattaaaattattgcttagggaagaaaagagaactggaatgagttatggcaattaaagggagtgaatgaatgaatgaatgaatgaaaacaagatggacagtgcacaggtccagaggacatatcatgaagtaaggagtatggccaactcaatcatcttcccccggagttcaaagtgagaaagcattagctaaaacataacaccatgagccaggcactgttgaaggcactttgcatatagtaactcatttgatcctgacaacattctcaagcctgtccaggtcctatttgcctttggatccagtcctggccatttccctctctctgctgtatcctagcagtgttaacgttgttccagtggcttctgaaccagccaacattgaccaaccagagcagcagaagaaaaaggtgggagagtggtcctgcagctagttggtaagccatctaaaggcacacaatggggactgtgttaatttcagagtgctgccatcagatttaccaccgatttagtggcttaaatcaatacaaatgtattattgacaattcggtaggtcagaaaacaaatcggccccactgtgctaaaatcaaggtatcaaggagaccatgttcccctttctggaggcagtagggcagtggtccccaactgttttggcaccagggacagaattcgtggaagacaattttttcatggaccacaagcagttggtgggggtggtagtttctggatgattcaagcacattacattattatgcactttatttctcttattctattattatattttatttctatcattacattgtaatatatactgaaataattatacaacttatcataatgtagaatcagtgggacccctaagcttgttttcctgcaactagatggtctcatctggggttaatgggagacagtgacagatcatcagtcattagactctcataaggagtaggcaacctagatccctcgcatgcccagttcacaatagggttaggcaacctagatccctcgcatgcccagttcacaatagggttcacattcctgtgagaatttaatgccacagctggtgtaacaggaggtggagctcaggcaggagtgtgagtgatggggagcatgtgtaaattcagatgaagcttcgcttgcttgccctccactcacttcctgctgctcggtccagttcctaacaggccatagcctgggggttgaggacccctgccctaggtgatcatctatttccttgcccttttcagcttctagaggctgctcacatcacatttctctcttcataacccccttctctgttttcaaatccaggaacattgcatctctctcaccattctcacataatcacagctccctctctgactctttttttttttttcagatggggtcttgctctgttgcccaagctggagtgcagtgatacccaaatcccaatccccagaacgtgtggatatgttatattacatggacaaaatgattttgcagatgtgatcagggttaaggactttgagatgagggtatcatctcagattatccaggttggatattatccatcgctcactgcagcctcaaccccctgtgctcaagtgatcctcccttttcagcctcccaagtagctaggaactacaggcatgcaccatgatgcctggctaatttttacatttttcttttgtagagacagtcttgctatgttgcccaggctgctttcaatctcttaggctgaagccatcctcctgcctcagcttcccaaagttctgggattacaagtatgagccactgtgcccagccactctccgactctgacctcagctggaaaagtttcttttaaggactcatgtgattaggttgagcccacctgcataatctgagatgatactttcatctcaaagtccttaaccttaatcacatctgcaaaatccttttgtccatgtaagataacatattcacacgttctggggattaggatttgggtatctttaggggaccattattctgcccaccaaagagatgaacagaaatattttggggtgaaatgatgccaaaggagaaagcagggtagaaaacaagggaatttgccactgatgttggtttccatgtgatctcatgtctaattcaaacattgatgaaatctgccagcatttgagctgtacttagaatacagtcatttgcagaagatcaaaaaagatcctggaaaaagaataagataatcaaaggggttgagggaagcagttccagactctcagattaactgcagagtggggagggtagaggtggagagggtggtgtaggagggttatggggggcagtgtgagggtgggaggagttgcaggctcccagatgtactgtgaaacacgaaaataaatgaggtgaagagaagaaaaaggatgaaaagtatacatttccttgtctctcataaaagaaagctaagatagactgggcgcagtggttcatgcctgtaatccaagcaccttgggaggccgaggagggtggatcaactgaggtcaggagtttgagaccagcctggccaacatggtgaaaccccatctctaggaaaaatacaaaaaaaaaaaatatcagcgaggtgtggtggtgggcacctgcaatgccagctactcaggaggctgaggcaggagaataccttgaacatgggaggtggaggctgcagtgagctgagatcgtgccattgcactccagcctaggcaacaagagtgaaattctatctcaaaaaaaaaaagaaaagaaaaaagaaataaagagctaagataactaagctctccaataaaaatagcaaaaacagcttttttttttattagagagcttagttatggagaggtaattttggtattaatgttttaagggaatccctagcagaatcaaaaactgtatgtttgtcttccaaatgagtgacaaagatgacaacaagtagagcattgcccagacatcagaaggccaaatagaagattcaatagcagaatattaaaatacagcatgaaatagactgacagaggctggatccaggaggcatttacaccagtgatttgtacctaacggtgtaaattccactgccaagaaaccaagactctcacactacaggactgtatttgtttaacaaattgctgcttctgaaacatctcgctgaagctgaatgacctcaaaagtctaaaagcaaaattgagaaaggcaatattaattaaaaaagaaaaggtgacttccagtgtagaaaatagtaacctaacatctagggcaaaactattggccatgacaagcaggaaaattacttatgataaaaatctaaaatcaataatacaattttgagattatcaaagtttaattctttgaatcaatataataaataaaatacaacccacgggaaagacatgaaaatcataattagaggataattttttttcttgttcttttttgagacagagtcttgctctgtcgcccaggctggagtgcagtgacatcttggctcactgcaacctccacctcccctgttcaaatgattctcctgcctcagctcctgagtagctgggatttcaggcacctgccaccatgcctggctaatttttgtatttttagtagagatggggtttcaccatgttggccaagctggtcttgaactcctgaactcaagtgatccgcccaccttggcctcccaaagtgctgagattacaggcgagagccacctcactcggcctagagaatgattttgattgttctatgttaatgacaaattaaggacacaaaaattaaatatggatataaatgatataaacaatgaaaataagttagatggaatgaataggataagtttttttactttattgaaaatataccttcttttcttatgtttgtgattgtttatacaaattgattatatgatacacactgaaaggcacaaagattcaaaaaaaagcattcaataaatatagaatttttacaaatattttattaaataacagttgtctcacagctcaagattaaaaccacagattattcagaaaataaggaaacttcttttttattttaaaacattacagaaacaggctgggggcggtggctcacccctgtaatcccagcactttgggacacggaggcgggaggatcacttgaggtcaggagttcaagaccagcctggccaacatggtgaaacctcttcactactaaaaattcaaaaattaaccaggcatggtggcggatgccagtaatcccagctagggaggttggagtgagctgagatcgcaccactgcactccagcctgggcaaaggagtatgactctgtctcagacacacacacacacacacacacacacacacacacacaacccctgccaccaaaaccactatagaaatatatattcagtcatgcgccacataatgacacttggatcagtgatgaattgtgtctatgacagtggtcccatgagattataataatgtattttttgctgtttcttttctatgtttagatacacaaacaccgttgtgttacagttgcctacagcattcagtacagtcatatgccgaatagatttgtagccagggagcaatgggctctaccatatggcctaagtgtgtggtcggctctaccatctagccttgtgtaagctcactctgtgatgttcacacaatgatggaattgcctaataaagcacttgtcagaatatatctgtttttaagtgatgagtgactgcagtgtggtcaaagcaggactccaaaataaattcttagctttgaatatttcataataaaataaaaaggtgaaaataaacaaaacgaagcattctaaccaaaatttaaaaataaagaaaataattatactgtccacttaaacaacatgaaaccatgaaacctaccaataaatgtattttagaaaagactaatagaataactaaaatactagttattttagtataaaatattatactaaatataaaatgaaataattaatattagtaatattaattagtaaataaatagtaattaatattaaataaaatactaaaataactggggctggtggtggtggctcacacctgtaatctcagcacttctggaggcagaggtgggcggatcacttgaagtcaagagtttgagaccagcctggccaacgtggtgaaatctctactaaaaatacaaaagttagtctggcctggtggtgcacacctgtaatcccagctacttgggtggctgaggcaggaaaattgcttgaactcgggaggcagaggttgcagtaagcagagatcatgccactgcactccagcctgggcaacagagtgagaatccatctaaaaaaaaagaactaaaacactagcaagtttcaaaacatgagagaaaaaaaagaggtgtaacaatagaaaataataatgcacttttaatgcattattataaatgcaattacgaggtgtacataattatattctattaataatgaagcatcttaatgagatgtattatttttacataacataaattgacaatggcaaattgatataagatcaaataagaatttgaaattatactaaggaatgaaacaaatgagaaatatttaatgtgggtgttttctgctccctgtctttacaaaaagacagaaagctataagatttatcctgtaagggagatgttgctgttcccaatacctgaccaagataaccaaaagtatattagaataatctcacttgtgaatacaaaactatgtgattaataacagtgtcagtaagtagaatttaatgatatcttaaaataataatataaaagcacaaagggtttatcccaagtatagaagtgatcaatattaagaaaaacattaatatattactatagcttatattacatctctgaaaaatgagtctataaatggataaatgagtagatattaaagggtgttttatcaagtcaatctattattattttaaagtcttataaagacatataagaattagagactacttccttaatattatcaagagtatattctaagctattaataataattgacattatgctccaaggagaaataagccctctaaggatttctcttcaaacaaagcacttaacaaaagtcccttgtctgcctttttagttaattcacttttgaaagttatgagaactggctttgtgtatcttggctatcaaggaggttagagactcaactttcatctgaaagaactctaagtatctgatataatgtttgtcccctccaaacctcatgtctaaatatgatccccaatgttagaggcgtgtggtcatggagtggattcctcatgaatggcttggtgcccgccccaaggtaatgagtgagttcttgctctgttagttcactgaagagctggatggttatttatttatctatctatttatttattttgagacagagtcttgctctgtcacccaggcaggattgcagtggcatgatatcagctcactgcaacctccacctcccgggttcaagcgattcacctgcctcagccttatgagtagctggggctacaggcgcccgccaccccgtctgactaattttttatacttttagtagagatagggtttcactgtgttagccaggatggtctcgatctcctgaccatgtgatccatccgccttggccccccaaagggcaggaattacaggtgtgaagagctggttgtttaaaggagcctggcacctcctcctctctctctttcttgcttcctctctctccatgtgatacactggcttcccattcaccttcttccatgattggaagcttcctgaggtcctcaccagaagcagacactggcaccatgcttcttggacagcctgcagagccatgagccaaataaacctcttttctctctaaattacccagtcccaggtattgcctgatagcactgcaaaatggactaacacagtaacctcaagacactagttctcttcctgcttccaggtggggcaccgcttgctttctcaccaggtgctgctttggaaacacagcacaatgaaaaacagaaagctcgcttttacttcttaggggttatctggtctgaaccccccagtttgcatgtgagaacactgaacttcggaaaggaaaagtgagctatgtaagagcaaacacttactggcagagctagggatgaataatcacaatttatagaacacccgccactcaccccttgaacagccttaggaaaaatattgcacttcctattgcattcttttttttgtttattttggagatggagtctcactctgtcacccaggctggagtgcagtggcatgatcttggttcactgcaacctctgcctcctggtttcaagcaattctgcctcagcctcccaagtagctgggattacaggcacccaccaccacacctggcttaatttttgtatttttagtagagacggggtttcaccatgttggtcaggctggtctcgaactcctgaccccaagtgattcacctgcctcaccttccaaagtgctgggattacaggacctactacattcttgcaggtgagaagagtgagacttggaggcattaaacatctgtcctaagatcacccagttagaagaagcagagcagagcggacagaacacccaggataagtttgtaatttttatttttataacatttcataaaataatgttaaaatgtttatatctctcttttttttctgagacagattcttgctctgtcacccaagctggagtgcagtggcgtgatcatagctcactgcagcctcgacctcccctgctcaagcaatcctcccacctcagcctgatgagtagcagggactacaggtatgcaccaccacacctggctaattattttttttttattttgcagagatggtggtctcgatatgttgcttggctggtctcgaactgggttgaaccaatcctcttgccttggcctcccaaagtgttgcaattacaggtgtgagccaccacacccagccttgtacctcttttaaatatttgttcactatttattcaatgagtcacatcagcatatcacctaccatgtcaagggcaaaccagcaaagcagaagtccagaacagagaccacatttctgatgtatgacatgttgacatggcctaggaccctgtctcttaatctggttctgagacagttttggattggaactcaaatttgctggttccacagcctgtgtactgggctatggcactcagagctcctgattcctggacaaatgtactttccttgcgaacccctttctgaaaaccaaaactgaagatggcattattttcccttcccaggtcattccaggggtatttcttgtccacctacgttgtgcagagtaataagcatgagaccaggcaggcaaggtctagcctcacctagaggataagaccgggctgaaacatgcaactgcattttcaggctgtggtttaatatttgtctctggaaattccagccaggtggcgctagtcttgacttctctggcttctttaggaagctttctcttctggctcctgatgattggctttctgtgggaaggtgcctgtaaactttctccccatggactctgaccttgctgcttgtagtctgatctttgctttggtttctttcttgcaggagaaggcttctactgcacaactggaagaaaccattgctttgggaattttctatcctgcagcccttagctaccctttgctggaatgctgccaccatgactgctagagacacttcgtggaagaccgcaggatgtgccatcttttctcatgtgggccaggcacaagcttctgttcattcaacctatggtttgaaggtcaaccctgtgcagcaactgtttaatctctagaagagatgctgataaaacttggaaatgggccaagcgcggtggctcaggcctgtaatcccagcactttgggaggccgaggcgggcggatcacgaggtcaggagatcgagaccatcctggctaacacggtgaaatccgtctctactaaaaatacaaaaaattagccaggtgtggtggcaggcgcctgtagtcctagctactcggggggctgacacaggagaatggcatgaacctgggaggcgaagcttgcagtgagccgagatggcgccactgcactccagcctgggcaacagagcaagactctgtctcaaaaacaaaaaacaaccccaaaaaaacttggaaatgttgtagctcaggtatctccattatgattgaaaccacctttgcaaaaagtatgacagtgagagaaacatgacatagaaaaattatgacagggaaagaaatctgacctgattccattttgcttctaacctccaagctgcctttgttcattctgggcatagaccaacctaaccatgggagaaatttaatttacagtttgactttgaatcaaggataataggactccctttctaaagctgaactcctgcttgtcccagtactgaaaccatctttgtaagatccctgaaagaccacgagattgggattataggaggggtctgaaatctgctaagatgtaggcttagttaaataataacctgccattgttccatagcttgctttcttataatccctaatcattcaggattcatgaatccagacttcacaagatttgtgacttccccaattgctcatatagatacccaaagggggccttttgagatgtttttcagactattgcattcttacaactaactccatttggacccatgactcagtactcaacccagtcctgtggtccccacccaaaggctgactcagctcacgaggacagttttccacacccctatgattttatcttcaaccaataagcactacccattgcttagcccctcccggccaaattatccatgaaaaccctagcttccaagctttcaggaagactgatatgagtaataaactcctatctcttgcttagctggctctgtgtttattaaacgctttattacaatacttctgtctcagtaaattggctctatctgtgcagtgggggataagaagccatcaggcaattacacgattactccttaatacttaaccaacagcaatactcataaagcactatttctaaatatttattcaacacaatccccagaggcccagtggcatgaaccacaacactcaagttcttcaaactgataccttaaactttttgggctttattcacttcccacatatgatggaaatcaagtttcacagcttccctttaggaagttgaaattatttctgattcatgctgtaactgcatccagttctctctcctgcagtattttttcctcaagccaaacggggcttgttgtgttttatcctcattcacaccatgtatttctacactgtcacccctttgtccaagccattctttttgcctgacatgcccttctcatggatggatctctgccttcccacagtccacttatgcttcaaaacgcctctaaaaataaaaatatcaaaaagacacctgcacttgtatgtttattgcagcattattcacaatagcaaagatgtggaatccacctaagtgcctatcaagggacgattggattttaaaaatgtgctatgtagaaaccatgaaatactactcagccattaaaaagaatgaaataaaatcatgtcttttgtagcaatgtgaatggaactggaggccataatcctaggtgaaatagctcaggaacagaaagccaaacaccgcacagtctcacttgtaagtgggagctaatcagtgcatacacatggtcatacagagggaataacagacattggagactacgaaaggtgggaggctgggagggggtgaggactgaaaaagtacctattgggtgtaatgttcactatttgggcgatgggtacatgaaaagcccagacttcaccactccacaatatattccctaagaaacctgcacttgcaccccctaaatacatagaactacaaacagaatttaacccaaaaccaacagaaaagcacaaaatgcttccaaatgccaaatgttttatgctgtgctatggagctgcgtggtgtggggaacacattcaaaattcagagttttcatgtctccctcagcgggtactttctgctgggctccttcttgtctctgacaacccggatgcatggagagttcacacacgcacacacacacacacacacgtgtataaatacatatacacatatttattactacacatatacatatttataactacatatatacatatatttttttcacatgtctatatctgtctgcttgtctatccatctctgtatccatctacttctatttatccctatccatctatctatccatttctctccatctatacatatctatttatgtatcatgtatccatctattgatctatatctatctctccctatccatctatccatatatctatccatttttctctccatctatacatatctatatttatcatctatgtatccatctattcctctgtatctgtctatgtatctatcatctatctatctattcctattcatctgtttctttctccatctatacatatctatcatctatctatcttctacttatctatttgtctctctacgcctatccatctatttctctctctccatctatactatctatctatctagcatctatctatttctatcatctatctatctatcgatcaatctatctatctcacttattcttcatggcatggctttgtgtcttttatctttaattgattccaacaacactctgggaatgaatgaacacacatgttaaataaataagagaatgtcccaggatgctactgtctgattttcttccaggcctattggctggttgggcccatgcatgtaatgtcaaggttggatatcttggctgctacgacatattccatttgaggaataatttagaaatgtgggcgcaagataaaaatgtcagtctggctcctggttaacgggtgtttctaattaagccacgatatacagtgctcacagccaaataacagtgtggctccggcgataactcaccaaatagtgtgttgtcttcattatctcattccctgacatgtccctgatgagtttataaatccctgtggaatcatggccttgatctctttaatgaggcctttaaaaactggggcaaaattatagcagcagataaggttggctccgctgtagacctacttcataaaggtttctcctccccctagtgaaataaacaccatttgctagacccaggagtttaattccatgtgaattggtcagggcatatgattgagttaattcttcaagcagcaaaagaatattaaaagtagtttctgtcttccctgacctagtgggtaactaggtaactagaaatggaaatattcctttgctctagtaaagagaagggtagaggacaatggttcacgcctgtaatctcagcactttgggaggccgaggcaggtgggtcacctgaggtgagattcaagaccagcctggccaacatggtgaaaccccatctctactaaaaatacaaaaattagctgggcaaggtggcaggtgcctgtaatcccagctactcaggaggctgaggcaggagaatcacttgaacccaagaggcggaggttgcagtgagccaagatgacaccactgcactccagcctggacgacagagtgagactccatctacaaaaaaaaaaaaattgtacttttcgtagaggtggggtttcaccctgttacctaggaaggtctcacactcctaaacagcagtggtgtgatcacggctcactgcagcctttccagtaatttttctgcatttaaaaaaaacagttgagggctggcacagtaactcacacctgttagcccagtacgttgggaagccaagatgggaggattgcttgaggtcaggaggtcgagaccagcctagtcaacataacaaaaccacatctctatttaaaaaaaaaagaaaataaaaagaggctgggcgcagtggctcatgcctgtaatcccagcactttgggaggcctaggcaggtggatcatctgaggcctaggcaggtggatcatcagcttgggtgacggagtgagacttcgtttcaaaaaaaaaaaaaaaaacaaggctgggtgcagtgtctcacgcctgtaatccatatagtagcaaacttttaaaaaaaaataaacctttgttcctatttcagattgaggtcaggagttggagagcagcctgacaaacacggtgaaaccccgtctctactaaaaatataacaacaacaaaaattagctgggcctggtggcacgtgcctgtagtcctagctacttgccaggctgaggcaggagaatcacttgaacccaggaggtggaggttgcagtgagccgagattgcaccactgcactccagcctgggatacagagcaagactccatcaaaaaaaaaaaaaaagaaagaagaaagaaagaaagagagagagagggagacagagggagggagggagggagggaaagagagagagagagagggagacagagggagggagggagggaaagagagagagagaaagaaagagaaagaaagaaagaaaaagagaaagagaaaaagaaagaaaagaaagaaagaaagaaaacataacagttgaggttaaataaagtaaatttttaatttttttcacttagtatatcattactatcttctcttacaattagaaatttataaagttttttaaaatgcctacacaataatcctttaggtaaatcaacataacttaccaattaattttttattgttgaatgtttcagtttcttgaaacttttccatataatggcccgggcatggtggctttacaggtgggattatgcctgtagtcccagcactttgggaggccaaggtgggcggatcacgaggtcaggagattgagaccatcctggctaacacggtgaaaccccgtctctactaaaaatataaaaaattagccaggcgtggtgacgggcgcctgtagtcccagctactcgggaggctgaggcaggacaatggcgtaaactcgggaggcagagattgcagtgagctgagattgcaccactgcattccagcctgggtgacaagagtgagactccgtttcaaaaaaaaaaaatccatatagtagtgaacttttaaaaaaataaataaatatttgttcccatttcagattgttttcttgcactgggatcaagctgaaagtattaacaatcaaaatacttagaattttgttgatgagttaatgctaattatttctcaatctctaccacttttgggcatgagccaccatgcccggccaaaactccattttaaaagcccaatttttcacttccatttgcttcagtgtttttcatctgttaaatggagttaataacaacacctgctacatctacctctggtgattgtttttagatatgtgatgaagggctggatgcagtggctcacacctgtaattccaacaatttgggaggctgaggtgggaggatcacttgagcccaggagtaagaccatcctgggcaacacacaccgcatctctactaaaaattaaaaaaaaaaaattagcccttcatggtagcacacgattgtagtcccagctggtagggaggttgaggcaggaggatcacttgtgtgttcgctttcctagctagttgctgtggaaggagaatgctttcttcatggcctcatctgtcatttcgtgtccctctgaagaaaactagtttccactgtgtaacaggcaggcatgaaactatctaaagcacagttcagtcctaaaaggtctgagagaaccgaatgatgtactaggtgaagcagtgcattgtgggaatcacaaagcaaacagtactccagaaagacaaatatcagaagcttccccttccattttttttctttttttttttttgagacagtgtcttactctgttgcccaggctagagcgcagtggtgatcacagctcactgcagccttaagctcctgggctcaagcaattctcccatctcagcctcctgagtagctgggactacaagtatgcaccaccatgcctggctaactttttgaatttctatagtaatgggatctcactatgttgcccaggctggtctcgaactcctggcctcaagcaattgtcccacctcgacctcccaaagtgctgagattacaggtgtgagccacctcacctcggcccccttctccatatgcctccagaaacatgtccctggagagtagcctgctcccacactgtcactggctgtcatggggccaataaaatctcctgcgattgtgtatctcagacatttctgtgtctttcatcctcaccctgggaccctaaaggcagagggcccgagtgtcagtaactctggtcctcccctaaagagaaacggagatggtggctcatctaggaagtggaggagcagggggttcctggttctcaggccacgtgtgatctctgcccacccagggcctgccccagcctgcaggtattgctgtgtggtgggaatacccgcttcccttgtgcatagcctttgagaggggatcgtggcctcagcttcacgggttcctggccagggccaagcgctccttctgcagaggcctgcatgcatcctacccctttgacttgtatttccgtggcttcccctccccacctgccccccagccctccctgactggccagcccctcagtagtcctcctcggccagggagagcagcacggccttgggtgtgttcttgaaaagggttgcccagctctgctgctgctccttcctcacccaggggccatagattcagaaagcgtaggcgtcgatgagccggcgcagaggctggagggtgtaggggtgggtctcggatgacgatctcccgggtcaccgggttcacccggtggtactggtagtagctccgcactgaagccaccacagtcagagcgatcacctgaaggccacgcggagaagctgggctgcagcccccgccctgccaggccctgcccctccagcacaggactctctgggctcatttgccacgaagccttcagtggcttctgcggggccctcctagtgtcccccacttcccacttggccagcatcctcagggacggagccagtgggctgacacctgccatctctgaagccatcacagggcggctgggaggggaggggtgggtactctggaaacccgcggggtataaggacccctgggggaggagacggcttagaggtttgcacttggggagctggcggcaactgccacagggtctgggtcaggaggcttcgtaccttgaacttcccccgggggctgaagtgccgcacttcctccaccacgtactgcaggaagaatgggtgtgccaaggcctcttccgctgtgcagcagctctggggttgcaccaacaggaatcgggagacctgggagggaaggagagggtacccgagaaacttaaggcaggtcccctccagcatgtcaggagaggcggggcctccctgggcaagggagcctggcatcgcagccctgagcccaggagccagtcggccttctctctcaccaggtccttcatggtgtctgagtaatcatcctactcaggcgacccaaactggtagatgctgctcatgatcatcctcagcatcagcatctgcttctggtgccagaagggtggggagccagccagcagcatgtacatgatgacgcccgtgctccacctggacgtgagagggcccagggccacttacccagtgccaggggcaccgacccagccctgcctgcttcctccctcgcccagcccaggcgggtgatcctcctcctggcgcactcacatgtcccctccttccgtagcccggatggtcctcattcatggagcactccatgatctcagggccaggtaactgggggttctgcagacctctgcaggaacagtcatcatcaggacaggtcagcagggcgctcagaagaggaagtccaggacaggcgcagtggctcatgtttataatcccagcactttgggaggccgaggcaggcagatcacctgaggccgggagttagagaccagcctggccaacatggcaaaaccccatatctactaaaaatacagaaattagctgggtgtggtggcacatgcctgtagtcccagctactcaggaggctgaggtaggagaatcgctggaacctgggaggtggaggttgcagggagccgagatcaccccacgacactccagcctgggtgacagagtgagactccgtctcaaaaaacaaaacaaagcaaaaagtggagtcagctgaaatacattttcaagtgtaatttttttttaaagttgatgagatccttcttaataatatatgcctcatattaatggcaggtgtttttaatatagttgcttctgatctcctgagcacacccagtgtcagtgactaccctgaaacagcataccaaatgtgtgtttgtgtttgccagtattcttccggtgaaagggtccaaagcttttgctagattttcaaggagtctataattcccactgtcccctaacaccccaaaaatcttttttaggctccagaaaagaaaaaatctaaaaatgatttttaattgctaacctttagtaactgaatatgtgtatttaagcaacttaatattattcaacaatataactgtgattgtaaatacattaaattagaaatcagagagaattaaatatctattcctacttacataactcatctataaaatgtttattttactttatccttgggaaggagcaggtaattttgccacctaaattattatttaaataactctagggggaaaataagagactgcagggaaaacatgcaatgatgtttcaaaatcttcttttaggctgggcacagtggctcacacctgtaatcccagcactttgggaggccgaggcaggcagatcacaagatcaggagttcgaaaccagcttggccaacatggtgaaaccccgtctctactaaaaatacaaaaattagctgggcatggtggtgcaagcctgtaatcccagctacttggtaggctgaggcaggagaattgcttgaacccaggaggcagaggttgcagtgagccaatattgtatcactgaactccagcctgggtgacagagcaggactccatctcaaagaaaaagaaaaaaatcttcttttaaattcaaaatttaaatattaaaaatccctgtatagtaaaaactgctatgtctttggaaaaacaatcccccgccttacatgccttcaactgtatcaaatctaaaggaacaaaaattagtgatttagcgcatttaaagtaaagcatgctaaaagcttcaattaaaagcaaatgcatagctttcacaattaaattactaaggtatgtgccctaaataaaaaaaaaattacagtaaaatttgctaaagctaatttatttcccaaattactttcataatcattacactaaatcactatgaaaataaatatgctgtgcgattgtcttctgaaagtctgttcaaagttctaaacctgctaaatgtgtgtactttctaaaagaaatctgcaatatctaacagctaagatactgtaagattttagccttgtaaaaataatctgaccaaatatactcaaataccgtgaaaaaatgttcattcatgcatatttaaaatgaattttttgaagtctctcaccagtaaaaattatctttcaaatttttaacttttaaactaacacctcacttctagtcatcttgattaatttttaaaaaatcaaaacaaacaattgtgcttacaatatagaaaatgtagggagatcactttttgtcttcacatttactattttgttccaagtaaaaccttttattaaatggctggaaaaaccatttcagttatatcattgtctgcctgctttttaataggaaactcttacccacacacatatagtagtaaagcttacaaacctaccagcgaaattaaaaacccagacaaagtaatggaaaaagcctagtaaaacaagaaaaagaaaatggtaacaacataacctgaatatgaaactaaatccccaaagatttagctccttctagggttgtctttataaggttaaaattcttgcaagccacaccccttcatgtgaccaataaaattagagccaccacagaaggatgacctagtcaagttctactttgctgcattacacatgacccacatttggagtgtaataaaagacaatcatgtttcatttaaattatgtgtggtggtctttcctaaagaacacagtaagcaagtagatttacatacttttgctccagtggttagtaggtcactacgtgcaaaattttccaaaggaatttcacttaaataatttcaaagatcagcagggtgcggtggctcacgcctgtaatcccagcactttgggaggctgaggtgggtggatcacgaggtcaggagattgagagcatcctggctaacacggtgaaaccccgtctctactaaaaatacaaaaaagtagctgggtgaggtggtgggcgcctgtagtcccaactgctcgggaggctgaggcaggaaaatggcatgaacctgggaggcggaggttgcagtgagccaagattgctccactgcactccagcctgggtgacagagcaagactccatctcaaaaaaaaaaaaaaaaatttcaaagatcaataaaaatttccaaaaattttgagtaataatggttgccaacatcttgttttgccaagtaagagtattaaaaccaaacataaacaaaactccaactactatcattataatttcatgaaaggacacttgaataaagagtaaaagatacatctgagtaagtttaattttttaaaacaacttgaaattttcagaaaattgtctttatttctatttagatcaatgaaaactcttgtcatgtatcaagaattctgaggatctacctttgaaacttgtatttttagtcattcacttataaagttttcccaagatgactgatggagaaggctataaagaagagaaaaataaattaacataaaggaaagagagactagggtttgccccaacttggagcaaggtatctattgtcacaattggtaccaatgatagacatcagttctgaaaaagagtcaccaatcaaatgtgactttaagtaaagggtacaaggaagatcaaggaaaaaggaggcagataaaacttcaagaaggacatttagcaaacagaataaaaaagagatggccctcctcttattggggatcacttcctttaagagatcagcaatctggatatgaccaactcttctcccctttcctttacaaacccttgctgaattttctttgatttcagaggttaccatttctgtggcttccaaccacccactaacctccatacagggatgcaagatacattctctaaggatataagaagcacttagatggctccatactttctttgtcagaaacaggtaattactggatagctgctaagaatagcatccacttctccagatctaaccttgagacgaattatagctgactggacaagttcagctagtcttcagatttaaaccacacaatctaattcttcagatttaaaccacacaatctaattcttgttttaagtccctctaaaatagaattgttctaggactcttgacataaaagaaaggcacattttcagacatctacacttatatttttaattttaattttaattttttatcttgtttattatactttaacttctagggtacatgtgcacaacgtgcaggtttgttacatatgtatacatgtgccatgttggtgtgctgtacccattaactcgtcatttaacattaggtatatctcctaatgctatccctcccccctccccccaccccacaacaggccccggtgtgtgatgttccccttcctgtgtccatgttttctcattgttcaattcccacctatgagtgagaatatgcggtgtttggttttttatttcatgtttcaatagactctacagtttgcccaaaactacctcagaaaatttagatataagataaattgatctacagtcatgcattgcttaaaaattgaggcacattctgagaaattcatgtgtcattgtgggaacaacacagagtgtacttacacaaccctagatagtataacctactacacacttaggctctatggtatgacatcataatattatgggaatttgtcgtatatgcagtcagtcattgactgaaacatcgttatatggcacatgaatgtattttactattcaatatctaacatctttaaaaccaaagtgtggcttatattttaaaaccaaagtgtgattagcactttgtgaagcatacattgccaaagatcaatttaagtataaattttcaataggttcaccttccatgccaaaattcttgcaactctcaacccctcgtcactaccactgtcaaagaatatattgttatggagagtcacatgagagcaatacagaaagaacattaaaagaagcctaaactcacacctgcttacttcacttatttaaacattagtctttcttttcagttattcatggatatgtactgagctatgaggaaaagcaccttactctgctaaagcaccataagttgttaatgatttttaaagaaaaatttaacaaaaatattctttgaaattgctaacattttcaagacaatgtaagatacaaccaatagataaaacttctaagtgatttctttcagattcagtatgtgttattcaatgaagtagtaacaatctaatttatcaaatcatatcaaatatctattccaattacagacattccccagttggttttatcttctgaaatgtttattttcctacttattattaacataaaatattatgctagctcctggagcaatttgcgttttagcaatgcaaacattttttatatttgcataggcaaagtatggtcatgattcctctctttaagagatatatttccagtagaattctatttgtgttttcacctgggatatagtttgactcacgtatccacacagtagaattttgtatatgcagaaaaaaacttcatgatactgtaaagtttacaatttttctctgaattatcttacctgcatccaacagcactactttaaaaagccttatatggccaagcacagtggctcacgcctgtaatcccagcactttggaaggccgaggcaggcggaccacgaggtcagcagatcgagaccatcctggctaacatggtgaaacccgtctccactaaacaaaatacaaaaaattagctgggcgtgatggcaggcgcctgtattcccagctattcgggaggctgagcacaggagaatggcatgaacccggaggtggagcttgcagtgagctgagatcgcaccactgcactccagcctgggcgacagagtgagactccgtctcaaaagaaaaaaaaaagccttatatttgagacacggggacaaataaacaattccttatatctacaacataacaaacattttaaaaatatattgaataagtacatatatttaacaaaaaatatgtactggtagtattttaacataaaaattatcagtagctttgtgtatgtgtttcttttaatgagttaaaaagttcatcgttactgataatgagtttaaagtgaattaagattttatgaacaatattcactatgatggatgcttacattttttgccaaagttgctcaataaagattttgctcaaaagagataaaaagccttccttttgttcacatattgaggcttacctcaaacagaatcttgtattttaaatatttaagaagggacatttttctattccattataaggcatgttaaccactatggaaaacactatagctactttcagaacttgtctttcgtatacatgtagttgatcctttaggattttcgtctaatggtagataacacctagctacaaatgcccattatttaaaatggttttgtaatacagatacgcactgcataatgacatttcagtcaacaagggactgcatatatgatggtggcccctaggaactgaaaaattcctgctgcccggtagcatcttgatgatcttgaccctgagtaggcctaggctaatgtgtaagtttatgtctttatttttaacaaaaaaaaagtttgaagtgaaaaaagaaagaacttttaaaatagaaaaaagcttatagaataaagattataaagataatatttttgtacatctgttcaatgtgtttctgttttaagctaagtgttactacaaaagaatcaaaaagttttttaaaatttaagttactataaaagttacagcaaaataagattattaaagacaaatttaaaaaataaatttagtatagcccaagtgtacagtgttaataaagtccacagtagtgtacagtaatgtcctaggccttcacattcactcaccactcactcactgactcatccagagcaacttcctgtcctgcaagctccattcacaacaagtgccctatacacatatcccatttttaatcttttatactgtattttactgcaccttttctatgtttagatacacaaatacttaacattatgttacaactgtctatgacattcagtacagtaacacgctatataggtttatagcctacaagcaatagctagagcacataacctaggtgtgtagaaggctctaccatctaggtttgtgtaggtacactctatgatgtttacagaatgacgaaatagcccaatgacacatttctcagaatatccccattgttaagtgacatatggtgtaattatgatcttcagtaatgacaaattttttaaaaggagggcacagacatggttaccagcttcctcacacatctcttttttcgacccccacataaaaacaccacagcttgagatacaagctcaataggacaaagctacacaattcgtagtcacttacaccactctaacaaccaaaagaagaaaccaaaactccagctaatttactccctggaataggattagagaaggtaagcaagaataaattcatctacatattccttttattaaagcctgtcctttgtttccacacaatctgtaagtgaaaactccatcaaaatggttcattcaaaaaagtgtctactattaacaaagcataacaatatacatttatgctgttgtgcatagagaacattatccaaattttctactgaggagccaggagaaatttaatgaaaatgaaacaatatgattattgactacagaaagaataccttttttggagaaaaaatatatacttacttagtcagctgccctttattcttgttgttatcaactccattgtaagtcacagctgccagttttctgcttccatagttctcgcagtggacattgttagtaacatctttcaagtcctgcatgtgtgttctgtcataaataaacagcaagagtttgcttctgttaatagctagggggcataaagctaaaaaagctttaatataaattcaaaattttaccaaaacaaaaatttcagatttaaaattaacaaaagactattgttaaggaaggtagcattcatctgttttcatttacactcaaagtagaccaataaaaaataagctaacttgacaccaaatttagattccatagagattttaagacccatagcaaggacttcatgactaaaacaccgaaagcagtggcaacaaaagccaaaattgacaaatgggatctaattaaactaaagagcttctgcacagcaaaagaaactaccatcagagtgaacaggcaacctacagaatgggagaaaatttttgcaatctacccacctgacaaaaggctaatatccagaatctacaaagaactcaaacaaatttacaagaaaaagcaaacaactccatcaaaaagtaggcaaaggatatgaacagacacttttcaaaagaagacacctatgcagccaacagacacatgaaaaaatgctcatcatcactggtcatcagggaaatgcaaatgaaaaccacaatgagataccatctcacaccagttagaatggcaatcattgaagtcaggaaacagcagatgctagagggggtgtggagaaataggaacacttttacactgttggtgggagtgtaaattagttcaaccattgtggaagtcagtgtggtgattcctcaaggatctagaactagaaataccatttgacctagccatcccattactgggtatatacccaaaggattataaatcatgctactataaatcatgcacacgtatgtttattgtggcactattcacaatagcaaagatggaaccaaccaaaatgtccaccaatgatagactggattaagaaaatgtggcacatatacaccatgaaatactatgcagccataaaaaaggatgagttcatgtcctttgtagggacatggatgaagctggaaaccatcattctcagcaaactatcacaaggacagaaaaccaaacactgtatattctcactcataggtgagaattgaacaatgagatcacttggacacaaggcggggaacgtcacacacgggggcctgacaagaggtggagggctggggaagggatagcattaggagaaatacctaatgtaaatgatgagttgatgggtgcagcaaaccaacatggcacatgtatacctatgtatcaaacctgcacgttgtgcacatgtaccctagaactcaaaagtataataaaaaaaaagaaaagaaaaagaaaagagaaagagaaatgggcataggagggaagactttcttctagggcatttgagattgtcaagcccagatgacaggcaccacctttccaccttatgcctcattaatggaaacaacacaaagcccagatctaaggcagagcttcccaactatgggcctgcatctcaatcttcaccttccaggaaccaggcagtgtcttctgggctgattacttccagtttacctcattgtgatgtccaaatattatagctcccctctccatgatgatcatggaaaatatcagtggctccaaattccaattgtttcaccttagaaaacaaatctgagaatccccctaccaccaagcacagtacctggatacaacaggcactcaataaatatttgctcagccaatgcaaggataaatgaatgaaattcctcatccctgtattcatttctgaatacgtgctggtgaaaatctagctctaaacatctttcagatttagtacattgaggtatgaaaaagaaaaaataaaaggacgatgcaaacgaagtcaggagctggcacagaaagtgcaatcagattctgcttcccctgtaattaagagtgcccaatgccgctgacttaggcgatgacagcgtgcagcttgcctgcccgccctgggcgcctgggagggcgggcagccctcaggatgccgctgcacaacacgttcgccaccttatcaagaattccacagccacaggaagatttttcaccccgccataacccccgcgggctgccctgtgctgtcacatgtccccgctgctcagagagagaaagccactagggaggccctcaatggaaatattaccccctatccaggctagcatgggcttgatcgcccctgattatttctgatcactgtcactgggccaagagcacagcgaagtcaagaaagaaatggccttattagtgagaacgcagcggtatgggtaggcagtggcgtggaggacctgcttttgtgagggcagtgaagagaggggaaggagtggtgtctttatattgagatattttgagattcctgctttctccactcacttcaactgcccaaataggttctgcaggttccggaaggttctagaacttgtacaggaccgaacctacagcttctcatggaacaaacccagaaccaagaaaatctggcggaaatcaccttgtttaactcctttgaggtctagaccagaaattaaatagtgcttaatctgttactttaaagaagcctagttctaactttacctcagctcgctccctcttttgcctaggataggaagggtgggtgcaaatggtcagctccctgtaggtcagcctcttggagccctaagtttcctgccacttctatgcactatgggctttgcccagggtgggatcctcagcccagggaccttgtttgtcctccgcctcttgatgctggtgcctgctgcccagccacataccctcagattcatttttaaagaaacgtcaacagctgttaaatggcaaatgagcctttcaaagaggtgggatgactttgaaaaagggcttgaggacagcagtcgacctctgaccgtctcccctcagatgccctctccatcccacgctctctccctgtccccgacctctgctttcccagcgagcctgcctgctcttcaacgctcctccctgcccgcttgtgctgtctcaacacctcccatgttgcttggttcctaaaataacatagaggaaaacttttttttttttttttttgagacggagtctccctctgtcgccaggctggagtgcagtggtgcaatctcggctccttgcaacctccgccacctgggttcaagtgattctcctgcctcggcctcctgagtagctgggactacaggcgtgtgtcaccacacctggctactttttgtattttttttttttgagacggagtctggctctgtcgcccagcctggagtgcagtggaatgatctctgctcactgcaagctcagcctcagggttcatgccattctcctgcctcagcctcctgagtagctgggactacaggcgcccgccaccacgccctgctaattttttgtatttttagtagagacggggtttcaccgtgttagccaggaccttgaccatctcttgaccttgtgatccacccgcctcggcctcccaaagtgctgggattacaggcgtgagccactgcgcccggccaaaaatatttttttaaataaagaaaataaatcctcggctgggtgcggtggctcacgcctgtaatcccagcactttgggaggtggaagcgggcagatcacaaggtcaggagatcgagaccatcctggctaacacggtgaaaccccgtctctactaaagataaaaaaattagcctggcgtggcggcatgcgcctgtagtcccagctgctggggaggctgaggcaggagaatggtgtgaacccgggaggcggagcttgcagtgagccgagattgtgccactgcgctccagcctgggcaaccgagcaagactctgtttcaaaaaaaataaaaccccataaatctcccaaagcagttactgaaggatgacctttctatgaaagagtgttctttatattatctatttaaatactagacaagaaactgtagattagctactactgaagctcataaaatctaaaagaaactgccttttagcaatattactaaggtaatatgtgagtttttattaatacataataatatatttcagatcacatatcaagttgttttcaaactagggaattttagaataaatttctgtttcttcgaattgtctaggtgaatgtggtattttggttaaacaaatttttgtttatagcatttctatcatatataaaatcagtacatatgagataaatccacaatacatatgggatgatgtcatcattatttaataattcaagacactgaagataccctcagctgctctatggatatcctttaccaatgcagtgttcttggatatacgtggggtggcaatactctgtattgtcagtcctccctcttttcatcatgtattctatttcaaacttcctatatctgccatcattcatcttcaccacgttactaaaactcccttctgggagacaaacataaaggtgtattgttggctgggtgtggtggctcacgcctgtaatcccagcactttgggatgccaaggcatgtggattacatgagctgaggagtttgagaccagcatggccaacatggtggaaccccatctctactaaaaatacaaaaatcagccaggtgtggtggtgggcacctgtaatcccagctgcttgggaggctgaggcaggagaattgcttgaacccaggaggtggaggttgcagtaagccaagatcgtgcactgcactccagcctgggtacaagagtgagactccatctcaaaaaaaaagtgtatcattgtacatttttatcattccttacatccagaaaacccttactgttactttacaatccagcttcttgaatctccccctttgtgaataaaatgtgatattcaattactctgattcatatcgtactgacatttgcatgcaactctctgatagttcactccccttagtcctaagtctgggttttccaaaaatctcatctcccagactctgtcccttgataaattcatgttctcttatagccacaacagttacttctaaagctctaccactccacttcgggcacgtcaggcaaaataaataagcaggtgggatcaagattttacagcacaattttgcaggtaattttaaatctcaagccctatgaaggttacccaaaaaatcctataatagagaggaacattaaaaaggagaaataagatattcacttcgcaaaattactcctttgggattctagttactaaactccatcttgcagtttgatatgtatgagttactgcccagaatatacagacagtccttccatcctgtgcactgggatgatcacttccacttcttcaaatccagctaaaagcatcactgcctccatgaagcctactccagccagaattgttcacttgcctcctctctgctcatgtcctatatattacacaagcagaggtcaccaacagtatttttcatcaacagtttagagcagtgctgccaaataaaaataccatgtcaatcatacaagtaatttaaaattttcttagtagccacttttaaaataggaaaaaggtgaaattaatcaattttatttaacctgatacatccaaaacatgatcactacagtatacgatcaatataaaaaattatggagatttttttccatgctcagtcttagaaatcggtggtatattttatatttgcagaacatcacaattcagactacccacatttcaaagattaatagccgtatgtggctacaggctgctgtactatttaataaaaagtgcatatctagagtctagccctttgctctataaagtgtgatctaccatccagcagcatcagcatcacctgggatcttgttagaaatgtagaaacacagcccatctcagaactactagaagaactaaatttaacaggatgcccaggattggaatgcatagcaaagactgagaagcagtaaattagatcacatataccttgggagtcttacagaattgctattgctattcaactatgatatggcattaccccactgactaatatagaacactgtatttaaataacaatagcttttctatgaatcatgttttctctacactgtccaatgcaattttctgaaatgatgaaaatcttcgtatatgtgctgcacaaaatggcagccacttgccacatgtggctgttgagcacttgaaatgtatctggagcaaaagagaaattgcatttttaatttaattcatttaactgatgtaaacatttggcaaatgactatcatactagatagtacaactccaggagaattggttactatgtcacagtttcatctctaggagagtccttaggacaaatttggaaagttctagtcaagataattcttctgattaactgtacttcttttttttaatgttatgaagtcatatttaccatcttacactggctaagggcaaatttgcatcttacctctaaggaaggataataaaagttacaacatgtgctttgtatgtattaatattattccagcttatcatcaattaacaatactaatatccatacctgtacagtctttttagttctatgagaaggacctgggtactctggagaatacaaatctgtgaggaataatgagttgattaatgtcgactttcccaatccagattcccctaaaagaaataagggaaaatatctgttaaactcacccattttacccaaccttaaatattcaacagatgctataatccaacttgctttatgcaagtacttcttggtgagacaatgaaatgacattagaaaatatgctacaaagagtatcttgtcctcagtttcttagctatcaaattagactcatgtttccaaggattcttttcagccttctaattatacttatattcattaaaagtaatgtatctaataatttacatttttaacagtaatgtgttcccaaggaaaaacttcagtcatttaaaaaaaaatccaagttggattatgtatcactgcttcagtgaaataaagtttttctttattaatagacaataatggatgaccaaaagaaatcatgcagctacaaaaagcaaaaatctgctaatacaaagaataattaatcacaatgaacatctccacataaaattctaaatcacaaaaaatactttctaatttagccacccatcagcctaaacataagggtgcttctccataaaccagaatccaaaaaaatcttaggtaattactttttctaccacttctactcgaggtagacaggaaggaagctacggcatgatttccactctgatcacatactcttttttgactctccatgtctagtccaatatacatagtctagtgtatagtaactattacaagtataccaaaatataaatggcttcaaggtatatataacctaaggttaaaacaaattagaattcatattatgataattaacatggcacagagttaaagtatttactgttaaaaattcacttagaataataggcatgtttagcctaagtaaccgatggcacaatacttatatgtctaggaggaattctttttatattagctttcaaaagagataataagatcctttccacatggtttgggcttacccctttgacttagagcatgccactttttactagatgtaaaaatgccataaaggtctaagtcacaggaaagtaacacgggttggccacacctgattctttcttaactcttacaccttgaaggcagaaagactagaataaaacccaagcatttggatgttaccagaaatatctataatatttccttttggaaacataaatgaaaattttagtacatacaacgttttgggaaattaaaaacaaaagtatgctaattaaaatattaacactgtactcaataaatcatgtttagagggctttttttcagttttttccctttttatttgtggtgaggagtgggggaacaagacgatgcaggacaaagggaaaagagagaggaagaaaaataaaagtctgaaaggtaacacagtaaaatgtaaaatggtggctactctggggttagtacaatgagggtgagatttttttcttagtttgttatacttctgggggctgcaaacttccttcaacatgattctattattttcataagttaaaaagcattattgagtggcatcagcaaaacggcaaattaaaaagctcgaagactcattccctcacagaaaccccaaaaacaaccagaaactagttgaattaaccttacaggacctgtgaaaaacagtcaaatgtctatagcaacaaagcaaatgcccaattgagaaaaaaaaaaacatgtaaaacttttgtgacatttttctgtgatcttgtcccaccccttctgcagtttatctgggtctggaggaggcagcaaaccaactcccatttcattcccttcaaatgggcgggaagagtgcagaccaaactcgtaacattttaccctctctggtcggccagaaggactgattcctgtttacctaactggcacctcatccggtaagagaagcaatgggcgccatttaagaaagctgcaaggctacacaatatgtttacactataaggaactagaaaaagaagagcaaactaaactcaaagctagaaaaacaagaaaaaaataaagattagagcagagataaatagaagagatttttaagagtagaaatcgggccgagcatggcgactcacgcctgtaatcccagcattttgggaggctgagaagggtggatcacctgaggtcaggagttcaagaccagcctgaccaacatggtgaaaccctgtctctactaaaaatacaaaattagctgggtgtggtggtgcgtgcctgtaatctcagctacttgggaggctaaggcagaagaatcgcttgagcccaggaggcggaggttgcagtgagccgagatcgcgtcactgcactccagcctgggcaacaagagtaaaactctgtctcaaaaaaaaagaaagaaagaaaaagaaaagaatagaaatcagccgggctcagtggctcatgcctgtaatcccagtacttcgggaggctgagatgggcagatcacggggtcaggagattgagaccatcctgcccaacatggtgaaaccccgtctctactaaaaatacaaaaattagctgggcgtggcggcacgtgcctataatcccagctactcgggaggctgaggcaggagaattgcttgaaccagggaggcggaggttgcagtgagccgggatcgcgccactgcacgcactccagcctggcgacagggctagactccgtctcaaaacaaacaaacaaacaaacaaaatagaaatcaacaaaaccaattgttcttaaaaagaataaacgaaattgaccaccgataaactagattcagaataaaagagagactcaaattactaaaatcagaaataaaagtgggggctgggcatggtggctgacgcctgtaatcttagaattttgggaggccgaggtggggggatcttttcagctcaggagttcaagaccggcctgggcaacgtggcaaaaccctgtctctactaaaaatacaaaaaaaattacccggtcgtggtggcacatgtctgtaatcccagctactcaggaggctgaagcaagaaaattgcttgaacccgggcggcggaggctgcagtgagccgagatcgcaccactgcactccagcctgggtgacagaaagagactctgtctcaaaaaaaagaaataaaagtggttcatgattttcctagttaaggactggactgtttgccaccaccccaccccccgcttttttgagtaacttccccttttggaaacagtgatgaaggtttctccctttattctaaacagtgtgtgtaccttgtagtactatctgccatcaaatttctaaatgctttctgcttttttaatactctttaaaaattagcaaatacatagttatactttcagttaagattatattttttcccactggattttttctttatcttttaaattcttaacattgactatgtgaagtaatacgctgtataccctgaactcagctatgaggtatttaacatatcatgggatatataaataaattaacttccatcaattcctagactacttacactgaaattatggaccaaagctttctaattcaattcccaagtggtattaaaaccaaactgtattgtatttcaagaaattttatccacggttacaaaagtttaaaaacttatcaaacaagtgggaaaactgcaatttaaagataaatgattaggtttcctatttttttaagaccaactacaatgtgaaccataactacactaactgggtgttctctatcaaagtcaacactgcaaacaacaaagggtatcatctggccaagaaaaagataatttctgattccaattcaacacagctcctgtgtaacaggtgtttctctagttctcagctccacatttatgcttgagttatttctatgctagttgtagttttctttttaagttgcctctgggcaaagtaaacctttcataacagattgagaactgttccatttcctcaactttaagatacaattttgccccccaatatttctaaaaacaaatgtctcataatcaaaatgtaattgactgtactatttaacctccctcaaatcaaatttgattatatgtttcagagtagatcttatcttagaatcaaggaagcaggaaaatcaaagcatttcttcccctagaattgaattcaattagaaaagccaaatcaataagaccttaattattttgtcctataattgagaactttatatttaattcttagaacaatttattctgaactaaagggatttctatttccttctaaattggaagacccaaagaaacagaagcctttaacacaaacttggatgagaaataaggaaagtaaccaagaccatctcccaccttgaggctcatgaggtgaaacaaaagctcccgcttgagagagttatatgccacaggggaaatgaccctcaaagagacaagtttcattcagagtaaggaggcaggaaaaatgggtaccaaaaagtagttgaaaactcagtctgctttttctggttctgtacataaggagcttggaagttgccactccattctaagaagtaaaaaactgaacagatctcatctttaagagcagtatccaatctttaagagcagtgaggacacaaggcaatgatccagcaattgctcttcttgatgtttacccagctaagttaaaaacttagatccacagaaagtcttgcacacaggtatttgcagcagctttatttatatttgccaagatgtgggagcaatcacaatgtccttcagtagtcgaatggataaatacactgtggtacatccaggaaatggaatatcactcagcaccaaaaagaaattagctaacaagccatgaaaagacatgaaccaatgtatactggtaagtgaaagaagccagtccagaaagaatacatactgtataattccgttattataattccataattatagtgagcaagatacttgcatttttggttttcttacatatcgaattagtataagagtatgaactatgaggaataaattagataatatatgtgaaatctaagcacagtgcctggtacacattaagtgctcaataagtagttgcattatttctgtgattcatttaaggaaattagaaagacttgaaagtttgatatgacagaagcaagaatataaataacaaaatttttaaaaacacttaaggcaaaaacttggaaacaatgggaagttagcaaattccacgttaaaagactaataggtcttttggatatggacaaatcaagtgcttaaaaagtaaaatgattgaaataatatgcttaattgtcaaatatatacacagaaatttctacccagagaataaacatatttttgaaacctatggaatacttcaataagctgatcctatgtaaggctacacagaaaaataaatcaatactggaacctacagatcatattttctgaaggtagtgaaattaaaaattaacaaaaaataatgtaatccatctgcctacttacatatctctctaactcttcttatttgaaaattactcaaatacaaacaaaatgagtattacacataaaaaactaagatatgtgactaaagtattcagagaaaaacccatgcttaaaataagcctaaagaaaataactcgaccatcagtgtggttcttggtgaaactgtaaactggtacagcttttctgaagaataatttggtaatctatcaaaatttaaatctacatgccttttgacccagggtttcactttcagaaatgtatattacagaagcatttatatgtatgcctagaaatccaaggaacctaagcactgtttgtaactataagcatccatcttcattaatagctgactgtataaatcatgataaagatattttagaataccacataattgcaaagaatatgcagacaggaatatatgtacagtatattcagtgacagggaaaaacagtcacagaacagtacttatagcacggcactgtttacacacacaaaaattgacatgggaatgcctggcgtatataaaagtataaaaaaaatggcaaaagacttgcaccagtttaatgcttatctctagagacaggactggaaatgaaggcaggagaaaaaaggaaactcaccttttactaaatgtctttagaatttagtttcttaaaaataaaaatgtatattgtataaacttttctttctttgggaggctgaggggagggtaataataaaagggaatataccaagtttctaatagtgtttatttctagatggaaaaggtagtgaaacatttaaattttctttctttgtatatcagtttttctacaagaaccataaattatataatatttaatttttacttttaactctttaaaggggttgataatatgttatactacaaagaggtcaagaagaatgcctgagaacaggctacctgcaaatataatgattgggagtactgggataagagttaagagaaaaatgagtattgagtccagtaagatactacagagcaaatgaaagggaagcatcaggcgcaggttactgcagatgctgaccactacagatccagacagctgtactgcaggaattctcaatcttggcactactgacattttgggttggacaattctttattgtgaggagtgtcttgttcgttgaaggacgcttggcagcatccctggccttcacccattagatgccagttagcctccctcctccccagctgtgacaaccaaaaatgcttccagacattgacaaatttcccctggggagcatttttcaaattttgaatccccaaatcatctagcactgataccactatgcatggaaaataatgacagtgacagccagtaagttgtaaattattctgtgtgccagtattttacaagcattgacttagtcaacctttataatcccatgagattgatactacaggttgtgtatcacttatccaaaatgcttgggaccagaagcgttttggatttggctttttcaaattttagaatatttgcattgctcatcagttcagcatccctaatctgaaaatccaaaatccaaaaattggttcaatgagcatttcctttgagtatgatgtcagcattcaaagtttcaaacttcggagtatttgagatttcagatttttggattagggatattcaatctgtatcattattgttaccatttggaaacaaaatgaaataacttgctggtgccaaatagttaataaggggtaatgtcagtatttgacactaggcagcatgttctactgcctttctaaatacccactctcatttatccattaaagactctgtccccacattcccaagtacctccctaatctggttaaccaggttggaccatatctgacatgggatattttaccagtatcttcattaacaataatacttaatatttttattcaataactataagaaagacactgagctgggcactttacatgcattcaatgactgcaataattacaaaactctgcataagactctttacacaattttacagataagtaagcaaacaaaacctctgagaagtaacttgccaatgacaaatatctctaccaagtagcagagctacagctcaatctgaatggcaaatctcatgtccttaatcatactatacttcccagactctgagcagatgaaaggaacatgcttcttgacctctttgtcctgacccacttagtcttttttttttttttttttttgagaagggtctcactctgtcgcccaggttgaagtaagtggcacaatcacagcttactgcaacttctgcctgctgggctcaagtgatcctcccacctcagcctcccaagtagctgagactacaggtgcatgccaccatgtccagctaatacgtttctaagagatgaggtctcactatgttgtccaggctggtctcaaactcatggattcaagcaatcctcccgcctcagcctcccaaagtgctgggattacatgtgtgagcaccagggccactgcttttactgcactacccacaatgagtttcaaatggaaaagtaaaggataaagcaattcaaaatttagaagaggaagaagagagaaactaagttcaatagcctttaatcttgtcagactgagtacttctacctacccctggtatcaagtcccacatctgtcctgaaactaaatcctaacctctttagcaggctgagaaagagggaaaaaagaaccttttacaagatatgataatagatctatgtcctttcaagaataacactgattcagtgaatattcttctaaagtacagtcaaaacccattgagcaagctcatacagatgagatatttgtaggttattgtattgtcttaatgattctagtgtcataacacagaggttaccaaaatgtcattcaaataagcctgataaaatgcagtttatttcccataagcaaagtcaccttactcaaatcactgtgactgtatgacattgctatgggagctctaaaagcaaactattgtgtaatgagtgagaagtccttttacttggtagcagaggaaaatacagcacctgagaaatatgaaaatagtttggtaatactattcttccctggaaatttttcctaagaagtaccctgaaggtgtaaattaagtgcttccttaagtatcacatacccttaatctatctcattttttttttcaaaagtaccaataattgtgagaaagtagttgtgtaactttgaaaaagtctaggggcaaaggttatagtagtccattagagcttaaaatttccttgaaatctcttatctcagttccatcaataaatttgtcttgtgaccttgggtaaaccataacttctgtgtgtcagcgcccttatctatgaaatgcagataacagcagtacctacaaaaacacagagtggttgtgaggaataagtgatctcattagaatcataccttggcacagtggacacttcaatatcaatcataggtagttgcaatggaatatattttattactattcatgttttctcacagaaaaagaaaggaccctagtgtaactactaagaataagggtcaaaggtgaagtagacagccttaagaagggaataaacatttgaaacagggatgcagggggatggagtagaagagtaaggttggcaatttattgacactaaagggtactggcctcaaaataaataaaaaggaatgttgaaagcagtgaggctctgcctgagtttggacattaatattaatttctactcacatttagtagataatatttacttccatagcaaaatgtcagatggcctataattacaagacaaaatatagcagccttgttctaataacctcaaagtgacttataactacaagtgatcctttctcattggcattactaaagggaggaagtagtgtcattaatgcaaaagaatagagaactataatcagtcctatcaaatcaaactctacttaaacacaaaatctgtggaaacaacccaaatccagtgtacttctgcattattaagaaaacatttaagaataatagagttcagaataatatatatactggcttaagaaaaacctactcaagataaaaagactatctgtaacatttcgtatttcttcaaactaatattttaataaacacaatattttttaatgttccaaattaatgtctattttacatttattttgactttgaaatgcactatacatgttttgcaacaatgtcgttatcattccctcattttactgcagcttaagggtaaataactggattaaaaatttctttgttctcgttaaaacaaaatataatatttacaatttaaggtgttactctatgaaaataatgaaacaagagtaactagagtcagtaatacaacactgtacgttaacctaataagcaggttaaaataacacatgtctttctcatctttgaggtctcactgatgaaagccatgtatttcatcactcttcatgaatgttaaatttcaagcctaacaataaaatattcatcaaatatttgttcataaggttttgaagaaagtcacaataatatctgtttataatagctaatgtcaggtttcttcaggtctttgggattgggctcctacagtatttataataaaaggatctgagaagtcctgctttaaagataattgcttatctttgctttactcagcatctcaactttatatccgtttcttattaatctctagattttctgagactaaaagtagtagtatctgacactttataagtgatcattaaatttttatcaaataaatgaatgaggaatgcaaagatacgatgtagtctttgcccttaaaaagtttagtatggtagaagaagtaagatatgcaaacaaacaacgaacaaataaacaaggcagaactttatcaagaccatgaatgagataccccaaagagaaagaatttcaggaaactgagaaatcacaccagcctggaaaggaggtcacatttcaatgaggctttgaaagatggagtatcatttcaataagcatttcaactttctgggatatctgcagatacaaggggcaacttttaccattttgtagcaattgtatagaaaagaaagcaaaggatttttagaaacagaatctttaagtcctttcagaatgttttaccatgttagggttgaggcaagaggaaagcctcagaggagctggtgataacattgtggagcttttctatcttgttcctctaactccttccttcgtttttctcctgggttttgaaatcaattttgttcaaattcaaatcctagttcaatcacatacaagtatgtgaccttgatcaagatacttactctattaattaaatgcacagggcttgacattttaaaaagcacctcaaatgaaacctattattaagagatgagacaacagcaaactatggttcttaactaaaatacatattagtgtcatcccaggagctacttcaaaatagatgaatattccatccttgacccaaagcccagaatatctaggcaagtgtttccaggaatactttgaagaagcttcccaaaatgatttgaaaggtagataaaattaagaaattcttatgttcatgttgttctctccataaaaagaaaattaagaaattctagtaaataaaggatgacatagggcaacatgccagattacatcaacatttaaaggtggcccataggaaaggatcctaataaagcagcttcaacacaaccaggtaaaccaggaggcagcagcacaaaaagtgagggagagtttcaaggaaaaatggtcaataatgccaaataagttaaagaaaaatacaatcagaatgccttttactgacctttaataaaagtagttttgcattaaggggagaagccaaatggtgataaattaagtactggatgggaaatttaaaagtagaggtttattttttctttgcatctggctataaaatgacgaaaagataccacaccaagatgttttgccaagggagggcgctattctttgttttactttttaataagcttaatctggtgaagatttaatctgtgaagaacaggcgtccccaacccccagtccgtggcctgttaggaaccgggccacacagtaggaggtgagtggtggtgagctttactgctggagctccgcctcctgtcagatcagcggcagcatcagactctcaaaggaatgcaaaccctgctgtgcactgcgcatgtgagggatctaagttgcgtcctccttataagaatctaatgcctcatgatcagtttcatcctgaaaccatccatcacccatcccccgcccccacacacacacccacacacaccctggcagaaaaattgtcttccataaaaccagtccctggtgccaaaaaactgggagctgctggtctagactacattagataccaatcattttcaaggcatcccatacatatattgatctggagtttgctataagacaatttcatctcctcaaaatctattagtatatcctttaacatacacactgatgtacgtgctaacactaaaaggcaagctaaataggctctatataacctggccctgcaattatcttaaaagaagtttacttattctaattactgtaattgcaccagtactaagaactaagtaacaattgtgctgtgtagctagtagcaaacattccaaccagctgctcaataattacctcatttgccaattcaaacagctttcacttgctacatgtcggaggctgggaggcgctaagaggtatgttatgatctttcttgctatactcagaaataaaagcattccttatacaacccagttcaaggggacagcttcgttgttaaatcatgatgttaccagagaaatccttgcagcctactcagaatattttcatcatgatttagaaaatgattatcccaattttgtagtaaaaggtattgcctgacctaggttagggtctgcagcgtttcctaagatatataccaagtttctgtaagttcttttgctaaactgaaaagagttcaaattgacagtttagatactgtctctgagctgtccctcaatgttcctcgaaattcttcccattacctgaaattctaattgatcattcaatacacattcccccttaaaaatcaagtatttttgtgaatactgttagtctttcagatcctggaataagactttccctctaatttctattttgggcaagcattaattaagaaagaaagagttttaatttggaagaaaatagggctagttttgaattacatgaatcagaaaaagtagattttgcagaaacataccaaagggctctctaaaagtagagggcaacttacagctggccatagggcacgctagagcgtaagtaaaggagaaatatcaggaaaatagatattattttacctggatatctaacggatagaagaggggaagcaaggtgttgatttattcttgatcaggtagcatgttctatagagtggttctaagaagtggctttcaaagcagaagtgggtaggttttaactgtttgaattagataacctatagattcttttaagttcttactttctttaaatctcatataccaaaatatatcccctaaggaccaggggtgaactatatgaatcatgccagtgattatgtgaattatatctcactgatatttctttttttattattattatactttaagttttagggtacatgtgcacaacgtgcaggttagttacatatgtatacatgtgccatgttggtgtgctgcacccattaactcgtcattaacattaggtatatctcctaatgctatccctcccccgaccccacaacaggccccagtgtgtgatgttccccttcctgtgtccatgtgttctcattgttcaattcccacctatgagtgagaatatgcggtgtttggttttttgtccttgcgatagtttgctgagaatgatggtttcaagcttcatccatgtccctacaaagggcatgaactcatcattttttatggctgcatagtattccatggtgtatatgtgtcacattttcttaatcctgtctatcattgttggacatttggcttggttccaagtctttgttattgtgaatagtgccgcaataaacatgtgtgcatgtgtctttatagcagcatgatttataatcctttgggtatatacccagtaatgggatggcagggtcaaatggtatttctagttctagatccctgaggaatcatcacactgactttcacaatggttgaactagtttacagtcccaccaacagtgtaaaagtgttcctgtttctccacatcctctctagcacctgttgtttcctgactttttaaggactgccattctaactggtgtgaggtggtatctcattgtggttttgatttgcatttctctgatggccagtgatgacgaacattttttcatgtgtctgttggctgcataaatatcttcttttcagaagtgtctgttcatatccttcacccagttgttgatggggttgtatgtttttttcttgtaaatttgtttgagttcattgtagattctggatattagccctttgtcagatgagtagattgcaaaaattttctcctgttctgtaggttgcctgttcactctgatggtagtttcttttgctttgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtttaaggaagggatccagtttcagctttctacctatggctagccagttttcccagcaccatttattaaatagggaatcctttccccatttcttgtttttgtcaggtttgtcaaagatcagagggtggtagatatgcagcattatttctgagggctctgttctgttccattggtctatatctctgttttggtaccagtaccatgctgttttgtttactgtagccttgtagtatagtttgaagtcaggtagcatctcactgatatttctttaaaaataaatgagtactgcactcatttatttttaagttacaacattcacaagaaatataacaatgaaactgtcattagtgttgtgactatacttaataaaaagctaggcaaaaaaagttttgaaaagacttctgacactaaaaaagttgcaagtacaaaatttcagaataaagaacagtactttttttaaaatttcaaataagtaatcaaaggcacataaattaaaatgtaatatctttgtctaatactgaattagtaaataccaaatttgacatttaaaagagatttccgagcagctgcggacctcgccaagacaatgcagactccactgactattcctgtgcccgtgctccagttaccctggggccctgatggcctcagccttggctttgccccgatggatgctggggcagttgaagccagaggctcctgaaatccaagagtgtcccatactcaagaatcgcaggaatcccaggagcagtgggctcgagctgccctttgggaacgttacctccacagcatgctggccatggagtatcaacaagtgagcttcattcacattgtacaactatgtgcacatggctgcccatttcagaaccaccaatctggacatggccagcttctacgtgtcacagctcagctgcagattcccataggtgagcagaggtgctgctctaatgtaatgacataatttcatataccttcaagccataaagatctgtgctcatctttcggcttgggtctaagccacagtatcccaggcctcccaattttcctgagccaggaaatctgggcctcatggagttatgggcccccttggaattctgagccaagctccaatcaactctggactcctgagacctcctgggtctagtcagtaaaattctgcaactcaaggaattctaggtcccattggaaggaatgatttacctcaaagaactctgaactctccagatgtataggcctgatgccatttcctaaagtctgaggcttgggggtggggtaatacaggtgggcaaattacagagtgggaagttatttattgaagaggttgcaaagttcagccaccctgaagatactccccattgcttctctcctcctaaagaaccaacttctccaggaaaataaaagagatttccactccatactggcaaggatgagatacatatgggcattcacacactatagaaactgtattagttggtatgacattttcagttaacctcctttaccatgccatctacttctaggaatgaaacacacagagaaaaacactgcagtaatattttaacaataaagaagtgtgtgtgtggtggcagggggagactttccaggtgcaacaatgggaggtaggctaagcttatcatgatacacctataaaaatattattcagccattgaaaattagtttttaaagttctgacacacagaaatgcttgccatagcattagatgaagaaagtatacaaaatgaatatgctattacaactatgcctaagatgcagaaaatataacaaaatttaacgatggtgatgtcctcttaaaatgccatatactccttcatatttttttttttttgagatggagtctcgctgtcacccagtctggagtgcagtggcacgatcttagcttactgcaggctctgccccccggggttcacgccattctgctgcctcagcctcctgagtagctgggactacaggtgcccgccacctcgcctggctaattttttgtatttttagtagagacggggtttcaccgtgttagccaggatggtctcgatctcctgacctcgtgatccacctgcctcagcctcccaaagtgctgggattagaggcatgaactaccgtgcccggcctcatattacttttctaatcaaaaaacattttgtaacaagtcctagtttttataggaagaaaatttcaagccatatatctgaatatctgttacatcaaaaaacaggagttatctaaatatccaactacatttcaaacaaatatataattcatgttgattcaacaagaaaggcaaacatccacatataaaaaatcaggctcaaaatttcaaactaaaactttttttaaagtttattaacttttaataaaagcaatccctaagattctttctatcactgatattaaatacctgatacagtcaagggaaagcaatatactcaaaaggtttgcaaggagtagcattaatattcagcaactacaaagcaagtgcacccttcagactaaatagtcatgtgacataaaaaacttgagcacaatatttacctgcacagaatttaagaagccaagctacacatctaaaccatgttttaaaaaggaaaagaataagttatcaaccatcttttaaatctgactctcagcagaaaagagctttgcccagcaatctgtactgaattacaaagagcacacatttgccccaaatgtttgtaaccaaaaaagttcaaccaaaacagaagtccaaagtaaggattaatgaaatatttagcttattaattgtacatcattgactaccatccctgctttcccttttctgcattcctcgttttggatcttaaaactaagtcatgaaaatgcacaaataaaaatatgtttaaaattaacatttatacaatttacagatttactaggtattttacatatgtaatatatatactaagtacattcacatagacaattatctcaagccctctgtgaggcaggggtagtcactcatagtgcacagcattcctgtgtaagtatctccactctaccaccttcccacacccacaggttcttagggaaccctaccacagctcttttttatttatttatttatgagacggagtctcgctctgtggcccaggctggagtgcagcggcggatctctgctcaatgcaagctccgcctgtcgggttcacgccattctcctgcctcaacctctcgagtagctgggactacaggtgcccaccacgacgcccggcaaatttttttgtaattttagtagagacggggtttcactgtgttagccaggatagtctccatctcctgacctcgtgatctgcctgcctcggcctcccaaagtgttttatttttatttttaatatttttttagaaatggggtctcactctgttgccaaggctcatctcgaactcctaggctcaagcaatcctcctacctgggccttccaaagtgctggaattacatacatgaatgagcctggccttcttttacttttttgtaatcaaagtgcagtgtttggcttagaaaagactaggtaaggctcggagcgatggctcatgcttgtaatcccagccaaggtgggcggatcacttgaagtcaggagttcaagatcagcctggccaacatggcgaaaccctgtctctactataaatacaaaaattagcctgttgtggtggtgcacgcctgtagtcccagctacttgagaggctgaggcaggagaatcgcttgaacctaggggggcggaggttgcagtgagccgagatcatgccattgccctctagcctgggcaacaaaccgagactccatctcaaaaaaaaaaaaaaaaaaaaaaaaaaaaaaggctaggtaaatatttgttgagaaaaggaaagagattcggccaggcgcggtggctcatgcctgtaatcccagcactttgggagggcgaggcgggcggatcacgaggtcaggagaaggagactatcctggctaacacggtgaaaccccatctgtactaaaaatacaaaaaaaaaaaaaaattaggcgggcgtagtggcgggcgcctatagtcccagttacttgggaggcggaggcaagagaatgccctgaacctgggaggcggagcttgcagtgagcggagatcacgccactgcactgcagcctgggcgacacagacagactccatctccaaaaaagaaaaaaaaagaaaagcaaagtgagattcaaagtgatctgtccagggtcatacagcttgtttgtgatagaaattgaagttttaaactagactaagtatgatattcttttcagtgtgacagctgcggcactgagtattatacagtagatataaagttagtttaaatacagaaggcttattttcatggtgtgacaaaaacataagtcaaaaacgtgaataaaataagttcttttacaaaattgccaaaataaactgtaaattccaaatttatacacaatagtgagttactggtttcaagattctaatcaatcctatcagactaataaagttagcacataaatccaaataaaaactcctgactatttacatggcactttaaatgtacattactacagcatttatgcaattaaacataattagtagtgtgcattttcctggaaattcctttgagggtagaagtaatcattttcattttcatgtcatctgcttgatcagtaattcttagcacttacactgctgatgtacataaagttaattactaatcattcaattaaaatttatcctctgaaccaggacaagcatgctatggaagagctcatcctttatgttattgttgtaattatttccatctgtaacataataaacaatttatagcattctatcattaaaaacttgagttagttaagaatgaactacaaatcttcacatttgattctttgatatgcacaattagcttgtatttatcatctgcttacttaaagaattctgggcagtgcaagaaacagaagccccaaagtctaaaactttcttccttctaaatatcagcctatttgtttcaactgttagtaaatttgggggacatcctacttagtttatcaaaataatattatcaatgaaaactctgtaacacttgtacgcataggcagataattttaatttccaagctaagtttttccagagctttttatctccattacttttttctatggcagtccaaaattacaattttactaatgtttctacctttttaggcatcaaaaaaaactattctattcacatatcaattaattctatggtacagttaaatattgggttttaaacacttcaaaattacttcggctctttcttttccacatttcttcctaaaaattcagtccaaaagtcattacgtgagactgagaaaggtaggtgtccatgctggagagaaaaccacagtggcccagaacagggtattacagcctgcagaatgaggaaacgtttctaatagagcgtgagaagaatggactagcatgagatgtctgagttaaaaaggatgagggggcatccatatgagaagaatggcctggcatgagacatcacagcacaagagaggtaagcagggccactgcctcccccttaattacactaatccacctgcaattaactaatccatcacctccctcaggttcttccctgatatttttcagagaagaaagggaagaacctaaaggagatgatggattaattactcgagaattgataaagtaagtacacatatggaggataatggtatctcaccatcagaaagacaatacaaatataggagggatgaaaattagggcccctctaatgatgaactgaaattggagattgaagtgtacacttatatttttcaatacacacacacacacacacacacacacagacatatatatgtaaatgtgtgtgtctgtgtgtgtataacatacatttgttactttctgatattgatggtatattatggctatataggagaatatccttaaagaagagaaatatactaaggtatttagagggacaaaagagaagcatccgtctcaaatatctttaaaaaagttatatactgtacttgtaacttttgtttagaattgtttcaaaatttaaaattaacacattattttcagcacagtaatcactataaatgatgatgcacacttttaattatataaagtactttgtacctacaattttcaatattttaggtagataacctctttgagattctaaatatgtaatctgtctccagaatataaagacatgataaaaatctcaattatatttcagaaagtttggcaagtcagtgaacccattcaacatcccccttccctgctaaaaatttgacccacagacttcagaaccctagccactgctttaaattctcactcctatataatgaaatagaccaagaaaaaccccaagacctagatataaatacataaaaattattacttaaaatgtgggtggtttttttttttcttcacaaagtttgggccgggcacggtggctcacgcctgtaatcccagcccactttgggaggccgaagcaggtggatcacctgaggtcaggagttcgagaggagcctggccaatgtggtgaaaccctgtctctactaaaaatacaaaaattagccgggcgtggtggtgggcgcctgtagtcccagctacttgggaggctgaggcaggagaattgcttgaacctgggaggtggaggttgcagcgagctgagatcatgccattgcactccaacctgggtgacaagagtgagactccatctcaaaaaaaaaaaaaagaaaaaaagtttgagtaaaattatcaaggttggcaaatttaccactacaaaggtctttcatgggagacaggttataccttcccaatctttaaaataattctaaggttctgtagctcaatagtgaaacaaataacgatatcctggcataaaactatctttcagacaaaatccacctgctgtgtataaaaaaatgtaataattgaaaacttcctgccttgggagagaataaacctgattcgtaatacaaaaaccactcaatctacaaatgcgttgaacagaaagatggactaaatataaagagggaacttctgacctcctttggtgctagactgcctgtagtcatagctaggcaggaggtgatattattatctcatatttaaaattatatttcaggcatatgtgatacagtcacctaagaaaaagatggacccacttgacccacagtagtatttggcctccatgccctaggctaggaaagatttagaaattacccattgtggataaagaaagagcagtcttccttgccaagatgaaaactacataataaatgagtctcctatgtgagaattacatttccacccgtaaagaagttgaactgacatgtattcccttgatgcccttgtcttctattcagtgctcagttcttttaaaatttaatgttgacagactatgtggccttcacatttctgtcccaacatctagctaattaaaattaactaatgtgatatcatttttacttcagtacacctatccaatcaatcttgagtatattcaaaaccaagagaaaaatttctgtaggtctgacaagcatggctatccttacctctctgggtaaggtggctcacatctgtaatcctagcactttgtgaggccgaggcaggtagattgtttcagctcaggatacccagaccagcctgtgcaataaagtgaaaccgtgtctctaaaaaaaatacaaaaattagctgggcatggtggcacctatagtcccagccactctagaaatagctactgtagaaaatatttgcaaattatgtatctgataaggcatatctgataaggctttttctttccattgcaagggtaatggtgaggtgggaggctctggtgggaggattgtttgagtgtgggtggcagaggttgctgtgagctgagatcgtgccactgtgctccagcctaggtgacagagccaggccctgtgccccacaaaaaaaaaaatttgtaactctatgcttaaccttttccattagcagtttctaccagcaaaataaatctcttttccaccaccaccaaagatttttccacatctttgccaacacttgttctggctgtctttttaaatttcagccactctggtaggtgtggcatggtatctcactgtggttttgattttcatgtccctgatggcaaatggtgctgagcatcgttttatgtgcttattggccgtatgtttatctgccttggcaaaatgttcattcagaccctttgctaactgttttacttgggtcattttttaaataaaattattaacttgtaagagtttaacagatatgtcttatcagaaatgtaatttgcaaatattttctcccattttatgggttgtctttttactttcttatggtgtcctgtgaaggacacacacgtatgctcggtctctctctctctctctctctctctctctctctctctctctctctctcaaaacttttggaccaaagagggaagtataactgtgatttattaagcagccccattgagggctaacagcacatttctgaccactttgtatgctggtgccagccgggggtgccccagcggttgctccctggggtgtctgcttcagggctgctgcaagggtgcagggcagggctccttcagctgggaaaccatggaatagttggcagctgctttgtacgtcttgagagacaaaagaaagctcaaaatcaagagcaaacactgggtttgcactgaaaagaaatatatcatttccttgaagagaaaaattcaagatgtgaaaaatggaagcaaggaaagaagaactatgaagagaagagagattagaataccaacagcatagatcatttcatgtcccaattatctccaagttcttccaccttctgggatcaccagctgttttaacacccaaaatatatgaaagctatgtgttgtaatctgtagggtaaccgttaaaggaacaggatctataacttggcaagagaggaaaaagctaggatggtaaaaaagtctatcaatccaaaaggcaagaaaaaagagaaaaagaaacatgctggcatattattataattattgtattatttgttattcctgttaattttttactgtgcctaatttatatattaaactttttcacagctatgtatgtatagagaaaaatacatctgtggtttcaggcatccactgagggtcttggaacataatccttcccccagataaggaggtcctactgtaattatattatatgtcatattaagtatatattaattctactaggtagcagccacattatatattaattatattaaatatatatcatacagatttattttaaggaattgactcataatagaagaggctagcaggctggagattcaggaaagacttgtaattcaagtccaaaggcaatctgccagagaattccctcttgcttgggggaggtcagctttttattctattcaaatttttgatgaaaatagaaagcaaagagtatattaactatattatacaaactaaatgctccaattaaaatacaaaaattataaaacctaataataaaaaacctaaattatataatgtttaaaagagacatttttaagcttaaggatatagaaaatttgaaaataaaagaatagaataaaataagccattaaaatactagtgtaacactgatgtggaaatctgacaaagcacacaaaaaagaaaataattttaactgcaaaattttaaaatccaagcaaagagaaagcagcatatgttataattatatcacaacatgatcaagtaaggcatacttcaaaaatataacaaaaaaaatttaaacatggcccattattaggaaacatactaataaaaatcctcacgaaaaataattcaaaatctaaaaagccatatgataagcctgatgaatattggtttacagaactgattttctagaaaacaggtttataaaactggttttctttaaaaaggcaatcttggggaaataacccatttactccatttttttttttttttgagatggagttttgctcttgtcgcccagactggagtgcaatggcacgatctcggctcactgcaacctttgcttcccaggttcaacagagtctcctacctcagcctcccgagtagctgggattacaggcacctaccaccatcacgcccagctaatttttttgtatttttcatagaaatggtgtttcactatgttggccagtctggtctcgaactcctgacgtcatgatctgcccaactcagcctcccaaagtgctgggattacaggcgtgagccacctttgggaagatatccagtagtgagattgctatttgaacggcagttctgtttttatttctttgagaaatctccataatgttttctgtaagggttgtaataatttacattcccaccaacagtgtataagcattcccttttctctgcatcctcatcaatatctttggttttctgacttttaattttaaatttattttttatttttatagatatgcgggtctgatgttgcctaggcgggtctcgaactcctgacctcaagtgatctgcccacctcggcctcccaaagtgcagaattataggtgcaaatcaccacacctgactgttttctgactttttactaatagcatgtgctgggtgcggtggctcacacctgtaatccctgcagtttgggaggcagaggcaggtggatcacttgaggtcaggagtttgagaccagcctggccaacatggtgaaactccgtctctactaaaagtacaaaatttagctgggtgtggtagcaggcgcctgtaatcccagctactcaggaggctgaggcagaagaatcacttgaacccaggaggcagtagttgcaatgagtcgacattgcaccactacactccagcctgcatgacagagcaagattccctaataataataataataataatagcacatgctgttctgcagcatgaccttaacattgctcccatggtgaggtcgggtctgtgctccctccccttgaattcaagaaggtctgtgactggcagaagtgattcaaggtaggtcatgaaaggggacaccatttctccgtggtcctcctgggatgcttgctctttgaacccagccaccatgctgtgaggaagcccagatcacagggagaggccacattttgatgttccaatcaacagtcccagcacaggtttcagatgacagccaacatcagtttccagacatgggactgaagaaggctttgcgaagactccagcccagccactacgacagcatgagagacccctactgaccatcacctacctgaacccatcaactcccagaaccatgaaaaaaaaaacttttttttttttttttgagagggagtctttctctgtcccccaggctggagtgcagtggcgcaatctgggctcactgcaagctccacctcccaggttcttgccattctcctgcctcagcctcctgagtagctgggactacaggagccgaccactacccagctaaatttgtagttttagtagacacagggtttcaccgtgttagccaggatggtttcgatctgacctcgtgatctgcccacctcgccctcccaaagtgctgggattacaggcgtgagccactgtgcctggccttttaaaaaaaaaaaaaaatgagtttcactcttgttgtccaggttggggtgcaatggtgtgatctcggctcatggcaatctctgcctccaaggttcaagtgattctcctgcctcagcctcctgagtagctgcaattacaggcgtctgccaccacacccggctaattttgtatttttaatagagacaggatttcttcatgttggtcatgctggtctcgaactcccgacctcaggtgatccacctgccttggtctcccaaagtgctgagattacaggtgtgagccactgcgcccagcaagattgctattttaagtgcctaaagttttggggttatatattatgcagtaagagtaacttaaacatcctcctttccttctagctttttgaatctcttagtcatcaaacctagtctctctctgaagacctggtctgctttaatcaatgttttccccatagacccagcgagaggtaggtggagttatcttcctactcttcatggctgctcagaacccacctcccgggttctcgccattctcctgcctcagcctcctgagtagctgggactacaggcgcacctacctgaacccatcaactcccagaaccatgaaaaaaaaacttttttttttttttgagagggagtctttctctgtcccccaggctggagtgcagtggcgcaatctgggctcactgcaagctccacctcccaggttcttgccattctcctgcctcagcctcctgagtagctgggactacaggagccgaccactacccagctaaatttgtagttttagtagagacagggtttcaccgtgttagccaggatgcccggctaatattttgtatttttagtagagattgggttttgccatgttggccaggctggtctcgaactcctgatcttgagtgatctgcccccctcagccttccaatgtgttgggattacaggcgtgagccactgtgccctgttagttttcataattttctttacttccctctgtggtgggagaactggcttcagagaaagccatcctggacaggtgaggtggccccaccaggaacaggtttcaatcaggtgttttggaggcagtaatgcccatgcaccctggtgagaaggggcatggcgtgaacatcaggaaccagacttcaccctggagaaggagaggccacaggtgaggctgaaggagcagttctcacaaatgatcctgtgggcactggggccacaccacgcaccttggtgcacaagtgtcaatgtggctcagagtggggtagaggactcagggtattaaaagcatcaaggaatccaggggagagccaccgcacccaactttactttcacccacaggctgatgcagcccgaggaaatgttacgccacaaggacctcaattctacacacagaacctgttcgccaggcccttgccacaaaatgggggctgccaagccttgttagaatacctgagactcagaggaaaataatttttcttgagacaagttcttgctctgtcacccaggctggagtgtagtggtatgatcatagttcactgcagcctctatctcccaggctcaagccatcctcctacctcagtgccccaagtagccagaaccacaggtgtacaccactatgcccagctaagaaaataatttaaacatttaattagtttatttattattagttttttgtttttttttttgttttttttttttacacagagtccctctctgtcatccaggctggagtgcagtggcacaatcttagctcacagcaacttctgtctcctgggtttaagcgattctcctgcctcagcctcccgagtagctgggattacaggcgtgtgccacaacacccggatcatttctgtagttttagtagagacagagtttcaccatgttggccaggttgatctcgaactcctgacctcaggtaatcctcctgccttgtcctctcaaattgctaggattataggcatgagccactgcactcagcctaatttaaacattttaaaatcttgtttaaattttgaaataaaatctcaagttggtttttaaaaaactctgtccgggttgtgatgactcacatttgtaacttcagcactttgggaggctgaggtgggaggatcgcccgggagttcaagacagcctgggcaacatagggatacccagtatctctaaaaaaaataataataatacaaaaattagccaggtgtagtggcaggtgtctgtgatcccagctactttggaggctgaggcagaaggattgcttgagcctggaaggtcaaggttgcagtgagctgagattgcacaactgcactccagtccgggcaacagagtgagaccctgactcaaaaaaaaaaaatagtgcttagtgccacatgccaggaaccgcaatgacaacaaatcagaaggttgttgagtcagggcctaccaagagctggtggggagtctgactgtagggaccctgcccttttccaaaaggtggaggtgcagagaagctcataaggatcacggcttctcaccctggccctgaatccactcacatcagcggctctctgcacagccaaccggacagctcacaccaataaattaaaccttcttatttcttgctgggcacagtggctcacacctgtaatcccagccctttggaaggctgaagtgagaagattacttgaggccagaagttcaagaccagcctaggcaacatagtgagaccctgcctctacagaaaattaggtgagagtggtggcctgtgtctgtggtctcagttactcaggaggctgaggcaggaggatctcttgagctcaggaggctgcaatgaactattgcattactgcactccagcctggaggacaaagcaagaccttgtctcataaaaaaagaagcaagccagcaggtctaatccagacgtaagaggagggtattggccaggcacggtggctcacgcctgtgatcccagcactttgggaggccgaggttggaggatcacgtgagaccaggagtgcaagaccagcctggccaaatggtgaaaccccatctctactaaaaatacaaaaattagctgggcatggtggcacacacctgtaatcccagctactcgggaggctgaggtataagaatctcttgaacctgggagacggtggtggcagtgagccgagatcgcaccactgtactccagtctgggcaacagagcaagactctatctcaaaaaaaaaatacaaaaattagccagatgtggtggcacatgtctgtaatcccagccagatgcgaggcttaggcaggagaattgcttgaacccaggaggcggaagttgcagtgagccaagatcacactgctgcactccagcctgtgtgacagagtgagactctgtctaaaaaaaataaaataaattgaattaaaaagttttattaatttgcaatactgagtttgcaagaagagtgaactgtggtatggtgaccagcacacagtattttagagttcacagcgtgctctctgggaaactgttttagccaaagttgtggcatcatctctgaccactcactttattcaaaagacctggctcaaaatgactatttatggaaatcaactctagcctcgaaatacaaaaccaatgtagttctaaaggtattcaaatgaaggtaattaagtttattaaaaagcaatgaagggccaggcacaatgtctcacgcctgcaatcccagcactttgggaggctgaggcagcagaaggatcaattgaggccaggagtttgagaccagcctgggcaacatagtaagaccctgtctctacaaaataattttattttattataatttttatttttggtttttgtttgttttgttttgttttgttttgttttgttttgttgagatggagtttcactcttgttgcccaggctggagtgcagtggtgtgatcttagctcactgaaacctccacctcctggattcaagtgattctcctgcctcagcctgcaaagcagctgggattataggcgtgcaccaccacacctggctaattttttgtatttttagtagagctgggtttcaccatgttagccaggctggtttcaaactcctgatctcaggtgatctgcctgcctcggcctcccaaagtactgggattacaggcatgagccacttcccccagcccaaaataatttttaaaattagctggacatggtggtttatgcctgttgtcccagctactctagaggctgggatgggaggatcgcttgaggccagaagtttgaggttgcaatgagacaggattgcaccactgctccccagcatgagtgacagggagagattttgtctctaaaatggaaataaaggaagcaaggaagggcttctcctccaaacactaccacttcatcttgggcagttacatgattccaggaaacatggaaaatctaccttgagtacctttttggatgtatgctaatgggaaaacaaatctcattaattaactcatagaacggctaagaggaaagaatcttaggggatgtgtggtttcactccctaattttaaacatgaggaaattgggtaccaaagagatgaagtaactcagcaggtagagagagaagagcctctcttaccacaaggggtctctcattggaaaatgggcaaaacttgttccctgcctgcattctccaagatcgtagccaacatagaatagaagtgtctccacttcagaggacaactggtttgtcctttgccttttacacccctttcagcaagcagtatttctcagctttgtgtttgtgcaaactcttgagtagcacaaactcctgagctaagagacactccactctgtttgcaattgagggcaaaggctgggatgcttgggcacagctccaggctcctttcccagaagtctggggtggcagaaaaaaaaagaatgtatttttcacacactgagtagagatgtggctcatcacgtagaggtaaattgtttttttcttgagatagagttttgctcttgttgcccaggcgggagtgcagtggcaccatctcagttcactgaaacctccccctcccgggttcaagctattctcccacctcagcctcttgattagctgggattataggcacctgccatgacacccagctaaattttgtatttttagtagagaaggggtttcaccatgttggccaggctggtctcgaactcctgatctcaggtgatccagccgcctcagcctcccaaagtgctgggattacaagggtgatccaccgcgctcggccttagagttggtattttataaagaatagaagtttacatagctcacaattttagattatggaagtccaagagcacgccattgacatctgatgagaatcagatttccacatcacaaaatggccaaaggcatgaggatgacagaaggtgaacataagagagcttacttttataatagacccaatttcctgccagctaacccactctggaaacaatgacattaattcattcatgagagtagattccctcaaaacctgatatcttcttaaaggtccaatttataattttataatgatgacagttaaatttcagcatgaattttgaagggggcattcaaaccatagcgatgcgtttttattagataattaaattatttgatatttaaaaaattattgatttgccatgacttttaatggcaaaaaccgcaattacttttgcaccaacaaaataatgtctttggttttcttttcatgctctcttttcttgtgttttctagtttttttttttgcttttgttattatatgctttgattcccatttcttttctttcttttgttttctttttttttgttttttttttttgagatagagtttcactctcattttccaggctagagtgcaatggcaccaactcaacctccatctcccaagttcaagcaattctccttcctcagcctcccgaatagctgggattacaggcacttgccaccacatctgactaattttgtattttagtagagacggattttctccatgttggtcaggctggtctcgaactcccggcctcaggtgatctgtccatctccgcctcccaaagtgctgggattacaggaataagccactgcgcccggccgcttgattcctttttcttttgtgtgtatagtacaaattttcatttagttaccaagagatttacataacacatctcatagatataacactctagcttacgataataacaattctacttcgatgcatagaaagactcaacaggtttactctcttcaatacacgatttatatcgcactttacattttttatattgtgtatctcataataaattatttaagctatatgtattttggatacttttgtcttgtagcttttatccctaagttaaaagtaattcatgcaccaccattacaggtgtcattagtattttattcatttttctccacttatacctaaataatgatataatttaattccaatatttattttatatataatctcacagtattctaaaaaattatattgtttttgctttggaatattattttcttgtgttcatatggttgtattgtagatcttatattttgtgtaatagcaataatatattaataacataaataactttacctagtatcttttaaatactttaaaagcttccattttcattagacttttactaattcttctaatgtatttttttgtggaaatttactactatacattgtatgccaataattaaaaatgccagattttcgtaagttcatagtcatatttgaaaactgtagttatttaaagaattattttctgatacatctatgctaatattccatattttataggtcaacatgttttatttttgtttttaagtccattatactgcatttttttcgtacaggtttcttttgatgattaaattgtatttttgtttttaacattacatttatgatgtggaaggtaattttcattcggtattatttataaaaatgtggtgtttaacagggctgggcacggtggctcacgcctgtaaccccagcactttgggaggctgaggcgggcagatcacctgaggttgggagtttgagaccagcctgaccaacatgcagaaaccccatctctactaaaaatacaaaattagctgggcgtggtggtgcatgcctgtaatcccagctccttgggaggctgaggcaggagaattgcttgaacctgggaggtggaggttgcagtgagccaagatcatgccattgcactccagcctgggcaacaagagtgaatctccgtcttaagaaaaaaaaaatgtggtgtttaactcaaatataaatccctgggtttcacttggagcaaattttaaaaaacaagtataagtcagatatttcttgtttttgtttgtttgtttggatacggagtctcgctctgtcacccaggctggagtgcagtggtaggatccaggctcactgccacctctgcctccaggttcaagcaattctcatgcctcagcctcctgagtagctggggctacaggtgcgcaccaccatgcctggctaattttttgtatttttagtagagatggcatttcaccatgctggccaggctggtcttgaactcctgacctcatcatccacctggctcaatctcccaaagtgctgggattacaggcgtgatccaccacgcccagccccgtaagtcagacatttctattgcctataaaagttacttatgtgatatttgcgtgtataaatattgatccattttctttattagttatcttgtttattttttttctcaggtggttgtcagtgttctattgtctggatgagtagtcagaaaggcagtctaaaattactgtctatttattgtttgaatctatgttattgtgtgagaaaaacacttgatatttgaagtaatttttgaaaaatgcaactattttttgagagttgtaaatatttgtgattaaaaacataaaattaccatcttaaacattttaaagttatatacttaagctatatgtttagtacttttaagtatatttacattatatgaaacagatctctagataattttatctttaaaaagtacaatctaatgttcaataaactgtcttctccttctctcttttccgcgtctgaagaacatcactttactttctgttttgtctgtctctttttggctatcttattttagtcaacatattttttcctgcgtctttaattttaacaaataagttattctcctctcagttcagattcatcaggaaattgaatcatatccagaagaattaaaactaagagactaatatgtttgttaaagcaatgcaggttgtcatactaataaaccctacaatttcaaaggcttagcaaaataatacattttatgcacacaccaccttcccctttggtttacttctggttaaaaaaacttcttcatgattatttggagattagatttttttctaaattttctatccacattctcctgtttctaaagccaatagatcaaaaaaagatgcaaagaagacacatttgctttttatccacacatcacttccagtcactatgctgagcagagtcaaagtgagcagagctcagaatagcagttttctggcaggacagccacttcttggcaaaaaatgacacaataaaagcataaatctttcatggaaagctaacatgttttcagcaaattaagcatatgcacgaataaaattcttgtggtaaaataaagattcattttgttgattcttagtaagctcaggtaatagcaaataaaaaggcagcaaatatagagcaaaaaaaattatttgaaatagaaataatgtggattaagatattctgtcaattaaagtaaaaatatttttatctcatactaatcatcttacctatagtcgtataatatcaaatgctaccttttattaacaattgtacttcatataagtattccatttatatcacccttcttcactgtttcaatgccttctgcacttcatatcagtgaaaaacaggctggctggtaccaggaaatggatgtggtgctattgctactttaagagtaatgatgaagagcacttgtctgaattggtcccatgtggcaaacactgttatatggtctaaagtaaacacatttattattttcttctaaatttactgatgaaatacaattctcagctaaggaagacttgatctcattcaaatacattttgtgaaatttggttgacatttcagtgtttttgacttaaatggcatattggaaatttctatgaatccaaatagagtgttatacacgaacagtcttttattaaaaacctttctgggttgggtgcagtggctcatgcctgcaatcccagctactcagaaggctgaggcagaagactgacttgaacctgagaggcagaggttgagttgagccgagatcacgccattgcactccagcatgggcaacaagagtgaaactccgtctcaaaaagaaaaaaaaaaggctttgtcttaagattcataaaatttcttcataatatagaagaaatgtgttaactatgttcccagtaatcaactctgaacactgagcattctcagtttccagtattcactctgagtcattcagaaaaattggtatctctgtaaggagtcagaaaaatgtgtttggggaagggtcacaacattgcacataaatgctttctacctgcacctgttaggatcttaatctaattggtctatcatttgcatggctagatagttactggatctaatcatactattttgtgttttgcagataatgacatctgttacctataagtttcatacaacaatttgctcagctgaaacatgaatcttttgctaatttacccgaaattgagggactagatttgcaatttctaatctttcaatgttagagcaaagtagagaagagtaatgtgtgtatgtggtatgcattttcttacttaactattaaaattcttctcatattgccttggacactttagacagccacccaaaaaatattctctactcctttttttagccaggatattagatttcaaaaggtcaaggacttaataattgggctaagccaaaatcttgtctttgcttctttcaaagagcatggcaattatgccaagccattgaaagatgtggatctgatgacttttgatttcaaatgctttttctaattgtttgctctaattgtcttattgtgttaatctaaaagagaacctatctacataacaacttatgcattcacgaaatgttcatgttacgatgatcaaagttcaatattgtagtatagaatagtagaatagtctaaaattagaaagtcagattattattaataaattcattatttttttcaacattttccaatgttgaaattaaagaattggcaaggctttttcatgataagttcaattctaggatagtactcactggtctgcatggtatttttttcctttttttggcaggaggggatggagttttgctcctgttgcccaggctggagtgcaatggcatgatcttggctcactgaaaccttcacctccagggttcaagccagtctcctgcctcagcctcttgagtagctgggattacaggcatgcaccaccatgcccggctaattttatatttttagtagagacggggtttctccatgttgatcaggctggtcttgaactcacaatctcaggtgatccacccacctcgccctcccaaagttctaggataacaggcatgagccaccgcaccctgcagctatctttgtcatgaattatgtaaatccgagttaccagaatggtgcagaagtgctaatgcaatcagaatgaaaatgaatacggccttgttggtagactattggtatcccagaggctgatcatttacttcagctgtgtagacattgcttcataacgccagggagccctttcaaccaagttatctttatttcccattgatgaggtcatgttctggtctctgtttttcttaagctgtcccagatgaggggtgattatttcttgcataaatgagatcccttctttttcctctgcaatgagatcctcctattctccttattgaaagtaatatgttgaaggcagaaatggagacaatatacaaatatatatcttgccatgtggccaccataaacactttatgacattgcttaccaagaagtttgattaatttcagggaagcagggatgttttctatgatgtgctctttctcttaaagcacctctgattaagtttagcctaatcaagataatctctcgtatgataaaaaggaagccaatacattagtaatataaatacatgaatactgttttgccacagtcacacacattttgtgatgctcaagagaaaaggattacacagcaggtgtgcactgaagtgggaacctgagggtcatctgagaattttccctacccacctgaatagatttctaaaatcacctttcagttgcttttgctgtctttctaagtaaacaaagatatcatctgcaaataataattaattgaactgcttttcaattgtattcattaaaataattatctttttctggcttatatgaagtatttcttatttgtaatatacattcacatatatacaaatatatagcaatacaaatgtatccattttcatttttgttaaatttttaagaatggatgttaaaggtaacttcttttctgtttgaagtgtttttattgttttattcaagagtattatctctggagttaaagttgatactgttttaatactggttttgctattgtgagcaagttatttctctctctggctcttttctttttttttttttgtaaattgaaaataatagtgacacctttgttattaagttactttgtctattagtccattctcacactgctgaagaacacaccaaagactaggtaaattataaaggaaagaggtttatttgactcacagttcagcatggctggggaggcctcaagaaccttatgataatgggagaaggtgaaggagaagcaggtatccttttcactaggtgacggagagcaggaaaaattaccacttataaaaccatccaaactcatgagaactcactcactatcacaagaacagcatgagtatcattctgcctctggccccttccaaatctcatgccctttttatatttcaaaaccaaacatgctttcccaacagtcccccaagtcttaactcaagttagcattaacccaaaagtctaagtccaaagtctcatctgagacaaggcaaatccctgctacctgtgagcctgtaaatcaaaagcaagttagtaacttccaagatacaatggaggtacaggcattagacaaattctcccactacaaatgggagaaattggccaaaaccaaagagctacaggcctcatgcaagttggaattccaatggggcagtcattaagtcttaaagctctgagatgttctcatttgactccatgtctcacatgtgggccatgctgatgcaatgggtgggccctcatggccttgggaagctcctttatggactggaattgtgtgcctctggcttttctaggtgcacggtgcaagctcatggtgaatctgttatttaggggtctggagtatagtggccttctcacaactccagtaggcagcttcagtggggactctgcatgagggctccaaccccacatttcccttctgcattgccctagcacaggttatccttgagggctctgcccctgtagacttctgcctgaacacccaggcatttttatacatcctctgaaatctaggcagaggtttctagagctcaactcttgtcttctgtgcacatgcatggccaatatgacatggaagccaccaaggcttgaggattgcactttctgaaggaacaacccaagctgtactttggccccttttagccacagctggatctggagcagctgggatgcagggcaccagccccaaggcttcataaagcagtggggccctccctgggcctcgaccatgaaaccattttttcctcctagagttcctggcctgtgatagaagaacctgtctcagatctttgacatgacctgaagacattttccccattgtcttggctattaacattcagcttctctttacttttgtaaatttctgcagtggcttgattttctttccaaaaaaatggggttttatattctacctcatggtcaggtgcaaactttccaaacttttatgttctgcttccatttaaaaattaagtttctcatctccatctgagacaacctcagcctggactttatcatctacatcactattagcatttgggtcaaaagcattcaacaagtctctaggaagttccaaactttcccatatttttctatttttttctgagttctctaaactgtttcaacctctgcctattacccagttccaaagtcacttccacattttcaactgtctttatagcagtgccccaaactacctgtattaattttctgtattagtttgttttcacactactattaagttactaccagagaatgggtaatctatacagaaaggaagtttaatttactcacaattctgcattgctggggaggtctcaggaaacctacagttatggtggaaggcaaaggagaagcaagtaccttctttactaggcagcaagagagaggcagagcagaaaaaaacaccacttatataaccaccagatcctttgataactcacttactatcatgagaacagcatgggggaaaattacccccatattccaatcacctcccaccaagtccctcccttgaaacatggggattacaatttgagataagatttgggtgggataaaattttacagtaacgaattcaatacaagtcacagaatatagatttttttgagaatctctgaggtttccaggtttctctttaattatccaccttattaaaataatcttttttgtttcaatattgttcttctgttctgaaaatgcatacaaacacacacaaacacactcagttgctacataactttcttatatgtgtgtatatatatatgtatatatattcatttatttttttaatggtgtctcgctctgtcatcctggctggagtgcaggtctgccaccttggctcactgcaacctctgcctcccaggaccaagcgattctcctgccccagcctccctagttgctgggaatacaggcatgtaccaccacgcccagctaattttttgtatttttagtagagatggggttgcaccatgttggccaggctggtcttgaactcctgacctcaaattatctgccccactcagcctcacaaagtgctgagattacaggcatgagccacagtgcctggctgatatatctttagagtaatatatttgtatatataactctatgtaaatcaaaactaaaagtctgtttttgtttgtcagcagagaggccacatgtacaaaaaatatacaaaacaattttttaaaaatatttaatcaagactcagaaatgtatattaattatactcatgcaatttttatgaccataaaatgaccctatggttagtaataattcaattgtacatattaaaataaaactgtataatgagcttgtaatacaaaggataaatacgtgctcgagttgaggaatacctcatatacgctgctgtgataattaactaacgtatgcctgtgttaaaatatctcatatatgccataagtgtgtatgcacactatccacccacaaaatttttttagaaatctaaatagggtaaaaaagaatacaaatttgatctatgagaaaaaaattattctacttatttgcagtttaaaccactggcaggacaggcatggtgacccacacttgtaaccccaccaatttggggcactgaggtgggtggatcacctgagatcaggagttaaagaccagcctggccaacatggtgaaaccccatctctactaaaaatacaaaaattagccaggcgtggtggaatgtgcatgtagtccctgctacttggcagactgaaggcaggagaatcgcttggacccaggaggtaaagtttgcagtgagccgacatcatgccactgcactccagcctaagcaacagagcaagactccatttcaaaacaaacaaacaaacaaacaaacaacactggcaaaaaagagattactagagatgtcattcccctacattaacaaatagcacattgttaccatcttttacttagaaccttaagtaaaatgggacccattaaatctgatgacaaattaacacttcattcaaagcacaatagttttaacacattaaaagcaactttgtttaatgaaaaaattaagatgacacataatctttaaaaaatttttaaatttattgcattttattacataaacgtacaattgataaaaaacaatctctcctatctctgatgaaacaactgatcaaatactttcacaaacaataggaagagtcaacatgacggaatctgagacttgagttacattattatttgcttttcagaaactatttttttatagaagaaagaaacatacctcgaaggtaattatgaatctcgaaaaaaactacttctttaacatgtatatggtgttagctttggatctcttttacactgaaccctctgatttagtgtaatgtatgaagtttcagtgccttcattctttctactgtgacccctcagatgtttatatagacttaatttttgatttaatatgttttccccatttactggttctgcaaaaatatttagtacaaactggtgttttctaagctgtaggttttgaacaaatgtttttcacattcattacatgtttagactttctccccaatataaattctctaatgttcaacaacgtttgagcatcttctcagatcttcaaatttttcctttaatataaaatgtgtacaataaaatctgtaatggaagtaaaggtacagcaatcctctttaagtttgtatgtttgtcttcagaataactggtctttactttaaaggcctatattttccaaaaggtctttttacagtaatcacatttataatttttttttgagacggagtcttgctctgtcacccaggctgtagtgtagtggctctatctcagctcactgcaacctctgcctccccggttcaagcaattctcctacctctgcctgccgagtagctgggattacaggtgcacgccaccacacccggctagtttttctatttttagtagggatggagtttcaccatgttggccaggctggtcttgaactcctgacctcatgatccaccgaccttggcctcccaaagtgctggaattataggcatgagccaacacacctgacctataatccctttattaagtataaactttctgatattgagtaagatgtgacctgatattaatggcttttcacattctttgtatttgtacaatttttctctagtataaatgctttcctgtaccataaggtgtgagaatttgttaaaagttttgccacattcttcatatttgtaggagtcttcttcagtataaactatcttactaccataacgtgtgactaccatttaaagtccttgctaaatttaacacatttctagagtctctcaccagtatgatttctcttttttagaaaagtttgaggtgtgcttaaatgctctgtcacagttttatgtaagcagagtttctctccagtataaaattttttagtgagtaagcatggagaaccagttaaagggtttgccacatttttttctacaattgcagggtttctctccaatatcaattatcttacatttattcaggtttgaggactttttaaagacattaccatattgcttattgcagggtttctcttcagtattaattctcttatgtataataagggttcaagactagttaacagctttaccacattctttgcttttgtagagtttctctctagaatgaatgatcagatattatgtaaggcctgagatgtgcttaaaggttttgtcactttttttttgtttctagggtctctgtaatataagttctcttaggctttgggaggctgacaaaggtggatcacctgaggtcaggagttcaagaccagcctggccaacatggtgaaactctatctctactaaaaatacacaaatcagccagtgtggtggcacacgcctgtaatcccagctactcaggaggctgaggcaggagaatcgcttgaacctggaaggcagaggttacagtgagctgagatcatgccactgcactccagcctgggtgacacagggagactccaactcaaaaaaatttttttaaaataaattctcttaggtttattaaggtttgagggttggttaaaggctttgttacatttttttacatttataaaatttctgtccaatatgaattctcttacgttcaattaaggtttggaactggttaaaggcttggccacattctctacatttgtagtgtttttttccagtgtaaattattttatgtattataaggcctgagggtggactttgccacattattcacatttgtagggtttctctccagtgtgaattatcttatgtttagcaagacttgaatgccacttaaaagcttggtcacattcttcacatttgtagggtttctctccagtatgaattctcttatgttgcataagggttgaggagcaattaaaggctttgccacattcttcacatgtgtagggtctctctccagtgtgaattctcttgtggtcagtgagggttgaggataagctaaaggctttgccacattcttcacatttgtagggtctctctccagtatgaattctcttgtggtcagtgagggttgaggataagctaaagactttgccacactcttcacatttgtagggtctctctccagtatgaattctcttgtggatagtaagtgctgaggagcgcctaaagtcttggccacattcttcatatgtgtagggtttctctccagtatgaattctcttatgtctagtaaggttcgaggataagctaaaggcttggccacattcttcacaggcatagggttttctctagtatgaattctcttatgtctagtaaggtttgaggaccagctaaaggctttgccacattcctcacacctgcagggtttctctccagtatgaattctcttgtggtcagtgagggttgaggatacgctaaaggctttgccacattcttcacatttgtagggtctccctccagtatgaattctcttgtggttagtaagtgctgaggagcgcctaaaggcttggccacattcttcacatgtgtagggtttctctccagtatgaattctcttatgtctagtaaggtttgcggaccagctaaaggctttgccacattcctcacatctatatggtttctctccagtatgaattattttatgtgtagtatggtttgaggagcagttaaaggatttgccacattctttgcatttgtaggacttctccctagtatgaattacctgatgttgatttaggtgtgaaagcatgcaaaatgatttgccatatttgttacatttgaaatgtttctttccagtatatcttgttttatctctattggaatttgaaaatttaccaaagactttgacatatttatgagtctgaaatattttgttttgggtagttgacaaacattggttaacttcactataacctctttgggcacctcacattcacccacacttttacagcattttttaaattgtaatttctcatgtccacattttccatatgttcttggtattactttttggagtgaatctttgatgccctgctctggctgaaggtcttgggtgaaatgggaatgcgtaactgaaagacacaaaaagcacaagttactccactttctggactcatataaatgtattctacacatgaaatatataaaattacacaaggtacattagcaaaatgccatatcaaaataccacaggccataattccttcatagatgtataaatgtaacaaaatcatagtgatcaaaatacctttgttggaaatttataaataaagtaagtgtgtgcaccatgtgagcacgatgtccagagccatatagagagaaaagaaaggtctgctacatttacccaacacagcccttcctcatgcccagtagaagaacatagtgcctttaataacagctttaagtcttctgagctcaaaagtgaatgttacaaccgcagaaagactgcagtatgatgggtagaagataggtgtagaacgtagttactgaccactaagaagaaatatgaagaagtcttttaattgaaaaataaatacaaattgcagacaaaacacatcctgagaacatgtttgtgagaatcccagaatctctaccaaagacaattggtgtcatgctatgagaggaaggagctgcattataaagatcatgaaaggtagttttatgttagtgtctaaatctccaacaaagattacaatgtatataaaacatgaggacaacatggtccaatcaaaaaaatcaaaaattttgaaaaagcaactataaaaataaagatgtacatcttgatttttaaaatttaagataatccatattatgctcaatgagaaaaatggaaaaccagacacctaaataaaataagaaaaataagaataccaacaaaacttgcaataataaaaataaacaaggtggaggtaaaaaagaataactgaaaaaatttaaaagtaagaaaaaagtacgtaaaaaatgaagaagctaaacaaacaaactaggatatacacaaaaagatccgcaacacaaatttaagcaaagtttcaaaagtcacaaaccagaagataatcttgggagctgcaagataaaagtgaagtattatttataagcatagtcctctgagacaaccagtgaatttgtaaacagaaaccttgcaggtcagaaaagaactgtgtaaaatggtcaaaggctgaaaaaaattttcatggtgagaataataaaaccagaaaaatgtactacaacataaagaaaaataaaactcttccagaatgaataaatgctggaaaagcacataatcattgtatgtgccctacataaaatgctgaaaagaggtctttccacttaaaacaacatgatgaaaaatatatgtaatcatatgaaaatacataactttctgaaaaacatatgcatatacaaaaagtaaaattctgtggcattattgtgatggtgcagaaaatacttttagttattctttaaaatttgaaaaatataagcataaaaaacataaaacataaaaagatataattagcaacatcaataagaagtatagggtagatataatgaggacaaatttttctatgcaactgaagtcatttttttttaccagtttaaaatatactgttgtaacatttaagatgttttacagaatctccaatgtagcacaaagaaaaaatctttatagacacacgaaagcaaatgagtcaattactagcatgagacaaagattgatattatataatggtaaaatgagtccatttactaggaatctataattattatgtctatctacatgtatatgcatatataacatcagggcttcaaaacatataaagcaaatattgacagaaatgaagcaagaaataaaatagcaacacaaaattataaacattaagacctccttttcaataataaataaaaaatttaaataaaagatcaattaaaaaaactgaaaacctgaagaatattatattgtgtatgaatttattttgcattgctatagaaaataacctcagactgggtaattcataaagaaaaagattttttgattcacagttcagtagactgcacaagaagtatatgccagcatctgcttctggtgaggatatgaggaagcttacaattatagtggaaggcaaagaagaaccaaacatgtcacatggtgaaagacgatgtgagtgtgaggtggaggagccaggttcctttaagcaaccagctctcatgtgaattaatagcgtgagaactctatgattgtgccaagtcattcatgagggacttgtctccatgatgcaaacagctctcattaggccccacatccaacagtggagattacatttcaacatgccatttggagggcatctacaccatatcacaaaccaaataggctaaacagacatgtacagaactctccagtcaaaagcaagtagatacacaatattcttatttgcacctggtgcattctgttagaacacataagtcttggtaaatttcaaaagatcagccaggtgcagtggctcacaggtgtaatcccagcagtttgggaggccaaggtggaagaatcacttggggcaagaagtttgatactagccttgggaacacagtgagaccctgtctctacaaataattcaaaattagctgagcattgtggggtatgcctccaatgccagctgctcagtaggccaaggtgaaaggattacttgagttcaagaggttgaggctgcagtgagccaagattgtgctactgcactacagtctgggaaacagagtgagaaactctgagtcaaaaaaaaaataagaagagcaaaatcatacagtatatgttttctaacccaaactgaataaaactaaaaagaaaaaaagtaatactggcaaatcaaaaatacatggaaataaacacactcttcactgtattcttgcacagggtcaaataatttaaattaatttaatattttttctcaagggccaacatatttaagtgatgacttaatttgttaagacccacagtggtgaacaaatttaatataatctgtatcaaaattccaaaagtatatttattcctgaaatattgtttaaaatttttaaattttattatgaaccaaatctagagaaacacacatgaaaaacacagaggcactatacttcataatttcaaaacataataaaaagctgcaataacaataactatgtggtattcacaaaaagacagataaagacatgatagaacaaaatagaaagcccagcaatgaactcttctgtgtatgaccaaataatctgcctcaaggttgccatgagcagacaatggagaaaatataatcccttcaacagatgatgttgaaaactggacatctacattgaaaaaaatgaagttgaatggtttaattgcatcacatacaaaaaatattttaaacaaagtacttagactaagaaaaacctaatgaaactcttagaaaaaaagtatagtgcaaagacatgacattggtcttggcacattttcttagatatgccatcaaatgcatgcgcaacaaagaggagaacagaaaaatttaattgggctaaacttcaaaatttctgcaatcaaataaaacatttaatagagtgacagtgtctcccaagaaatcggtgacaatatttgaaaatcacatgtgataagacttaatattgagaatacataaactactcctagaactagacaacaataattgaattacttgatttagaaatggacaaatgagccaggtgcggtggctcacacgtgtgatcccagaactttgggaggctgaggtgggcagatcacctgaggtcaggaattcgagaccagcctgaccaacatggcgaaacccatccctactataaatacaaaattagctgggtgtggtggcacatccctgatcccagctactcagggggctgaggcaggagaaacatttgaatccaggaggcagaggttgctgtgagctgaaatcgtgccattgctcttgttgcctaggaaacaagagtgaaactccgtctcaaaaaagaaagaaatggaaaaatgattaaactaaattttaataaaaaagatatacaaaggggaagaagcatttgaaaggttgcacaaaattaataatttatagaaaaatgcaaaacataatcacaaaacaaaatcaccttacatcaattaggatggccactataaatttttttaaaacaccaactgttgacgatgtaaagaaattgaaacctatgtaagttgttttttatgagaaaaaagatacagccatcataaaaacatcataagcattctttaaataatctaaaatgaaattattatataatacagcaataccatttatgagtctatatctaaaatatgcaacacagtaaaatgaaggcataaaaggtaccctgcttgcatatccccccacagcaagtgcaagtggggggataaccaagcctctaaataaataaatacatataaaaaattaaacaatttgtaaaaaatttgtaaaaactttaaaatatatttcaaggctatagtaataaaaacagaatggcatgtgcagaaaaatggatgaccaccaatgaaagagaaactactattctcacacatcttagacatgatgcaaaaaaaaaattttaatggtttagagttttccaaaaatatgcagatattagtgtgtccccaaaagcaatggcaaagcagtcagtttgcgcagtccctgataacctttaaagaaaactttggctcacactgtgaacctgaagaaagattattgaagcagaagtggaatccttagagactttaacagcatgaggcaggaggtgtccctatgtgagagcaaaaggaaaaaatgacttgagcttctcagaaactcttttcatcaaaggacagctccccagaccacattttaaggactggctgcctcctttatttgtgtacctctcatctgtctcatctgcttcatttgctctcacctacctgggcgtttggctaccatctcatttctctttatattctgggactctttattttgctccagacaggtgatcaagtctggcttagagacagcaatacctgttttattaagaaaaaaaagtaacatagatcatgctgaattctttaattaccaaattagtattatgcttagaggatataatagaaaattctagaaaattaatattgattcataatagaactttctaaatattcagaaaatattttaaatttgtaggtccttaatttcactactcagtactactgaatcaaaaattggtggcagcaactgaattctaatgtgtgggcaacgatcttttatgccatggcatttttggaattcccactaacctagagcaaaagatacataagctcaggaaaggcaaaagttctggtcaagataaaacatcttgaagaatttgttctacagcaatgaatccccaagattttcttaaaattggagatctaaaattcattcatgcaaagcagaaattaccaaaaacatcttagaaaagagaaaagcaatatattaggaattatgtattgaagttatcctcacccagggagaccaagtttctgtagttctctaacatcacatgtctatataaattccgctgagcacaatccaggcattgccattcctccagagagaattctatagctatgtctctgaatgtcaacagtccctggaaaacaaacaaacaagcaaaaccactcatgaacacacaagcacttaccacatggccataggcagagatttttatttgactcaagttaaaaaagagagtaaaaagaagtggttctcacttacaagagtgactaaaattattcaataagataatttttaacactgaagtattctctaactctgagaaaagaggatagcataagatccacaataccactgtagatttgatacttttctggatgatacattataaaattaagggcatcaacatggacatgtctttttcttttcttctttttttttgagaccgagtctcactctgttgcccaagctggagtgcagtggtatgatcttggctcagtgcaacctccacctcccgggttcaatcgattctcctgcctcagccccctgagtagctgggactacaggcatgagccaccatgactggctaatttttgtatttttagtagagacggggtttctccatgtggacctggcaggtcttgcactcctcacctcaggtgatccacccacctcaacctcccaaagtgctggaatggtaggcatgagccactgcacctggccggacatgtccatttttgagtgctatatttacatcatatagaataagttgtgtatatttctcagatagaagagtcatgatgaattggaagatacctctcaagtcttagtatgtgcaataactaaagatcttgtgagattttgtttcaggagatttcggaggaagtctgaatttctgaatttttagcaagctcaccaatgtttctagcctagtaagaatattttgtcaaatatccagtaaatggcagagtttgggtttttcccagtttctctcacctgtaaataaagataagagccttcatttttaaaagacaaatataagcaaaagtcatctaaaaggaaaggacagcttccagattaaatgcaacggtttatgcacttcagctagtaaatctcctaagtgtccttaataattaagagaataagaattaactctagagtggaaaaaaatgtcatagagatcttgaaccaagtgaataaaattgttatcaactttattaggacacatttttattatgtgctgatgcacacacaacacagcatcactgctgtggcatttctctcctctcagaaaagtaaattataatctacatttaattttattatatatatatatatatatatattttttttttttttttttttttttttgagacagagtctcgctgtgtcacccaggctggagtgcagtggtgccatctcatctcactgcaacctcaacttcctgagttcaagcaattctcctgcctcaacctcccaagtagctgggattacaggtgcatgcaccatgcctggctaattttttttttttttagtagagatggtgttccaccatgttggtcaggctggccttgaactcctgacctcacgtgatccgcctgcctcggcctcccaatgtgctggcattacaagccaaagccattgcgcctggcctaaatttaatcataaagaaacatcagttttatgcaaagttgaaggtgcagataacttccctgttctgcaatttttattagtaattttaaggagtctttccttagcaccctggaaagcaagtatctcctaacagttttttcagaactttctgtataataaatgccaccctgtttaaatgagcattttctaaacgctgttctgcatggaactaatagagcacacagatgaaacctcaatataacatgtttcacttttcactaatctccaaagacaacggtgtttccccaatagaaatcttgagtatccacaccttctaatgttcaacagctacaatgggaacattttatatatcgtaggtcataaatttgtggtaagaattctgcatgatatacaagaatccaagatgaagagaaatgtatagaatgctatggcatagagaaaacaaatatttttttcagaaccccttgactatcataaaaatcacaaaaaatagttgaaacaaactcattagggatcaacagcacgagtagagaagtaaaactttgcaagttctgaacacaaggcattccaaaaggcagagtggacactgcgcttgatctgagacatgctcacctgagaaaaagtgatttgtttcttttcctcctctttctctgaaatgtattttcagataagatgctctggacatatcaaacctgcatcttgagaatatgactttaaagtgcaacctattcacctgctaccaccacacacacccacgggcggaagaccgagacttgcagaaaacattcacccatttttgttgtttataactgaaaagatttaagagcaatgagagaacaatgagcttctccacagctattaaaatataagtttctttgtctctgccctcccctatcagaaaccagcaattttctttagagtaatgggaacatgaaccgcactgacctcttcctaccaaactgaaacagggcaggcagtgcagccttcctttgaggcaaaggttgaactaaactctcctgaatgtatcttgaacccctcaagtttataaatcacttggtaatcttggccccgctctatgcaacgtgattctgcaggatccaaaagggtccaggaatgggcttttacagcaagtcccctgtaaatgctgattgtgctttcccagacacattattagcattagcaagagaaagcaggcacagcagagtcccttacacacaccacatttgtcacaatactaatacttctgctacaaataaaaacaaccaatttccaccctgaaatgctatatttttgttggcttttttaagtttacagggacaacagaagacagcaacgtctgagtgaatctgcacctgggaaacctgtacacatgtactaataaaacgtttactaagcaggtactgtgtgctcaggagcatgtcacagaacactgcgctgggaataacacattttgtgatttaattttcatagcaccctgggagttggtactaagtgctgaataatttttagcatttagattaagagcacagcatttttatttcttcttatctttctcattaattttaaaaagaaaatgtatagaataattcaatacaaaaaaaacatgtgaaaggatgcatttacataaaaatggaataatcagcttccaaatggctattttggaaataatgaaattaaggcagaaataaaatttttgaaactaattacaaccgaaatacaacataccagaatctcagggttagagctaaggcagtgttaagaataaaatgcatatcactaaacatccatatcaaaaagttagaaagatctcaatttaaaaatctaatgttacaattaaaagaatttcaaaagtaagagcaaaccaacttcacagctcacaaaagtcaagaaataaccaaaatcagagccaaaatgaagaagtttgagacataaataactataaaaagttcaatgggccacgcatgtgctgtggctcgctcctgtaatcccagcactttgggaggccagggcgggaagatcacgagttcaggagtttgagaccagcctagccaacatggtgaaagcccatctctactaaaaacacaaaaattagctggccgtggtggcacatgcctgtaatcccagctactcgggaggctgaggcaggagaattgcttgaaactggaaggcagaggttgcagtgagctgagaccgcaccactgcactccagcctgcgtgtaagagtgaaactctgtcttaaaaaaaaaattcaaaggaaccagaagttgattcaatgtaaacataataagatagataaaacactagactgatgggaaaaaaagaaataattcaaataaaaacaattagaataaaaagtaaaaacaaaaacaaaaacagatgcttgtgaggttgtggagaaattgaatgcttatatgctgctggtgaaagtataaatttatttaaccattgagaaaagcagcttggcattttttcaaaaacctgaaaacagaattaccattcccaatcccgcaattgggaacatacccagtgaatgtaagtttttctaccatgaacacacatgcacgcgtatgtttattacagcacgattcacaatagcaaaaacaagaaataatcctgtatgtcttcaatggtagactggataaggaaaatgtggtatgtaaacaccatgaaataggatgcaactataagaaagaacaacatcatgtactttgcagcaacgtcgatggaactagagaccgttatttttagaaaactagtgcaggaacagaaaataaaaaactgtatgttgtcacttataagtgggagcaaaataatgagaacacgtggacacaaataagagaacaacagacactgaggctcagttcagggtagaggatcagaggatgaagaaaatcagaaaacaaatctgttgggtactatgcttagtacctgagtgataaaataatctgtacacaaaaacttcatgatatgattttacctatacaacaaacctgcacatgtacccctgaacctaaaataaaaggtaaaaaaaaaaaaaaaaaatcggctgggtgcggtggctcacacctgtaaccccagcccattgggaggctgaggcaggcagatcacctgaggccaaaagttggagaccaacctggccaacatggtgaaatcccgtctctactacaaatacaaaaattagttgggcctggtggcacacacctgtaattccagccactcgggaggctaaggcaggacaattacttgaacctgggaggcggaggttgtaatgaggtgagatcgcaccactgcactccagcctggaggacagagcgagactccctctcaaaaaaaaaaaaaaaaaaaaaaaaaaaagcatttcttggaaattactatcttgaagaaaatattcaagcctaggcaaccacagcctgccaattaatctctgatgacataaccaagaaatttttacctggatctcacaaataaactacataactgtaccaaaccaattattgaatctggtttgcttcgtcatgaaacttataacagacttttcttcaagtctctcccatggatcacaacccacaaaccatagctgggcactctatgattcttgaatcacactttgatcagattctcatttttagagtgactcccgtacatctctaaaaggaaaaatgaggaactaaggaccccaggaccacagctctttccactcatgaatcttgcaccctgagtcaggattctcccctgatgactttcccatccctgtacaatctgggtgagatgaggcgctgggagtgcagagcaaaccagagaggcctccagtccagggtaaagccactgcagaggaaaaagacagaaatcccagggtcccaggcgctggcccaggcaccatcttgcggctggaggggacgagagccgagctgggccaaagacgatttgggtcgtcaggctctggagctgactgcgagaaagtctgggacctgctacagccactttctgccggttccaaccagcccccacccctctctcacgatgacagacccagcactcaccatttcccggcttccagggggtcccggtcttttagccataaatctgcagatacctgcaggacacaaggacacataggcttggcctctaggagcagaggacacagagcagtgaagagaagaactgcagctctggacgcagaaaaacacaaaggacccgcaaaattacggaagtagcctgttctttccagctgcatgcctgattggacagtttctagaccacggctcctgattggataaggtttcaggccccacccttcatgccctgagtgagggaatatttgatcagacactgggctgagcgaagcaaaaataacagcctaggctgcagccttcacaggcagggcttcttccttgatctgagccaggccaacttcagaggatatttgcatttaaccttgtgtataatgtcatatgcatttataaatgatatataatatttattcataaattgaaataatgacaattattttaaaatttaggattttatgcccttccttgctgcggatcctttgcagtgatatggtgtgactttctggctccacccaaatctaatctcaaattgtaattcccgtccatgtgcggtggctcacacctataatcccagcactttgggaggccgaggcgggcaggtcactagttcaggagttcgagacaggcctggcaaatacggtgaaaccccgtcaatactaaaaatacaaaaattagccaggcgtggcagcgtgcctgttagtcccggctactcgggagactgaggcaggagaattgcttgaacccagggggtggaggttgcagtgagccgagatggcgccattgcactgcagcctgggtgacacagagagacttcctctgaaagaaaaaaaaaattgtaattcccatttgtcagggcagggaccgggcaggaggtgattggatcattggtgtggattatcctcatgctgttctggtagtagtaagggagctctcaagacacctgatggtttaaaaatgtggcacgtcctccccggttctctctctttttccaccatgtaagatgtgccttgctttcccttcaccttctgtcatggtcatgaatttaagtttcccaaggattctgcagccatgtagggctatgattcaatttactttaaaaaaaaaattacgcggtttgagctatttgtctgtagcagtgtgaaaatggactaatacatgcggacagcctgagatttcagaagggaggcaatcctctgcagtaaaatatgagccacatgtaaatttttaattttctagtagccaaatgttaaaaaaaaaaaaaaaaaaaggtggggccgggcgcagtggctcacgcctgtaatcccagcactttgagaggccgaggtggggaaccacctgaagtcaggagttcgagaccagcctggcttacatgatgaaacccctgctctaccaaaagtagaagaattagctgggcgtggtgacaggcatttgtgatcccagctactagggaggctgagacaggagaatcgcttgaacccaagaggcagaggttgcagtgagccgagatcacaccacagcaccccagcctggtgacagagaaactctgtctcaaaataaaaaagaaagaaacaggtggaataacaggtggaattgattgcaacaacttaatcagcccaatatatccaaaatattattattttaatatgtgattactatgtaatggttaataaagcacatacatttttgaagctaaatctctgaatgtaatcttgtattttacctttctagcacactgaagttcacactagccacattccagcaccctgtagctatgtcagaggcgtctgaagcagagaaactgcatctggaataggtgctgggtaaaatggggctgagacctacaggactgcatttccatgaggcccggctttctaagtcacaggataaatagaagattggaacaagatccattttacaaagaccttgctgataaaacagtttgcagtaaagaagccacaaaaatccaccgaaaccaaggtgggaatgaaagggacctctggttgtcctcaggaatcactacacgctaattataatgcattagcatgtgaaagacattcccaccagcgccgtgacagttaacgaatgccatggcaacatcagaaagttaccttacatggtctaaaaagaagagaaacactcagttctgggaattgcccacgtctttcttgtaaaactcatgaataatccaccccttggttagcatatactcaagaagtaactgttaagtatccttagttgagcagcccacattgctgctctgcctggagagtagctattcttttattcctctactttcccaataaatttgcttttgctttgtactgcagactcacccaaaactctttcttctatcttttttttttttttgtctttgagacagcatcctgctctgtcacccaggctggagtgcagtggcgccatctcggctcactacaacatctgcctcctgagttcaagagattctcctgcctcagcctctggagtagctgggattacaggcatgcgccaccatgcctggctaatttttttatttttagtagagattgggtttcaccatgttgcaaggctggtctcgaactcctgacctcaagtgatcctcccgcctctgcctcccaaattgccgggattacaggcataagccactacccctggttctaaattatttcttgtacgagatccaagaacccaatcttcatttctgaattggggccatttctggaagcttcttttcagtgaattacaaaaggatgatactaaggaaacccgcagctcaaaggaaatagactgaattaccaattggctaactttttgtaagtggtggcatacccgggtaaagaatggaatcgggttagtagcccaatttagtggagttagagtgtctcctaagacagataagataaaaggtcccttttaataaaaggcaagaacacttgaaaaacttgtgtttgaggtgcaacttagaaaggttagagtctttcctaagatttagggggttagaggcccctctcagtaaagtccctctcagttaagattagatttggcattatggaatattaaccattgctgtctttgtgtttgtttgtttttttgtttgttttgagacagagtctcactcttgtcactcaggctggagtgcagtggtgagatcttggctcactgcaacctccacctcccaggttcaagtgattctccttcctcagcctcccaaatagctgggattacaggcgcccaccaccacacctggctaatttttgtatttttagtagagacagggtttcaccatgttggccaggctggtctcgaactcctgacctcagctgatccacctgcctcagcctcccaaagtgctgggattacaggcatgagccaccgaaccaggccttatctttgtattaagttgccttgcactttttgctaatggctgtggctgacagaattaggtgagtacagaatcatggaacatgtggagatttttcctccctaaagtgggaaacttgagagcagatgggactgcaaaaaagattctttcacaaccaacaagcggccacctaaacttttgattcggtgcaatgcttgggtctttctctggctttcctcagctcctcacctttcctgccctgccataggcaatctctctctctctctctctctctgtctctctttcctttcctatcttttctgttactctaggccaccatcttgcgcagagatcacatgttgaaacttctggtcagaagtccctgaaacaggccaggcatggtgactcacgcctgtaatctcagcactttgggaggccgaggtgggcggatcacctgaggtcatgagttgaagaccagcctggccaacatggcaaaacctcgtctctacaaaaaatacaaaaattagccagggtggtggcagacacttgcagtttcagctactcagtgggctgaggcagggagaattgcttgaacctgggaggcagaggttgcagtgagctgagttcatgctactgcactccagcctgggacacagagcaagactcagtctcaaaaaaaatactcccaaagaaacaaaaaagaagtccctgaaacaaacaacaacaacaacaacaacaacaaaacaatggatgaagtttccctcttgttttatgttcttgggagcttgaccttgtagccatgtggcagtattttctcttggtttctaccatccagcatacataaattttgaaatttatgttatacttaactctaaaaatgatcttgagcagttaaaaacctttgcaagctcaaaattggctgctggaggcttcttctgggagactccaacggagactgctcagtgctgtagctcagtagttgggctttgctgtctcacagtggcagcctgggttcagggttcaatttctagcttaggagatgagtcctttctgatttgatatctgtgtgaacatttgttgattctcttcccctccatgaaacattttggattttcctttctctgagctacctttgaagattctagattttgtaaaaactgctttgccacctttttgaaaataccttgtacacttgtggttaggttcttaaccttagttaaagcttattggtttcaggaggtggaggtttcagtgagccaagtttggtcactgcactccagcctgggcgacagtgggagactccatcacaaaacaaaacaaaacaaaacaaacaaaacaaaaaaaggcttatttgtttcacctgtgacattatgttagtaaagttcaaaagccagaaatattggcaatttggcatggctaaagtcaagcaatgagagaattaaatacatgttttcagaaagagcatcatggttaaaagctggcttaattattattattattttatttatttattttgagatggagtcttggtctgtcactcaggctggagtgcaatggtgcaatcttggctcactgcaacctccacctcccgggaatcaagcaattcccctgcctcagcctcctgagtagcagggattacagacacccaccaccacacacggctaatttttgtacttttagtagagacggggtttcaccatgttggccaggctggtcttgaattcctgacctcaattgatctgcctgccttggtctcacaaagtgctgggattacaggcatgagccacaacacctggcccaaaagtcagcttaattaattgcagatattcaagctccaacagctagaagtccttagaaaaaacagaggaggtgccacaataggcattttgggagaaacatctgttttcttcatgaaactccaggaattggaagtggatagatccctctcaaagtctaaggctctgttccatttttgctttgcattatctgatggtttttactttctggggtatcagaaattacttcacgttacgaaaaaatttagatatgtaataagtaggtaggaaatatacattcagggatggctaatggcagctatggggggatacttggctttttgcatatttgaatcagagaagtgtgctcttggccacctagaaggcatggaaatgtccccgccccccactgacaggtaagatgccaatgggagatgggctgattccctctttttgggatccaggttctagtatgaaaataggagtcttaatttgcggggtggggggggggggcgcaaatctgttttgccttccagctgtgcctacttattaagctgttgaaattgcttagtttttgctttcctggtcctatttatcctatggatccatcttaaagccagggtggtaatccaattgagaaactgacaaatgaaaaatcttacaggtacttgatcttcttccagctgtgtatttatatgtgttgtgtgtgtaatatgaaggagatttgattaattggtttaaaaataataagagctcaaatcaaatattttatcagaaaaatagaaaccatggtgtattttagtttacatcactttagtaatcattgggaaataaaaacagttttacatgctaggtatgtaaaaaaagtcaaatgtgttttcagtaaaagattacaagaagtcatgggaatgtagattacttttgtcctaaattaaagggtcaaaggattgttttaaattagataaaacagagctgaaggattaaccaagttgtgaaaagttcgtaaaaatttacatctggtaaaagaaattctgtgtgttaacatattggctaaagttaaaggggtattcagttttttataaattgaacactggaataaaagtacaactggttttctttagagcactactctgctctttcacaaaaattgtaaagtattataaaagggttataggaatcttaccttattgtcaaactgattaagactagatagatttgtctataaggttttattaagaattaggtttgacatcaatagtacattaatgcaagggtgagatttagcttttcttcatgaacaagattttcatgtaatattttaaaaatgacatatttttgtctgcccttttgaataaactggagcaaaaggaaaggaaaaaaagattgtgtggaaagtgaagtcttccctctattagtgagtaaaggtttttgtctttttaaaatttttgagttatcattttggttagtgagtgacttatgataacctgggatttgatatttgacaaacctttaaaaaatcaaattataaattatgtatttttcttacctaaatatcttttagatattaggtcctctaaaatacaaaaatgacatttggcttatttcgtataaaaatcaaacaggaggaaatgtcagaaagcattgtcaggccgggtgcagtggctcacacctgtaatccgagcactttgggaggtcaaggagggtggatcacctgagatcaggagttagagaccagcctggacaacatggtgaaaccctgtctctactaaaaatacaaaaaaattagccaggcgtggtggcatgcacctgtaatcccagctactcgggaggctgaggcaggagaatcacttgaacccaggagacggaggttgcagtaagcagagattgcagcattgcactccagtctgggcaacaagagtgatactctatctcaaaaaaaaaaaaaggaaagaaagaaaatattgtcaaatatgaaatggtgtttggttttccttgggctgtatttgtataaatatgttattggtatgtgattcaaaaaaagggaaaattcccataattccaatataacttagtgtatgttattaatagtaataattgttatgtaaaatcattgtatgcaacagaagtaaccaaaatctgtcaattgtagctttaatagtggctgtcctaagacttctttgtcatccacagacaattgttgtcttgttttaacgctctttgaaaggtgatttataatcaggtttaggacgttgacaggtgctcttaaatgcaggtttctgataactttggaaattttggcaatagaataaagaaaaaactttcagaactctcatggagagctgaaatgttcatcaatatcaagcagaacaggagataactgcgtggagtgaactaatgtaagactaaagtaatctttttgactttgcttaaaatattggtgatccattgttttgtttttcagagtcctggaaacttttattttgagctatttacagcttttagcaattgagtaaaatatatttctgtaaacaaaatttggagcacatttgtttctatctgttttctccagaatttggaaactatttgtgagtattcttaacttatggcaatataatttgtataagtgcaaaataatgttttcttctgcaacaggacactgttggagaaattagttattttgccaaggctttggctggaatgacgtgctttcctttaaggaatcaaacttgacttatagagccaataaaagccccttgggaaaactggctttatgccttgtctacacagtccctatacagggttcctaacctggggtaagtaaataatgtcactttttgacaggttcatgagccccaagttatcccgtggtatcaaaaaagaaatttatgcaactcatatttgagggtatagactcatggctggctcagctttaaaaagtcttatctgagattcattttatggaacagtttcatcaaatccaatttttaaaacctatgtaaaaataattattcttgctgcacttcgtacaaataatcaggccaagtataataaagcaacttggtcataccatgatttgtctttagtaaaatggcagactggggagagtaaaaaattatactttaagaactatggtacatctgttattaaattctagatttatctgttgttgttgaacttttttttgaaagaagttgaacctttgaataagccaatgacaagttctaaaattgaggcagtaataaatagcctgctaaccagaaaaacccaggaccagatgttttcacagcctaattctaccagaggtacaaagaggagctggtaccatttctcttctgaaagtattccaaacaattgacaaagagggactcctccctaactcatttagtgaggcctgcatcatcctgataccaacacctgaccctggtggcgctggtggtagtgcagcatgagagggagtggggatggggtttatccacgggccaggggttagaggattccctgggcagcacactgcctggctccattctcttcattttagatatattgggagggtttgacacacagagaaagaggagacccatctcaataaagtgtgtgaataggggacggaaatcaaggaccaatctttggaggaggactgcttgtatctaactctgagaacagactggggcggcatgggattggaggagaggaaggagcctcttaagagaaaggccccaagaggctgggtccctgctccctcccttccccacaaggccccttgagcatcttccacccaggccctgtgagtatcctgtccttccctctgtgtctagaaaatcaaagttctccaggagatgtagccactccaggtggctggaaaaaatgactattttcagcccaaggagcaattttgggtctgctttcagacaatgaagtggttaagtgagaatgagagaagaggacccagtaaattagcagaggggaggaaaagacttttttgtggccagctacagagagcctgtggccatagctccctggccagtgtcaggtcctgttgcatagtgacccctggggcacaaatattccagctgggcaggtaccgggagggagacctgaggtgtgactcctggtagcctcacagctgccttaatgtcctgcagctacaaccatttctgccagcggccgcccctatcccagcaggccagcagctcatccagcacctgtagtgtctgaggctccaccagaatgtgattcaggacatcagccctgtaccatccttgacctagagagtgagccccagggaacaacctcgatgtgggtggcaacttagctccatggtgtctctgttaccaaagaccaattgctcctgctggttgggattagatcccaggacctctgcaggtgatgtgggtgagcatgaggcaggcaccccaatatttgatgctctggggcttaacacctgcacaacaggcaaatggcacccccacttggcagacaccccagtgaaggtcaaagcagccctgagtggggaagactctgacccagagcctggagtcccaccagagaattctcaaaccagcgtctaaaaactcttcctcaaaatggctagggttcagtatttgcagctttgccaacccatgtcaattgcaatgactcaaatctgcagttgcagcgtgacagcagcctcccgcagacaacctgggaatgaaggtgcatggctgcaatctcatagaactttccttacaggcactgaaaactccaatttcaaaacatcaagtatgattcttcttttggtttgttcgaccatttggaaatgtaaaattcatccttggctcatgggagacaggaaagcaggcagggacaggctgcaccttgatgacctctggcagaaatgaagctcagaggaggagatgacaggagggggtgagcccagccccctcacagctgagatttaccccaggaggggtccctgccagcaccaccctacttatccctcatcttggcttcaagagcagttcaggtgaagagcaggggaacagaaaagacctcagcaacgaaaaggaaggagatgcagggttgggcagccatgtggatggatggcgctcaacagtgcatgctaccacagccattgttttttattttttatttattttttattttttgagacagagtcttgctctgtcgcccaggctggagtgcagtggggtgatcttggctcattgcaacctccacctgccgggctcaagcaattctcctgcctcagcctcctgagtagctgggattacaggggtgcaccaccatgcctggctaattttgtaattttaggagagacagggtttcaccatattggccagactggtctcaagctcccgacctcgtgctccgcctgctttggcctcccaaagtgctgggtttataggcatgagccactgcacccagcctaatttttatatttttagtagagatgaggttttgccatgttggccaggctggtcttgaactcccgaccacaggtgatccactcgccttggcctcccaagtgctaggattacaggtgtgagccactgcacccggccaacagcagccatttacaccaagttgagcaaggcatgaccatccccagggggaccatggtgggggctctgtgggatagaggacatgctgtattctgcacttatatggacgctccacacagcagtcattacagaaaacacaccgggtaaaagggcagtatacaaataggacaccagtactggccagttgggtctcactggtcagtggggtaacgaggtccaggtgggcccacaaggtgtggctggtggtcggtttctgtctgcaggaagcctgggacccgtgtctaacagaggaggacccaggctggagtgaggaagtcatcagagtcaccaggtgaggggtcagagctggaaacagagcaggcagggagccctggcctctcccagtgagggctgagaagctggggtgggaacacaacccatgggcagatgcacacaagtggtccctgggcccctgccggtgcccagtgactgcccagttcctagggagccactgaggcctgagacccagggacacaccacctgatcatcacccccaggcctttctgccgagaccagacaatgcccagtgcaggcaggtggtctgggattggagtctggggcaggggtgcatgttcctacctggcaggtgccctgacctagacctgcctgagctggctgcaccatcacttgttattctgcctatgtatggcctagattcaaaggtccagctgtccattctggccacaccattccctggctcctctgccaggcccaattgtgcctgacctacctaagccagccctacctgcccagtgatcacaagaatcctgccagccagaaggactcacttttttcccctgaaatatccacaagagcctgtcttttttatttatctatttatcgagacggagtcttgctctgtcacccacgctggagtgcagtggtatgatctcggaggagcctgtcttttgcaggggccacagctcagggccagctttctggaagccccagagtcagatgtactcctgtcctgacttccagccttccagtactggctatcatgtcttttggggaccactcagcactgggagctgcctgaggcccccacatggcagagaacatgctggtcatgacagcctcagcccaagaccctggcccaagagcaacagccagttggttctagtgtctggatggtgacaacaggtgaagccatctgcacaaatactgccttcaacctggtccagtgacagactaggggagccacagagcagcccccaggccagccctgcccagtgtttccatcagtgtggcatgaaaaaaggaccctgtactcagccaaaagctgagccctgacctgcccacccaccctgcccacgagggactctgacttcaggcagaggcaggcagcagagctgtcaacttctgtgattctatcccagggcccacaaggtcctcaggagacccaaaaggagctgagctgggggagtcagggaggggcctgctgagtgaagggcagcgtgggcctgggcgtgagtcggcactaagagcacatggcctggctcccactggagaggaggcagcaggggagagtcctgcagagccctcacacactccactcagctcccaggtacatgtagtgcccataagcctcccaggagacccagaaatggttctttcttggtcaagaaaagaggcaaccccacccatacccacacaggccctgatgcccacacacatcagagaacaaagcttttgtgcccagggtggggcaaagggggaatatcccctccttccccctgtggatcccataacacttgctcctcctggtgctccacccccaccccacagggtgctgactgcaaccaaagcgccccatggaaagaacagcccatggatggagcccaagaggcgctatgtcctgaacgggccgtgctgggtctaaggtgatatttcccaatcacagagtctctaactttgccacccactggccctgtgcttccgcttcccttggtggcccagggtaacaatcccactctgaaggctggaggacccacagaggcaccacccccagttaaatggctgcattgtgaaaggggatgcacaagagacatttcctgccttgggtctcttgcctcaggactgatgtgcatcaggccacggccaggccagcctgctggagagggctgcgttccctgtgctctgtgtggggaatggtgttcacagttctgggtcactaccgttgactcccccaagacacgggggcagatgtgctccattatataagccttgggtcaatcccagagaatgagcatcaaattcactcctgtctgaagctggctgccccaaggcatttgggttttggggtgagataagggtctggagtcagcatcaaagtgttctggttttggaaacacatgaagttctctgcagctctctgaggtacaggaaatggtgctaggtctgtgctttaaaaaagcctaagaggagggggtgcctggaaggaatcctgaagccaagggtaagggtttccacctttcctacctccccaccagagacattccacaaagtctcatgacaaactcagaataggaaaaaaaaaaaaaaaaaaaaaaaaaaaaaaaaaaaggaggcggggtgaaggaaagtggaggggagggagggggtaataagagattacaggggatcatctggcccaatcctgaaacacccctgccatatgatgccctatcagtcctctcagacagctgaggaatctgaggtctggaggaggcgcctagagcctcgacaggcagctggcagcctggagcccctgaggtccaggcagattccgccacaagcctgagccagaggcagcgggaccccagttcattcacttggaaatcactcaagttgactgggccactgcccctccccagaccctcccctttcccttgtcaggcaacagccttcctgcaaagctgccaggctagggatgaggatgcctcggtccccctaggaattggctgtccccagggtgcaggtgcccggcagctgcccaccaggccacttctctctgcttactgcctggagcctggagcgcatgtgaggagcaggtggctcacggagcgcttagcccggccgcgtactgtaggcactgcattatgggtaccatggtacccctgcaggttagggttggcatacccttccccggctgaccccacaaacccttctcgaagacccaccacattccacctgaccttgacagccaggggccccacagccctgggacattggcccgctaccctcctccttgcgttcagcacccctgggggggagacccattagctcgccaggtaggaaagcagggtgggggcagtggtgacactagagggtgtcaccttgttgtgccgagcactggcgggggctggacatgagctcacacactcacactcaccctccaaagtccaacctcttgctttggccaaagctggccagaaactagggcctggggacagaggagatagacgtctccgtgccggcttcctgcagtgtccccacggttgggtgtcggttctgcccctgcaggtgccacatcaactgctgcacccaggtggctccagccgccatcttcaggaagcgggggcagcaaaaccgggcactggccccacagtgccactcacacctggcaaccactttccacccaggcgcccgttccgcctcctcaaagcctcaacccgctgaacccaggcctttgccttgtgctggctgagtctttcttcacctgctgctctccaggagctttgaggaggcgctggccacaggggtcacagccaggcagagcacaatggtgcaggctgagacgcccaaggcggagaggggatcttagcatctttaactggtgccctccactaccggaaggcatgctgccccccaggcccgtctatggcacccgcagaaggagggttatgagaagcaggctgctcattataactccagttctgggccccttagacgtgggatagagggggacaggcagagctgggatgtgactgtaatggagatgggtctgtcgagggctggctgggagctccagcctcctctctccttggcagggggcctgaggcccatccgcagctctctttgactccttttattctgcagaacacccagaccccagccttctcatgggaatcataagacgcatgaggcccagggttctttctgcctcttcccaaccatggtctttgtatttcccccaaggagtgtctaactccttgaacagaattgcggcccagagatctgtatgctgtagtcattgaaatatgccaaggttctagaaaagcaaccacacaaaatgaagtgcttaatatttctatgttaaatgaatgaatcccaaccagaaccttcttagatatctgaatgggcacaggaccccttttccagcactcagggaccctgatctgtctctataactgatggcgactagctggaaaaaagaccgtcacactttctttaaaatggaaaacagattattaatttgtcttgatgaataaaacagatttgctttctatgcgctattttaaatacagtgtaaaaaacgtggcaaagcctttattgttcacactttactcaacatcagataattcatgctagagaaacactatacacgtaatggatgtagaaggagtttgatttaaaatataaaccttagaaataaccagaattcatacggaattcttccatagggaaacttttcagatgcaataaatgtgaggaagtattcaaaaatcaagtctaaataaacatcggagaatttccacgagaaagtacaaaggcactacaattttaaaactttacattaaacaagaatatctaatatagagactaatctaaagtcaaaacaattagataatttatttgtatgtttcaatgaagcaacggctttgtatttgaacaggtataattatatatcaatggatactcgttttgtattgtcattatttgctttttttttttttagaaacaactattattgatgtaattcaactttccattcagttgaccctgtccctacattcctagtgtttatatgaaaacatgtgacctactgttgctgcatcagagctgggagaggccattctacatgaatttctccatggaaccttcatggcaaacgtaaaattaagaaataaaaacaaaaataaaactgccaggcactgtggctcatgcctgtaatcccagaactttggaaggccgagtcaggtggatcacctgaggccaggagttcaagattagcctggccaacatagtgaaacctcatctctactaaaaatacaaaaaattagccagacgtggtggcaggcacctgtaatcccagctacttgggaggctgagtcaggagaatcgcttgaacccaggaggcagaagtttcagtgagcagagattgcatcattgtactccagcctgggcaacaggagtgaaactctgtctcaaaaaaaaaaaaaagaaagaaaaaacaaatttaaggagagatcctctttgtggtttacttaaagtctgcatgagggaggtgttctggaagttattcttctctattaaagcaagagtgaaaaatcctgaatttctgaaataaataattttaccaatcatctctccttgaaggataaaaaagctggccagtctattaaaataccagtgtattatagtaaaagtttaaagtcttgaatatcattcagtgtgataattttttaaaaaattacagataccagagaaaagtaaagataacacctccatgagaggattttaatgtgttttaaatcaatgtttcctaaataattaaccttagtctttaaaaatggagaaaggaagtatctaagataattacatcagagaaaaaataatgcttattcagtgtttgtgactgtattttcaccaagaagaatatagtggattttggaatgccttacttagactatgtgtgaacttagttttaattaataaactaaatggttttcaatgttttgacactgatgtgcaataaatgaaatggtatcctgccaccaatgttaaactattttctttaatcaagataacaatatactattgagtaacacagtgaaatgacttatttagtaatcatttgttcagagaacttaaaacaaataatttggtgactattgttgtcaaaagttttatttcattttttttaaccttttggtaactacaggaagattatgccagttatgataaagatcatataggaatgtggttggccaggtgcagtggctcacacctgtaatcccagcactttgggaggccgaagcaggtggatcaagaggtcaggagttcgagacctgcctggccaatatggtgaaaccctgtctgtactaaaaatacaaaaattagccaggcatggtggtgcacacctgtagtcccagctacttgggatgccgaggcagaagaatcacttcaacccgggagacggaggttatagtgagccaagataatgccactgcactccagcctgggtgacaaagtgagactctgtctcaaaaacaaacaaacaaacaaacaaacaaacaaaaaaagatataggaatgtgattggaagccataatttctgaattttaaattattatttataaaaatttactgaatgttggctgggctcagtggctcatgcctgtaatcccagcactttgggaggccgaggtgggtggatcacgaggtcaggagctcaagaccatcctggccaagatggtgaaaccctgtctctactaaagataaaaaatattagctgggcgtggtggtgtgcctgtaatcccagctgcttgggtggctgaggaaggagaatcacttaaacccacgcagcagagtttgcagtgagccgagatcacaccactgcactccagcctgggtgagagagcacgactctgtctccaaaaaaaaaaaaaattatcatcaaaaagtgggcaaaggatatgaacagacacttcttgaaagaagtcatatatgcagccaacaaatatgaaaaatttctcatcattactggccattagataaatgcaatcaaaaccacaatcagataccatctcatgccagttagactggtgatcattaaaaagtgaggaaacagcagatgctggagaggacgtggagaaataggaatgcttttacactgttggtgggagtgtaaattagttcaaccattgtggaagacaatgtggcaattcctcaaggatctagaactagaaataccatttgacccagcaatcccattactgggtgtatacccaaaggattataaatcattctactataaagacacatgcacatgtatgtttattgaggcactgttcacaatagcaaagacttggaaccaacccaaatgcccatcaatgatagactggatgaagaaaatgtggcatatatacacaatggaatactatgcagccataaaaaagaatgagttcatgtcctttgcagggacgtggatgaagttggaaaccgtcattctcagtaaactaacacaagaacagaaaacgaaacattgcatgttctcactcataagtgggagctgaacaataagaacacatggacatagggaggggaacatcacacactggggcctgtcaggcgggtgggggggctaggggagggatagcattaggaggaatacctaatgtagatgacgggttgatgggtgcagcaaaccaccatggcacgggtatacctatgcaacaaacctgcacgttcttcatccatgtccctgcaaagaacatgaactcatccttttttatggctgcatggtatttcatggtgtgtatgtgccacattttctttatccagtctatcattgatggacatttgggttggctaccattcaggacataggcattggcaaagccttcatgtctaaaacaccaaaagcaatggcaacaaaagccaaaattgacaaacaggatccaattataggttttaaataccacattctgatcacttaattgaggtgagagaaaaataatgcaatagtccagagcatcagatcaggcagtcagcactgtggcagatgtggagacagattaaacatgatgatggtgtccttcttagagaggtaaatgaggcctattccaaatatatgtgtgtgtacatatatatatatatatatatatatatttatatatatatatttatatatatatatttatatatatatatttatatatatatttatatatgtattaatatatatatttatatatatatttatatatgtatttatatatatatttatatatatttatatatatatttatatatgtatttatatatatatttatatatatttatatatatatttatatatatatttatatatatatatttatatatacacacacacacacacacacacacacatatagcagacgcatttgaaatttggggtagaaattgaagtgagctctctgtaatcactctgaggtcttaggatagctagctacaagtggtgtcatcacgtgaacaaatgtgacagagatgagatggggacttgggaaatataagtttctttttcttttcttttctttctttctttctttttttttttttttttgagacagggtctcgctctgtcacccaggctggagtgcagtggtgtgatcgcagctcactgcaatctctgcctcccgggttcaagcgattctcctgcctcagcctcctgagtagctgggattacaggtgtgcaccaccacgccagactaatatttgtattttcagtagagacggggtttcaccatgttggccaggctggtctcaaactcctgacctcaagttatccacccacctcggcctcccaaagtgctgggattataggtttgagccaccgacccggcctaaattgagacagctttagaatgttaagcagtgatagagtttggatgagtttccccgcccaaatctcacatcgaaatgtaatccccaatgttggtggtggagcctggggggaggtgatcggatcgtgggtgcggatttcttctgaatagtttagcaccatccctcctggtactgtcctcccaatagtgagtgagttctcaggagatcttgtcatttaaaagtgtatagcacccccgttgcctgctttacaagctcctgcttccccttccaccatgattttaagcttcctgaggcctccccagaggtagatgctggtgttttgctttctgtacagcctgtagaaccgtgagccaattaaacatcttttctaatcaattaccgagtttgaggtgtttcttcatagcaattcaggaacggattaatagagtttatttgcacaaacagcaatttatgaatcagagagcaccaagttatggtttctttggaggctccaaggagggtcttgtaaaaaaggtttttgtaaagggcatcagaaagaaaaccaaattcaatatctgattggttacagttatatattgcatttgcacccatcaggtggaaatgtcttggtcgtgtaatgagagctttattggcagcttgtggttggttaagcctaattttattttctcaaagttagtaatttacaataaattcctttgatgtagttaggtttccttaggaagaatcccagggcagcatggccacttcagtgtaagtgccagctattgaattattttaaccctccacagagggcctggttttcctcgcatttttcaaatgtatggcaagcagggtctcaaatccatgactgttctcccagcctaactgttctaggccctgtggaaaattctaactttccaattcctttcccacattcccaaatgccaaccgttcttctccaaatcacaacattatcaactattagtcttttatttagttttaaaacagacacagcattttaattgtttatttttgtttcacggcgtggtggatggctcttctaaaaatatgtgtctgtttgtgaacatttcacatgacagggaagcaaagggtaatcacctgacactctgctgtgacaagtcttcgcgcgtctaattttccctaggcacacacaccttaccagaatatctctgggtgaaggtttctttttggaacctttgcagggtgatgtgtcctcagccactgtcctgttttttcctggttctgaatactacaaccgtctggggatgacccaagatacccacaagagccatgtctcttggagtgtctagtaaatatcagtccttctgtcagcttccagaggagagtctgagatattgggtggagcctctcagagaagcagctggatgtcctcatgctgagagcagtttcctgatataccattcctctaaaaagctaactgcttaaacattaaaaaaatttttccctcagacccagcttttattcctcgcagacatattggtggtcagccaatcaggtgctggtattgaggggaaaaggcgcaaatgcatctttccctcttgtttctctcacgcttgtgaaaggagaatatccctaagtagaagtaaaacccaccctattgaggtagtgtatgaacttgcaaagccaaatacacatcagacacacagggagcaagtgcattgtcttctgagaaggtggtgatcaagttctttagtgagcaggatgtggggaggagattctctcaagtgattgatacatgaatccaatatgtctgtgttccagtgtggtgattcctcaaggacctagaactagaaatcccatttgacccaacaatcccattactggatatacacccaaaggattataaatcatgctactctaaagacacatgcacacgtatgtttattgtggcactattcacaatagcaaagacttgaaaccagaccaaatgtccatcaatgatagactggataaagaaaatgtggcacatatacaccatggagtactaggcagccataaaaaagggtgagttcatgtcctttgcagggacatggatgaagctggaaaccatcattctcagcaaactatcacaaggacagaaaaccaaacaccacatgttctcacttacacgtgggagttgaacaatgagaacactgggacacagggcagggaatatcacacactggggcctgtcagggggtggggggctgggggagggatagcattaggagaaatacctaatgtaaatgatgtgtcgatgggtgcagcaaaccaacatggcacatatatacctatgtaacaaaccttcatgttgtgcacatgtaccctagaacttaaagtataataatgaaaaaaaaaatgtctgtgttccagtcagcaccgcctctccaggtgttcatcaccttgaatatatttgttcagttatttcaacttccgcctttcattaaccatatactgtatttcatcattagagcttgaaagataaaaaaacacaaatgttttctaagagaaaaacaggtagatttgagagaaaaaaatcatattccattggttaaaaattctcaggtactgcttttattttgcagagtgagcgtagtaagattctgagttctgttctgttttagcatgatttcagacagagtcgcaggacttggttttgggaatgctaccttggaaaagaaatagagaaaatgtctctctctttatgcctgcataaaaataaatacatttctacaagaaacttacagattaacacatgaattacaaacattcatgaaaacgccagttacactcttgtgcagggtggagaacttgtgacagttggtaactcatttttttctagatgaatttctacttcatagggaatatttttatatatatgataaagaagtatttgccactatgcatacacctctttgctcagctagcatataacctaaagcaatatgattgtctagtacaagcttagccagtgaatcagtagcatttttgttgagctacaatgaatacaacagttgcatctgtaattttttccaaggttataaaaatattttaagtcatgtgttcatgggaacaactcaccaaggcaaaagcatttttccagtaaaatgcataaagctgttttcctgaaagccaggcagataattagcagatttcctccaaatggagtcttcatctaaaacagattggtggccaagcttggggaaaagtttgagagaatttgtccagtgctgggtttcttcggagctgtgtataaatagaggggtgaccaaatatcctaaaagacattgcccttcaacttagcagcacaggtagtggccaagaaaacctaatatggttccttccaacaggtttgcagggtatctgtttcttcatagaaatctggtttaaaagaaaaactcaaattttatgattgtatttttgtatgattagtattaaaactaattttaagaaaaaccttataaataggtgtatctaatctcaatcaactttgacaatataagacttctataaaccttttataactcttttaactcttttctctttttttattctctttctccaactttttatatccatttagtttatctctcttttttattttttgagacagagtctcactctgtcatccagaatggagtgcagtgcaccatctcagctcactgcaacctctgcttcccggattcaagcgattcttctgcttcagccccctgagtatttgggactacaggcgtgtgccaccacgcccggctaattttttttttttttttttttttagtagaaaaggggtttcaccatagtggccaggctggtctcaaactcctggcctcatgatccacctgcctctgcctccaaaaatgctaggattacaggcatgagccactgtgccctgtcgagtttatctcattttctttggcttttattctttcaattttatgcaacctttaaataaactctaaactcaccaaaattgccttttaagaaaaaatcacatcctcatgtctcctttttaaaataaattttttcaccaagaaacacatcttattttctttgtacactctatgtagaattgtttctcttcttaacaatagttttagttatatcttaaccagaattttaattcttagtaattttaactcatagtgaaattctaagaagtaagcaattttaactattagtcatatactaacaatttatgagtacatattttatgattttttagaaacgtaggattttaaatggaaacatctttttttttttttttgagatggagtcttgctctgttgcccaggctcgagtgcagtggtgcaatctcggctcactgcaacctccacctcttgggctgaagtgattctcctacctcagcctcccgagtagctgggatcacagacgagtgccaccatgcccaactaatttttcgtatttttagtagagatggggtttcaccatgtttgccaggctggttttgaactcctgaccttaagtgatctgcctgctttggcctctcaaagtgctgggattatagccgtgagccactgcgcccagcaggaaacatcttttaacgtggaacaggatgtatttacttacagatctaaatatcttttgtttttgtgaaataaacctttaagaaaactttataaataggtgtatctaatctcaatcaactttgaccatacaagataagatttctataaaccttttataactctttttctcttctctttctccaaatttttatatccacttagtttatctctcttttttattttattttttttatttttagagacagactctcactctgtcgcccagaatggagtgcagtgcgccatctcggctcactgcaacctccgtctcccggattatatatataaatttgagatggagtctcactctgacacccaggatggagtgcagtggcactatctctgctcactgcaacctccacctcccgggttcaagcgacttgcctgcctcagcctcctgagcagctgggattacaggttcccaccaccacacctgggcaatttttgtattttcagtagagacggggtttcacgatgttggctaggctgctctcgaactcctgacctcaggtgatccacccacctcggcctcatttaagttaatttgatatcatgtagataatatacaaacacgtagatagacatatacatacatgtagacacaaaatatagcttacacatgtatgtatctaaaagccctagagatgcaggagttcattgtaaaagagtagagcttcagacctgagagcaacctgtccacccacaactcttggggctccatgaggaaaaatagaggtaccctgccaaagacggagaagcctgtggtgctttatctgtgttcttcaaggggtccaaggctgctagaagtttcctttaggttctctcacatggtaccaaaaggtcgcaaaaggaagatgagatagatagaagtaaacagaagagttaattctagaaaaggccgtttgagaagatttaggtttccaaaaagccagtaaagttttacattatccttggcaaaaatcatgtgagcaagagaagagacagagggagcacacatagttagcatgagtttagggaaagaggaattgagttgactgagaagcttatataaaaaaacccacaggcctcaaattaatatatacataaatagcctgaatatcagttataagtggacttttgactgtagagctcttaaattttttaaaattaaattttagccaagtaaatagcaaacattacttgtttttttctttctaaagtttacatcaagatgaaattttggaggtgggacatttctgtttactggaggtctagggtaattactatttaaagctgtttgtcttcggaaatttttagtaaatgttttctatcttccaaaccacagtatatggttttatttatgtcaggagagaaggttaaatgaaaaaaacaaaacaaaacatttctgtcacactctaaatatgaaccaaaattttaaattaaaggcgtacctgaactagtgactcaaaaccaacacaaataaacatgtgtgagaccaaatccaagaagtcatgcatggctttaactaaagctccaaagagagcacaaaaagcgtagcttttccatgattaaaacacctattaaaaacagcttcctgcaaatggggtgcaatctacattttcaggccacatattctagtgtctcaacttctcagtttaccatcaacccacaaaggccagtcagaagatggaaagcaatggtcggtaaaacagaagaacaaaaaatttccatggggtagaaaaggttccaaatgtgtactccaaaagtccgagagtcatacaaatgatagaaaacaaataaattcatcattataaatgtttcttgcctaagctagaggtactaaccgagaaataaaattttgagggtgagtctaaaaaccttcaatttttttttcaatttgatttcagctgcaatgctgttttgctaattacctggatgttaacatttcaaatacgtggtaaggtttacatctttgagggactgagaaaggcctgggaaaggttaaagtatgtgttgtaaatcctgcagcaaagtcaagcaggcaatttgagcatgtaaagggttttcttgaggcagtgaaagaagagccctctgaaaatgttatgtagttattatacagttaatagttattcaacttggtctttaacttgtctgtggctggatgttgtttatgggttacactctaattcacagtttcagatgtcatttcacaatgtctaaaaaatatgacctattgaatgtctactttcatgaagttactgacataattttgcatccaaaattttaaaattttaaatatttttctatggaatttgaaaataatatgtatgctctttatactacttaataatgctatccatttgttcatataataactaatcaaactgtcttaaatgttaatgaacactctttatgtttacttatttgttgtatataaaaaaagtttattttttgacagtttaatgtcacctaatattatttttaatgtttcaatttctcatttacatgaatgtttgtgttgtttattttagtcttacaggtgttatttaaactgtctgtgcaaatgccttggaatagtgcgtaacacatcgtgaattctatgtacgtgttcagggctgtttcatcacattttaatctgtcatacccttcttcatttaccgtcattttgtgtttgtccttattcaaattatgtttgtgccttgacttgactacatattcatggaagagagaaggtagactcagacttccatccggattaagcacaaagttaactaacatatcttcttagctcactttagatagaatattatatttgttttataatataaatatgaattttaagtactgcatgaagaataatcttccccatcttacaaaagaagatcatcagacattggatcattcatgaattacccaaagctgtattctctcaacaattctttttattcttacatcttaacctccatgaaaatctagaggcatgaagtactagaaattagaaacaaatttgcagaaaagcacaaattctcaaaattaatccaagaagaaagagaatatattaatatacttataacaggtaaagacattgacaagattccttcccagaaaaaaggctcagatagcttcactggtaaattctactaaacatttaatgaataattaataccaattctacacaaacacttgcaaaatgtaaaagggaaaagaaaacaattcatttgttgaggccggtattacccagtaaacgaaaccacatgaaagcataaaaaaaaaaaaatgagagaccattattcttcataagtatagacccagaattttttttttgagatggagttttgctcttgttgcctaggctgcagtgccatggccccatctcagctcactgtaccctctgcctcctgggttcaagtgattctcctgtcagcctcctgagtagctgggattacaggcacccgttactatgcccggctaatgtttggtattttttttagtagagacggggtttcaccatgttggccaggctggtctcaaactcctgacctcaggtgatccgcctgccttggcctcccaaagtgctgagattacaggcatgggccaccgcacccagcctagcagtctttaaaaactctagaaaactgaattcagcaacacataaaatgttagacaaaatgaccaagtggaattatctcactaatgcaaatatcagtcaatgtaatataccatattaatagaatagaggacaaaaccataattatttcagtagacacacaaaagcattggataaaatccattactcattaacaataaagcctccagaaatctaggaatagaaaaatctgcttaacctctcctacagggcatctataaatctttcacacattccagtaaaatataatagaggacatattggtatgtcttactttatggttttaaaaattaacaacgcataataaagataatgtatttacctagaaaacaaacacttttctaaaaacgtttctattgcatgtgataaaagtggaaattaagataaaaaagagtagtactgttgagaatgactaggatttggtatcattaattttcttattagcaattaaaatagtatcaacaattctaacaagacacaggtgcattctccccagcaaaaaggcatgatgatcacataaaatccttatgttatacataacagaaagtattttatatttgaaacatatggcaacattgtcataactacattctactaaaaatgttgcacaatacatactccaaaaaattagaactttccttggggacatatggtttttctaaagataattgtgttcattattctgataagcaattcctccaaaggtaaatgtggctatctgggattctgggaatatcctgaaaagttacatgttctaaaaatagttccattgaaaaaaaacaccataaagcctagacaatgtagcaagtgcttaactgcagagtttagttctaagtgctaaagtaaaaaaaaggggctgggcatggtggctcacacctgtaatccaagcactttgggaggctgaggtgggcagattacttgagttcaggaggtcgaaaccagcctgggcaacatgatgaaaccctgtctgcccctgaaaatacaaaaaaaaaaaaaaaaaatagccaggcgtggtggtgggtgcctgtaatcccagctactcaggaggctgaggcaggagaatcgcttgaacccgggaagtggaggttgcggtgagccgagatagtgcaaatgcactccagcctgggcaatagagtgagactccatctcaaaaaaataaaacaaagaaagaagcacaggcagcagaaagaagggaggatgagacagtccatctggcagggtgaggcttcctacaataggttgataataataggggcatcatttcttgggtttttacagctctcaggggtagatgtggtgccacactagaatcaaagtaagggagatgaacctgaccagcctaactaaagccaaaggcctcaaggttctgcaaatctaagaaaaatgagatagaatatgaagcctgcagtcaaagtgagataaatagggaagctagtcagtccgtgccttggctgatttgggaaggaaggccaactgtactgatatgttggggtttgaattgacccggagtttttatagagaaaaatttaataagttaatttaaatgttttcagattcatgtagagaagaaaacaaaaattccaagacaattttttttttttgaggaaaaaaccctcaacccaaaaaactgaaaatcttatcagttcaggcttgtcaagtataatcacacaacgtaatttttttaaatatgcaaaataaaggacacaaaaattaattttgttcaaaaataacaacaatcataaaacacttgtaccagtagacttcaaggaattccgagcagacgtacagaaaatatgtaagctaggcatggtggcgcttgcctataatcccagcattttgggaggccaaggcagtagaatcacttgaggccaggagttttaggctagcctggtcaacatagcataacgtaatttctataaaaatacaaaaataaaaatatatacatacatagttaaaatatttagataaatataagggatatgagcaaagtaaaaaataggagctaaagtataagaaaaagaatgagctaacaatgccaggtgcggtggctcacgcctgtaatcccagcactttggaaggccgaggcaagcagatcacgaggtcaggagatcgagaccatcctggctaacacgatgaaatcccatctctcctacaaacacaaaaagttagctgggcgcggtggcatgtgcctgtaatcccagctacttgggaggctgaggcaggagaattgcttgaacccgggaggtggaggttgcagtgagccaacatggcgccactgcactcaagctgggcaacagagcgagactccgtcaaacagaaaaaaaaaaacatagatgtcaggacaaggagaaaaatgagtggaaaatatgcaagtcagaataagttaaaaatgaaataagagtgctatgtctaatggtttgttgttgttgttgtttggttttggtttggtttggtttttgaggtggagtctcactctgtcgcccaggctggagtgcagtggcacgatctcggctcactgcaacgtccccctcccgggttcaagcgattctcctgcctcagcctcctgagtagctgggactacaggcgccggccaccacagcccagctcatttttgtatttttagtagagacaggtttcaccatgttggccagtctggtcttgaattcctgacatcaggtgatccacccgctttggcctccgaaagcgctaggattacaaatgtgaaccaccgcgcctggccttgtctaatgattttttgaacaaaatagggaaaatatggcatgcttaaacattttgaagaactaataaaacatcaaccaaggaaagtacaaaaaatatctaaaaacatcataataactaaaaagcttaacaccaaaatgatttaaaatcattgaaatataaaatgtgaatcaactacaaagcaacaagagatttttaacccatatttggcatcttcatagaattcacaaatcaatggatattatgttcaaagttctgagttaaaatatctgtcaattttgaattgcatccctagttaaaaattttttaagatcaaagataaaatgtaaaataattcatataagtaatacaaactaagtttacttcagttatttacttgtttaataaacttattaattacattagtcattacataaataaaatgctgcttcctattgtgaaacatataatttgtgaagcatataatgttcaaaattttgtctctaaaacaggtaacattttgaatgaagagaacaaaaatttaatgattggtataaaaataaatttcaggaaaatgaaaggtttgtatgatgacataattaacataatagaaaggacagaaatctcaatatttgtttttacacattttggagggaaagtaaccctgagatattaaagtgcagaaaataatattaattatattcttgagttttcaaacccctctttccttggtacttacagaacatccagcacaggcccaggattccctgggtgtttctgccaaggagactatccagcggaattaaagcggaaagccatgtgcacaaagatggatggatgctcacctctaagagatcagtgggtgcaggttgcagagggagttgggtgagtgcagtttttagagggagttgtgtgggtgcaggttgcagagggagttggcccttcttggaggtccagggaggggctacaggcaccatccttgaagtgggtcctggaactccactgagccctcctgcctacaggggccttagagggtcctgggggaggccagcctgggtgccctgtcctgtccgtggcccctgagtcctacctcacccgctagctttttttttttcttacagaggaatcagggtggcaaccccaatgcagccttgctagaggaaggatatcaaaagtgtcagggtgatgggaatagcattaaatctatgaattactttgggcagtgtggtcattttcacgatattgattcttcttatccataagcatggaatattttttccatttgtttgtgtcctctcttatttccttgagcagtggtttgtagttctccccgaagaggtccttcgtgtcccttgtgaattgtattcctaggtgttttattctctttgtagcaattgtaaatgggatttcattcattatttggacctctgcttgtctattattggtgtgtaggaatgcttgtgatttttgcacattgatttcatatcctgagactttgttgaagttggttatcagcccaaggagttttggggctgagacaatggggttttctaaatatacaatcttgtcgcccgcaaacagacaatttgacttcctctcttcttattcgaataccctttatttctttctcttccctcactgccctggccagaacttccaatactgtgttgaataggagtggtgaaagagggcttccttgtcttgtgccagttttcaaagggaatgcttccagcttttttgcccattcagtatgatattggctatgcgtttgtcataaatagctctcattattttgaagtatgttccctcaatacctagtttattcagggtttttagcatgaaggggtgttgaattttattgaaggccttttctgcatttattgagataatcatgtggtttttgtggttggttctgttaatgtgatggattacatttattgatttgcatatgttaaaccagccttgcatctcaggaatgaagctgacttgatcgtggtggataagctttttaatgtgccactggatttggtctgccagtattttattgaggatttttgcatcaatgttcatcagggatattggcctgaaattttctttgtttgttgtgtctctgccaggttttggaatcaggatgacactggcttgataaaatgagttagggaggagtccttctttttctgttgtttggaatagtttcagaaggaatggtactagctcctctttgtacctctggtagaattcgactctgaattggtctggtcctgcctgggctttttttttttttttttggttggtaggctattaattactccctcaatttcagaacttgttattagtctatttagagattcaacttcttccgtgtttagtctcgggaggatgtatgtgtccaggaatttatccatttcttctagattttctagcttattttcgtaaaaatatttatagtattctctgatggtagttcatatttctgtgggatcagtgttgatatcccatttatcactttttattgtgtctctttgattcttctctcttttcctttttattagtctagctagtggtctacctattttgttaatcttttcaaaaaaccagctcctggattcattgatttttttaaggcttttttcatgtctctatctcctttagttctgctctgatcttagttatttcttatcttttgctagcttttgaatttgtttgctcttgcttctctaatgcttctaattgtgatattagggcattgattttagatctttcctgctttctgatgtgagcatttagtgctataaatttccctcttaacactgctttagctaggtcctagagattttggcacattgtgtctttgttctctttggtttcaaagaacttctttatctctgccttaattttttttatttacccagtcgtcattcaggagcagattgttcagtttccatgtagttttgtagttttgagtgagtttcttaatcctgagttctaatttgattgcactgtggtctgagagactgtttgttatgatttcattctttttgcatttgctgaggaatgttttacttccaattatgtggtcaattttagaataagtgctatgtggtgctgagaaatatgtatattctgttgatttggggtggggagttatatagatgtctatttggtctgcttggtccagagctgagttcaagtcttgaatatccttgttagttttcagtctcattgctctgtctaatattgacagtggggtgttaaagtctcctactattattgtgtgggagtctaattctctctgtaggtctctaagaacttgttttatgaatctgggtgctcctgtattgggtgcatatatatttaggatagttagttcttcttgttgcgttgatccctttaccaccacataatgcccttctttgtcttttttggtctttgttggtttaaagtctgttttatcagagactaggattgcaacccctgcttttttgtgtgtgttccatttggttggtaaatattcttccatccctttattttgagcctatgtgtgtctttggatataaaatgggtgtcctgaatacagcacagtgatgagtcttgactctttgtccaatttgccagtccatgtcttttaattgggggcatttaacccatttacatttaaagttaatattgttatgcgtgaatttgatcctggcatcatgatgctagctggttatttcacacattagttgatgcagttcctcatagtgtcgctggtctttacattttggtgtgtttttgcagtggctggtaccagttttttcctttccatatttagtgcttccttcagaagctctcgtaaggcaggcctggtggtgacaaaatccctcagcatttgcttgtctggaaaggattttatttcttcttcactaattaagcttagttaggctggatatgaaattctgggttgaaaattattttctttaagaatgttgaatattggcccccactctcttctggcttgtagggtttctgcagagagatccactgttagtctgacaggcttctctttgcaggtaatctgacctttctctctggctgcccttaactttttttcctttgtttcaaccttggataatctgatgattatgtgtcttggggttgctcttctcgaggagtatcttagtggtgttctctgtatttcctgaatttgaatgttggcctgtcttgctaggttggggaagttctcctgcataacatcctgaagtgtgttttccaacttggttccattctccccatcaatgtcaggtacaccaatcaattgtacgtttggtcttttcacatagtcctatatttcttggaggctttgttccttttcattcttttttctctaatcttgtctccctaccttatttcagtaagttgatcttcaatctctgatatcctttcttccacttgatcaatttggctattgatacttgtgtatgcttcacaaagttttcatgctgtgttattcagctccatctggtcatttatgttattctctaagctggtgactctataataactgttggttattacagcagttcctgtagcctcttatcaaggttcctagcttccttgcattgggttagaacatagtcttttagctcagaagagttttgttattacccaacttctgaagcctacttctgtcaattcatcaaactcattctcctttcagttttgtgcccttgctggagaggagttgtgatcatttagaggagaagaggcatcctggtttttggaattttcagtattgttacactggtttttcctcattttgtggatttagttacctttgatctttgaggctgatgacctttggcttgggtttttgcgtgggggtcctttttgttgattttgatgttgttgctttctgtttgtgagtttttcttctaacagtcaggcccctcttctgcaggtctgctgcagtttgctggaggtccactccagaccctgtttgcctgggtgtcaccagcagaggctgcagaacagcaaagattgctgcctgctccttcttctggaagcttcgtcccagagggggcactggcctgatgccagctggggctctcctctatgaggtgtctgttgactcctgctgggaggtctctcccagtcaggaggcatggggatccgggacccacttgaggaggcagtctaagagctcgagcgctgtgctgggagaatcctccttttcaggatctgctgctgtcttcagagccagcaagcagaaatgtttaagtccactgaggctgtgcccacagctgccccttcccccaagtgctctgtcccagggagatgggagttttatctataaccccctgactggggctgctgcctttctttcagagattccctgcccagtgaggaggaatctagaatggcagtctggccacaaccgctttgctgcactctgttgagttctgctcagtccaaactttccagcctctttagcactgtcagagaaaaactgactactgaagcctcagtaatggtggacaccccttcccttaccaagctcaatcatcccaggttgacttcagactgctgtgctggcagtgagaatttcgagccagtggttcttagcttggtggcctccatgggagtgggacccgcttatcgagaccacttggcgccctggattcagtcctctttccaggggagtgaacagttctgtctcgctggggttccaggtgctactggagtatgaagaaaaaattcctgcagctatctcggtgtctgcccaaacagctgcccagttttgtgcttgaaacccaggcccctgtttgtataggcacacaagggaatctcctgctctgtggattgcaaaaactgtgggaaaagcatagtatctggaccggatagcacagtgtctcaccacttcccttggctggaggagggagttccctggctccttgcacttcccgggtgaggtgatgccccaacctgcttctgctcgccctccgtgggctgcatccactgcctaaccagtcctaatgagatgaactggatacctcagttggaaatgcagaaatcacccgctttctgcattggtcttgctgggagctgcagactggagctgttccaagcaaccccactttctctctttttgctcctcaaagtcactaaggtcttaagagctaacactgaagatcaactttgtatttgtatacatgttttattacagaaaatttaaaacatatacaaaataaaacagtataatacaactgttacccaggctcaacaacctgtgccaagtttgttttatccatacttcaatgcattttcttcccagactttattattatttttttctgaaataagatgtgtgctaattgaaggtaaaatcttggctgagcacaatggcttaagcctgtgtaattccatccttttggaatgacaagacaggaggctcacttgagcgtcagagtttaagagcagcctgggcaacatagtgagaccacatggctactaaaaataaaaaaaaaaaaaaaatgaggcatgatggtgcatgcctgtattcctagctacttgggatgctgacatagcaggatcccttgagtctggcagggtgaggctttagtgagatgtgattgggcagctacacacaagcctgggtgacagtgagactgtctcaaaaaaaaaaaaaaagaaaggtttactcttaactgtacctttttaaacatcagtacacatatataaacaatttttcttttaagaatagaagtacccaagttaataatcattaacgtgaacccatttgttactcagactttatcttttaattagtttttcttttttaaaataagatgtgagctcattgaaaggaccaatcttggccaggcatagtggcttgcatttgtaattccatccctttgggaagccagagctcacgagtttgagaccagcctgagcaacgtaacaagacctcactggggcaacgtagtgagacatcatctctacaaacattttttaaaaattacttgggcatgatggtgcacacttgtagtcccagctatttgggatgctgacatgggaggatcgctcgagcctgggaggtcaaggctgcagtgagctgtaattgcaccactacactccaccctgagtgacagattgagacgctgagaaaaaaaggtacaatcttaactgtacctgtttgacacatcaatacatccatataaacaatccctttcgtaaaaataaaagtaccccacttaacaatattgatatgcatgggaattacctatacattttttatttcttttagtttggatttttattgaaaggaaacacctagaaacattacgtaaaatctagattttgaaaaaaatagacctgaacttggtttgagaatttcaaaatagacatgagttttgtctgagaatttgtctttctaacaacatacagatcttacagcacatggtagatacaaggactcttttatctaaaataaataaaatttgacgaataaacattttaaaatttgacctgtggctaaaggatgaatcaaaacacctgtgcaatgggttatctgtagaagtatattttaatgacaaactattaataaccaaaaaagttataataatttattaactaacatgagcaaaattcctattatggtatctatgaaaatgctttcttagagtaaaatattctcttatcttgcaagggcactggttaataacagcaaagatttggaggtcaatgtctcataaagtaagtagcagacccctttcacacccatagctggccttcagagttatcgaaaaaatggtcatttacacaagagcagataattttcttaggttctattaagtttatatgttaatgttgttacaaaatttaactcagttttctcataagattatctgacaaaattttatatgttataatatcacaatatattatgtaatatcatgtaatataataaaattttgtcagatacggtgtcatatatataatttgttatttcataaaacatatacaaaaaaacaaaattttatgttatgatatcacaatgtattataccatatattatatatgattatatatcatgtattatattatgatatcacaatgtattatgatatatatcgtatgtataatacatgatattatatcacaatatattatgacatcattatatattatgtctgacatatattatgtcacagtatattatattatataatatattatattatattatattatattatattatgttgcattatatattatattatatagtccagctaattgacatggcccagcagactgcccagggcatgaactacctccatgccaagaatatcatccaaggtgatctcaagtctaataacatttttcaacacaaagatgagtgactctcgtctggccacagtgaagacagagtgaagcagggcccagcccttggagaagccttcaggttctgttttgtggatcgcagctgacctgaaccccttcagcttccagtcggacgtctatgccagtgtggctgtgctctaaaatctcacgactggctcactgccttacagccacattggcagctgtgaccagattatctttatggtgggctgtgactcttcatccctggacctcagaaaaatctccagcaactgcccgaagccatgtggtgcctgctgtctgactgcctcatgttccagcaaaaggagtggctccatttgccccagactctcaccacaatttttctgctgcaagggtcgctccccaagatggaggggaatacctctaaatcgtccttttatcaaacccaagctgatgagtttccttcctgactactcaacacaggctgtcttgagcctgaccttactcccagccactagggagccaatctgagcccgccatgccaaggagccctgcccaccaacgaatcaatgttttatctctgtcctgaagttgcatcaggatctcatatcccccaccctgttagatgagggggtcctgatgtgctttcccagttcctctaaaattggaaaactcttaaagattgagcccctgcccccctccatcattttattttttggcttagaagatacctctaaattgggggaactccttcatctctcatggctaaaatttgtagcagggatttcactcagaacctctatgggatttgtgcctgatgtgacttccactggactttggggttctcaacacatcatgtattttgggggttccctttttgtcctctcctccattcaaggactactgtcttacttcattaaaatacagagaattttgctgaaaaaaaataaagtgtttcaaataaaaccttcccaacctttgcctctggggaaaacataattttattaaattatttatgtatgtatttgacctctgctctaaaaagagacactactcacttcacacaaggctgttagttatttaaaaacatccttgaaaagattgtccaaatggaagcttatataagatgtaaaacaaattaaccaacaggtctataaaaattggctcccaacagagtacaacatacacttaaaaatacagaaatattggtacaaccattacagaaacactgtgaagctttctcaaataattaaaatagaattgccatattatccagcaatttcacttccagatatataaccaaagaaaataaaattagtatctaaaagagacacctgcccttctgtattcatagcagaattatttacaatgacagagacatgcaaacaatctaggtatccattaatagatgaacgggtaaagaaattatggaatatttatataatggaatattattcagccataaaaaagagaattctgccatttgctacaatacgaatgaacctagaggacattaggttaaatgaaataagctagacacagaatgacaaatactgtttgatttcactcatatatgaagccaaaaatgtcaaagtcatagaaacagagagtccacagtggttgctagggggtggtggctggcagaaatgaagacacggtgatcaaaacttttagatataaaataaacaagttccggtgatttagtgcacagcatggatgttcacgaatgttgtcttaggctatccctatttctgtaataaaatactttagaacaggtaatttatatagagtctaaacttacttctcacagttacagaggctgagaagtccaagaccagggcactagcagatacacataatatagtacctgctaattacattaatttgataattgcaccatatatatgtatgtaggtaggtattggagcttcacattttaaccttatattcattttatgaaaacgttgctcctgtacaactttattctgtctttccctcctagtttgggtactaatgtttaaatctacatatgttacaaacacaacagtttgtagttatctgcttacataattttatttttttaaataagctgaaataagaaaaaagagcacttgtgtatttacaggtttgttttgttaaacttcttattattcattatgttattgtaatccttcactttttctgacgtacttttttaaatctttgtagatacaagttattatctggaaagattttcttagcccaatatatcttttcttgaacccactttctctgtgctgtaattggcaaataaattaaatttctttatgttatagcactgaagatcccattacaaacaatattacacagttgcttttgacaatcagataatatgagaaaaaaatttcttatattgccttaaatatttgttacatttactagtcctctttgtcttttgggggcattaaaattatctgggattacttgcattcagcctgaaaacttatttttattctttctcaaatgatctgtctgctatcaaaaaattgcctcagcttttatttacctgaaatgtcttttttatttatttttaattgatagtttttctgaggataaaatttttagtggacattttttcatctttgagcattgaaatatgtatatattcttagaagttgaaaagcttttaagaagaaaaaaagttttgatctgagaatgttcagtgatttgaggaattcagaagggaaggaaatgctttctgatgagtgagccacaagtactctatgagtatagataatgtgcaccctacatgggtgtgattgtggatgtatggaagtttcagatacgtataacttatttgttgtaagataaaatgcttaggctacattttaaagaatttatatgagatagtccaggttaatcaggataaatgggtaaaattaaaatgataatattggtaataattttgaccgtgcaataaataatactgatgataggatatctattgctttttcagatatataaaatatgatccctcttcaccattaagacgaccatagtccacttatgacactattaaaaattgcccttttttcccaagctggtattggactcacagccaacaccttcctccttttcttctgtatctgcacactccctctggactgcaggcctaagcccactgacctcatcacctgtcacctggcccttgtccacttagtgatgctcctcactgtgagcttcttggcatctctggacctctttgagtcacagtattttcagaatgacttcaagtgtaaggtattcttctacatgcatagagggatgagggctctccatctgcaccacctgcctccggagtgtgctccaggctgtcaccattacccccggcacctcctggttggcaagaattaaacagaaattcacacattgcatctttcacttcttggggttctcagtttctttctcagtagtaacctgccttcctccactgtggcctcttctaatgtgaccgacagcaatgtgccaagtatcagtaaatactgttcactttcttacataagctacatcatcaggagtctgtctttcatgctgccactacttgcagatgtcttctttgtagcagtcatgttgctctcaagggcatacatggtaattcttttgtccaggcatcagagacaaccccagtaccttcccagcaccaacctgtctgcaaaagcctccccagagaaaagggccacctagaccattccgatgctggtgagttgctttgtgctcatgtattgggtgggcctcatcatctcatcctcctcaaccctgttatgggcttatgactcattcatcatgggtgtccagatgcttatgggcaatttctatctgttagcccttttatgctaattagttctgataatagaataatcaaaattttgcataatgtgttatataaatatcatagatgataataaattatgaaaataattatctgaaaaacagatttggacatcaaataattcaagaagcaggtgattttatatattattttattacacttttatttcatctaaatacttttgaaaactatgctgccaagaacttggtggtttctttaaagtccaccgtcatagtcccctgtgtccacaagtttcttatatttaattttgatcccttaagttttatataagacaacttttctatcttcttgaagtgtacacttaagatgctcctgttggtagataaaatttctctttgtgtgtgtgtgtgtgttttacttctgaaggttatttagtttacccttatttattaaatatatgctagctatgtattcagttactggttgaacaataatttttcagcactcttaatatttccttctcagttttctggctctgcctgggctgtggagatttcactctcacatgtgtagattctctctctctctctcatggctttgaagtttcttcattctctttggtgttatgcagtttgacttatggtgttggatatctttctttattgctttttctttttttaatttggtgacggaatcttgctctgtcacccaggctggagtcttggctcgctgcaacctccgcctctcgggttcaagggattctcctgcctcaacctccggagtagctgggatcacaggcagctgacaccatgcccggctaagttttttgtatttttttgtatttttagtagacacggggtttcacctggttggccaggttggtcttcaactcctgacctcaagtgacccgccctccttggcctcgcaaagtgctgtgattacagatgtgagccactacacccagcctctttattgcttgctttcaggcacagtgtctcttttaggcacatgtctggtttttacttttagaaatttgtaaataattatttattagtatgacttattatttgtatgaattcaagtgaaataattgtgctttattctttgtcattctattcttcacatatgtataattacattcatattactattattttgtttctctttcttttatttggttatattcgttctgctcaaaatttcagttcattaatccagttcactaattctctcatcaacgtagtctaattttataattaactcacatatcgtatattaaatttctttatgtttaaattattccatttctatttgactcttttccaaatttcctcattcagtttatagtttcctgctctttcaaaaattatttggatatcatcttttcctcaattgtttttacctaaacatttaaaatatttaaatttaatattttatattaatatgtacaaatataaatatatttataatacttttaaaatttaaaatattacaaatatatttccagtatgcaaagtttatgtgatatcaaatttcttccaaccgggccaggcacagtggctcatgcctgtattgggagggagaggcaatcccatcacttgaggccaggagttccagaccagcctggtgaacatggtgaaaccccatctctactaaaaacacaaaaattagctgggcatggtgaggcatgcctgtaaccccagctactcgggaggctgaggcaggagaatcacttgaacccggaaggcggaggttgcattgagcctagatcgggccactgcactccagcctgtataacagagcaagactctgtctcaaaaagaaaaatcttctaaccctttttcctcgtagcttattttcttctgtgcttcatactttttatttattttttattttttacaataggatccggtttattctgccttggcagggtgatcctgagagtggtgggtgtcaccctctcctgggcagagggaggggccgtgggccagtcaagccaatggtaggagaagcgctggtgaggggtggaatttggggttcaggggtgtaaccccaagaatgcagtgaaaccaggccgaggcccagaggcagctgtggtaggccagggcagggtggaaggcagtggactgggcccgggccgggatgacagggccaaggactcaggccacactggcaccccgggaggcggggcgcagtgtcgcatgacgtagaaaatgaatcacaggcccagggctcacaataagcacatggacaagtgggcacagactcacaggccagatggacctccagccacggccgggccagactcgtggacacaggcgcagtgtcacgtacagaccacggggagacatggcactaggggacaaatggacgtgacaccacaatgcacagggcaggccacagagctcgagggacgtgggcaggggccttttggcatttctgcgctggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcgtttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccggtgagtccccttgttctcgcacaatctctctaacctggtgggagactcctctgcactggaggtctgggaaggtctggccgtggatgaacttcaccttgatggtgtccatggaacatacgaccaccatggcctcggccacgccagcgccctggccgcaccgcagccagcgctgccgtcaggccgtccctgggcatcccgcgtctggctgctgtggaactggaacattcagaacccaacgccgccctggagacaagagccgcagagcagggagccgaggccgcggtgccggcccgggacgccatgaccgcgacagtgcgcacgcgggatccatgcgcggtgcccggctggtgccagcgctcgtccggctgcagctacgacctcccgcgctccgtggggagcggacgcccatttcaatgccgccggccaggccgcctgctggtgtcgccttccccggagcctccgctgggccttcccggacgcggcgcggcgtggccacggcgggcgggaggcgggcgcccgctgtgatctgaagtcccagcctcctaaactccgcactgggaccttaatttggttttaacacaaatgaagatctcactaaagataaaaagggatgtcttggcttctaatttttgttaaaagcaatagcatatgttgtataggatagtgcattggggtaaatcttttttttattatttttattttttcatcagcccactgacattgaaaggggataggttttaggttattgacgagcagttttctctcagataactgccttagtataggggtttgtggtcatgttgatgagagggtaggctggggttaaaagtcgttatggcagtaacaaccttctgaggaccaggaaattcaaatccctctcatgatactttgctaatatctcccgagtttgctgtgccttccctttgtgcctcttcccacacgtggtttcttgcacttggcccagctatattccactgttttgactccatgcttcttagcctggtggcagtggtgagggagtgaggagatctctaatgttctgaggaagcctcagacttagcactgtgaactggggtgtggggttactgaccgttgaagagtttcctgcccatcctgtacatgcaatgccaggacaagagcacattcctgtccctccttgtccatggtaggggaaacgtgctccttctccatgctcttaactcccagttgaagtgggccttgaacagtgccctgtaaattaatggtttcttttctttatgggagatgcatctgtgcagaaatgcgggtgttggccttgttccttcaccctcagttccatgagcttttccccagtgccctttggctcaggtttggatgctctttctctgcagattaggcctcatgttatataggagagatgtgagggctgtgtctccagagttgcagtagtggatgggatagtggtccctccccatcagcactgtggggtaagcatcctcaggattctaaccccatcttccctgacaggccttgtagggttcctagaaaaattatacacaacggtataaaccctacgtctgtagactccagggtttctcattctcctcacccacccacacacagccaccaggaactagttcaaaagttctggcttaattttaccagtttacatggtcttcagggtacacataaaagcctggagcctgtgtgacctgcaggctttctgcatcccctgatgttgggtttgtagtctgccctgtgacctcagttctttaaagggctcaggagaaaccatccattcatttgaagtttctccagcatttttgtttgtttgtttaatgtgtaggagcaactctttgtcaggtctctatatctacaaacttaactcagaaactaatatttttaaatatatttcttttctatcatacttttagtgctcctctacctatgctaattgttcttcagtattttttatatttgtatgtctttatctattttaaaatcaggtttaattccttcttaatcaaattaataacttttcatttatttccctacgtaactttcttttcagacgtttaaagtattgctgtgtgtttcaagtggaggaggtcatattacaactgacatttgtccttgactactggacatatcacaccagccctgattgcagttatacttgaagccagatctacccttaacgtatattcattttactattcaataaatattaacttatcatgaatggtatatattgttacagttgtaggtttatggacctgaatagacaataaaataaataaaacccaaattacatggcttcagggggggtataactttttattaagtttttagttaaaacatttttgcctttctgtgatttgcaactttgagtgattgccttgaaaaaggaaccagagttgaaactgaagtagtaggtgttggtgagattttgatggctaagagcatcgggctcattttgtaactgaaggggaaattagaacaggtcaccagttccatctgaccacaatgcagttggaataatcaccatggcaacccatgacttgtattttaggggagaagaattggaaataaaatgaccaagcataaagctgacccagtctacatggatctttgtctttaaaacatatctgcaatactcatgtaggcagtgtataaataacttgtcagaaatatcgtttatgccaaggttcttcttgaattttcaggattttgcttctccagtagtgagtgtgttactgagcaaaaggggctttctatccaaaacactagaacccaaaactgtggcactgggtttttctttttaagaaaaaaaaaaaaaagctgctccttattataatttttgtttatattataattatgtaagtataattttaattttattataaatttgctttattataatttttatttcagtatcacttacagtacaagtggtttttggttacgtggatgaattatatagcagtgaattctgagattttagtgcacctgtcacctgagtagtttatattgtaccaaataggtagttttttcatccctcatccacctcccactctctgcttctgagtctccaaagtccattacatcactctgtatgcctttgcatacgcatagcttaactcccacttataagtgaaaaataatagtattttattttccattcttgagttatttcacttaaaataatggcctcatatcccttgccctgaaattaacagccagcaggggtgtcctcagtatcaaaacaagtcgaccacacaaagccgtcaaagactccaggaacccaggtccatggggtgcagccctgcaaggtggaaaagctgaccaagtcttccttccagccaaatctggaagaaaggccccttgcctggagcagtgttcctggtacccaggcctctgtgggcatccctcagcacaaagaccctctccaaggggcatgggccggcccttccaggaccaccagcccagctccagaagcccatgggtcatccccaccctcacctgactgagctgtccctgaggctaaggcccagcagcatgaagagacttccacagaaaccagggcaataggctgctctctggcggcactgggggctcagggtctggctagcctgtccctggctcaagtcacatgcctggaaattagggttttctcctctgctcttagcatctcctgggtaaaccaataattaccctccttcatgtctcaaaattcacatccatgtaaaaggctctggtgagggtgacatttccaggaagccacagcccatgtcaaccccctgcaaagctgtgaccttgtccgcgggcaggtgaggcggcggagttctcccaaaagccggtgaactggcgctctggctggagagcgcggagggcggcagcacaatggacagcgtctgggacctcaggccagttccacagcagcctaggaaagcaggcggctcctgtgctggaggaggcgtgatgctctggagggaaaccgagctgagcagcgagaggtggggtgaggctgagacccgcccgatttaggcaaagatgaggtgcacttcgcagcgtcacactcttctcactgcccagccccgacttgccccttaagtccctctctggactcactccccttagccagggatggcacagaatcagtggccagcataggtttggaagcagagaggtccacacggcttgcgcctccctccgggactgctcaccaccccgcagcccggcgcttgctgggactgtaggccggtagccctgcgaccaacagccgaaagcggttaagaaactactcccagaatgcctggcgaggcgcgcaccacgcggccccttcctccaggcattcgcaccaccccccactcccgttgcatgctgggattgtagttgatcgcctgcgatcaacggccggaagcggctaaaactactcctgcctgcataccccgcaggagcaaaccgcgccatgtctccctccagggatccgcaccgctcacaatcctgtttagtgctgggattgtagtcctgcgagcctacgactaatagctgggtgcggataagagactacagctccccccattcccagcaaaggtccctcctccaccgagctcctccaggcttccagtgcagttccgccgtgcggagggaagcttggctgttcacaaacctctcctgcccgcgaggagacagcttggccagggcggctgatctcaccttgtcattgtgacacggtgtctccccaacgtgctggcttcatgacttgtgcccagagtttgattttccacagaccaggtagaggccaagagcctctcacagactctgcagcagggttgctatggtaacgcttgcgcccccgccccccccagcagccggctcgacaccgccctttccctctgaagggccactcgttttagccacgtcctcttattgtccctcccctggccacaccccttcagacatgcgtagtgctccccttggtccagcgcgggaagctccctcgtgagtgtccgaaactattagctcactcactgcctcatgtgaaggtacccagtctctggtaacctggcacttcccttttgaaaaccacctttttctctctctctgggctgccacgaatccccctgtactccccagatgcacctgttggaccccgggctggctgcatggcccacacctgggtcaggcctcgcacaggggcgctcctgccactataataacgatgagaaaatgtcccaggggaaaggcctgaccctgctgcatccagtcaggaaactgccacggggaagggaccacctaaactactttgcgagccacatccaccacttctttgtcccccacccaggctggttcccaggccttggggtcctagtgtagacctcccggccataactaacacaggtgcaggaccagagagcgccttggttcctcccaacacatgaggaagtttgtgtggtgaggtttggacagtgtctttgtttttgctctgaatagggtgccctggaaaaatctttacctcttattaaatactccctttggaaccacttttaagactttgccgatggaacttaacagtgatcatttattgaatccatttttctattcgcttttttagattaactcttaagtactccacaactacacgcttttgaaactggcgttggcatagcgttagttctgtgcagggcggacgcagcaggacagaatctccctgggcatcttttcggagcatcaattttactgcaaaattttgaaaaaacaaatttaattgatttccaaggtaagaaattaaaccttgaaaaatagactaaagagtcatctgcacctgacatatcagactttctgcaggaagaaaactctaaggagagcatattgtccattattataaatagtgaaaatgagaaatcatagcaagtcccttgaaaaccctgccctgccagttttctaatagggccttggtatggttttatgtgtattttcttttgaagtgtgctcatcttttgaatatacaaatttgaggttttgaccaaattttgcaagttttcagctatgagttgtttatttgctcttgtatcatatttaatttttctgtctctccctctccttctcggactcagtcattccacaggtctctaaggagcttttcattttcttcaaacttgtttcactcttcagattggatgatgatgatttctattgctgtcttctgtttctactctgtttataaactcaaaggtctttttaatttttcatttcattatctctgtatcccattctttttataattttcatttctctgtaatggagtctcgccgtgtcacccaggctggagtgcagtggctgatctcagctcactgcgccctcctcctcccaggttcaagtgattctcctgcctcagcctcccaagtagctgggactacaggcacacgctgccacactcagctaatttttgtatttctagtagagatggggtttcaccatgttggccaggatggtctcaatctactgacctcatgatccacccacctcggcctcccaaagtgctgggattacaggtatgagccaccgcccccagcgtttctggtgttttatcagaggagcaaaacctgaggtaattcagattctgctctttgttatcttctaggagttttgtgagttttcctcctatataggtctatgatccattcttagtaatttctgtgaaagttgtcaggtctgggtttagggtttttttttttcttcttttctcttgtatgtggatgtccagttgttccagtactgtttgttgaaaaagtattgtttctcaattgaatttcctttgctttttcctcaaagataagctgactatatttcatgggtcaatttatgagctttatcttttgtttgattgatctgtttctctattattttttaccagtaccgtgttttgattactgtagctttatagtagtgcttacagttgggtagtgtcattcctataactgttcttttaaaatattttcttggttattctgagtcttttacctttccatataaactttagaatcagtttgtcaatatccacaaactagctttgtggaattttgattgggattgcactgaatatgtagatctagttgggaagtactgacgttttaacaacgttgaatccctctttacttgaatgtggattatctctccatttatttagatcttctttgatgttttcacagttttgtagttttcttcatatggtttctatatttatatttattttcttatatttgtacctaaagaatttcattgttattggtgctagcataaatgtcactgaatttttaaatttcaaattctaattacattactgatatataggacagtaattgacatttgtatattaatcttatattgtgcaaagttgctataattgctcattaaaattggttattctaagattttgttttgtgatctttttgtatttctccataggcaattatatcatctgtgtaaaaagactgttttatttcttccttcccagtctatgtaccttttctattcttgtcttattgcattacctagggcttatagtataatatcatataggaatggtgagaggagacatctttgccttgctcctgatcttagcaggaaggaatctagtgtttctacattcagtatgaggttagatgcaggtttttttttttttcttgagatgtcgtctcgctctgtcaccaggctagagtgcagtggtgtgacctcagctcgttgcaacctccgcctcccgggttcaagcaattccttgcctcagcctcccaagtagctgggacaacaggcacgcaccagcatgcccggctacttttttgtattttagtagagacggggtttcaccatgttggccaggatggtctcaatctcctgacctcatgatgcacccacctcagcctcccaaagtgctgggattacaggcgtgaggcactgtgcccggccaggtgcaggtttttttaatagacattatttatgaaattgaggaagttttcctctatttctagtctgcggagagtttttctcatgaatgggttttggatattgtcaaatgatttttctgaatgtactgatgaaatcttatctttttaaaacttaatatgatgaactaattttttttaaagacagagtcttgctatgttgcccaggcttagtttgaactcctggcctcaagtgatcctccctccttggcttcctactgcattaggattacaggtataagccaccacacttagcctaatttattttcaaatgttgaaccagcctggcatgcctgtaataaatctcactgggttgcagtatataattattttttacatttttggacttgatttcttaatattttggtgaggatttttgcatctttcttcatgtgagatattgtcctgcatttttttcttgtaacgtctctgtctgaatttgacactatggtaatcctggccccattgaatagtttgaaagtattcactctgcttctgttttctggaggagattgtagagggttggaataatttctcttaaatgtttgcataaatatactagttacctcatctgggtctggtactttctatttggtaaggttacttatcattgacccaatttctttaatagatgtagtactattcaaattgtctgtttcttattgtgtgagtttgggtaggttgtttctttcaaagaatttgtctgttacatttgggttaccaaatttgtgggcaaagagtggtttataatgtttctttattattctttaattcttcatgggatcagtaatgatagatcctctttcatttctgaaattaggactgtgtcttctgtctttttcaaccaaaactaaaaaggaacgttttaaaaagtgaaagctatttttgataaactatctaatttcccatgatctgcaactgtgggtacataggaagtacatggaaacagatgtttggcagagcttgccaacaaattcttttctgcatcaagaaggcatgcctctcagcatgacactcttaagaggcagaaatgtgacaaaagaaggatgcgatctgctcctggtgaagagccacctgactctccctcagctgcacatagtggccttaacgtgcatcttgctagaaggggcatgcaagccaggggctgccagccaagccatacaggccaaggacagtttcaagtctgccttttatttcatcgaactgttgttctagtaagcagctagagttttatgaacactgtaaactctttatcatatttctttgctatttctggaggatttgttctaggagtcctcttggataccaaaatgcatggatgtataagttctttatatataatggcatagtatttacatataacctatgcatattctcctgcatactttaaatcttctctagattacttttaatacctaaattgttgttatgctgtgttgtttagggaatagtgaaaagaaaaataaaattctgtaaatgttcagtacagaaaccttattaaaatatttttgattcacatttgttgaatccaggaatgcagaaataaggagggacagctctacctatgtttggagtccatgaatgtgtcatcttgctgtgtttgtaaatagaaatttatttcacaaaatgactcaactgcttcttcactaacatgttcaaaaacttgcaagaagcagccaggcatggtggctcacacctgtaatcccagcactttgggagacccaggcaggaagatcacctgaggttgggagttcgagactagcctgaccaacatggagaagaatcgtgtctactaaaaatacaaaattagccaggcacggtggcgcatgcctgtagtctcagctacctgggaggctgaggcaggagaattgcttgaacccaagaggtggaggttgtggtgagccgagatcgcaccattgcactccagcctgggcaacaagagcaaaattccgtctcaaaaaaaaaaaaaaaaaaaaaaagagagagagagagaaaagaaaagaaaaacacttgcaagaagcaaaataagaattgagaaaggggaaagatgatgactgagagttggaaggttgcacattttcacagaaaagtagaacggaattgtaacaagcactctgataggaaatcatagtttatgtctcgcaactgtccctgaaaaaatacaatggttggcagaaaagacaagaaatgagatagactataaattaactggagaagagaaaaaataattcccagaagtaaattgtcaacgagtttgaaagcaggtaaaatgtaggtgcattatccctactctttctgaataattttacaaccttgtgcaacaggagcttctgtcactgcagaaccagggtcacctgtggaaaatccttgctgaagccatctccctgtctgcctgtccctcaggcccaggagtcatgagtcctttctccaataagtcattcagttggctggcagcaaaccctggtaagattcttcaaggcagctactttttatcttagattttaacagaaactcatgaagaaaagtcttaagacctaaactcccaagtcccttactgtatcattttgagtattaggaaatcagtcagaggtcttttcagcatctctgaaatcacaatgcaaaaatagccccagcttcataaggccgattcttggtatctctgttctgcaaagtagggtaagcaagatgccacaaaaggcaggttgaatgcagcattatcctcactccaccaacagaactatcatactttaagtaacccagcaggtctttaaaataaagaaattataaaacataaggaaaaactttcttgagaggaaaaaatttacaaatcagaggaaaatcttctagaacttttacatcttataacaaataaatcatatgctttattgttttcctctgagtacatcatcagtacttccataatacttctaatttttggcttgaaaacaccagttgcttaaaaaaacacagggacacaaaacaaaatcccagaaatgtataattattttttttaagctgacaaaggagtaacacaccactgacttctcagggaaaagctttcaagcaaagcagtcatttctggtggggattatagaagagggagttatcatggtgagatggtggaactaatccagaacaagccagatttttagtattgacaaagggatttaatcagttgcccaggaatactcactcacttggaaatcaaacttccatcattattcttggaagaatttctggaacttcccctttggaaacaaatttttatcttcaaaaataccagacaatagaagaaaagaaatgaaaaaggaggcagaggaagatgaatcttgcttaggcagggactgaaagggaattcgtggccataggccacatttttcagcgcccactgtgtgacggctttccccaggaccacacgtgtgccactgaacaagaagagtccacagggaccttcaccttattcctccccaacatcaaaaccaaaatggaacaacctaccatgagaatatgagtatatatcacaacttccattacatttaaagcatgcagagtatctaattgcaaattcaaacagtggaaaaacaaatctacttgcctcctggccacagccttactcttttaagagaatgtggtctatgctttctaatcccatcaccagggataaataaccacaggtttgtgtgacatagaaccacctccatgcagaggtaaatatgcatttattttttataaaataagaattatactctgtacttttataccatacttttagaatataacagttcttatgatcattttataattatttgaaacaacctccgtagctatataacattaaatcaaaagaacatttcataattttaccattttcctattggacattgagtttgctctcatgaagtttatatttgtgtgatgatttgggggaagtttctcggcctcactagattgaacaccttgtgatggtggtcactgttatattcttttttatttttattttttgagacagagtctttctctgttgcccaggccggagtgcagtggcatgatctcggctcactgcaacctccacctcccaggttcaagcgattctcctgtctcagcttcctgagaagctgggattacaggtgcacgccactatgcccagctaatttttgtatttttagtagagacgaggttttgccatgttgaccaggctggtcttgaactcctgacctcaggtgatccccccgcctcggcctcccaaagttctgggattacaggcgtgagccaccatgcccagccctattcttatttcattaaaatacctgaaacatatcaggtatattgcagcatctgttgaatgaatgaatgaatctctccttcaaatcttggctaaagtctgcctcatccacaaaagttcctgaccctcacttcaatcataaacctctttctcttctataatttcccatgtagctgtttgtttgtttttttttaactccctggcaggaaaaagaggaaacatgctatttattgagcactattctgagtcagggactgtggtaaatacattcaagaagaaagcatcaaaagggctatacgtcagcctagacagtgtgccccagagggtccttgactgaacatttggtgacgagcatgttgggcatgtgctctaggctgaggtgcagctcttatgccacagactgaccctggatcaattatggctcaagtcccaccctgaaatctctctttcccatttctaggtttgtcaaggaggacagaaactcagagcaccctgcacttggggatcggcactaggagctgctctctggatggggagatgggagctagcagctcacaatggggtcacaaggtaagttccaaacagctctgtcacagagagcgtcagcagatcgcaaagaaagggagcatgtgaaggagaaagccctgagtgatgtcacagctcatttctgggcaaagggagaagaaattagcaccctgaggcccttccgccttattaacccattgcacttattctcagaggctcctgccaaaaatagagacattattccacctccacctcctcaaattctaagccagaaatatgtgtgtgttatcattcaacttatatcattttttcctccttaaatgatattttcaccactaataaatttatcaaaattgtacttcacatgtgtaatacagaagaaacaaggcttccttcaacactgaattaatgaaaaacaactcaggatatttacttttcttcacaccataaattttgaagagctttttcgttatgcactgtgtgttacaacatatgtgcttaagcagtcaagcaagtatctcatatctgaattggaaagctttagagtattgacaaagaagatgtatgtatgtatgtgatgttgctggcctaagacaggccactgctactgcacacagagcaactgtatgttaacaactgctgtgctaggggcgtgtcccctgaagttagtgttgctagcatggaattgaaaatatttatgagtctcagacatggcatcacggtgtttgactattattacattagttacttttagtcactgttttattacaacattttaatgtacatttgttcacagtgtaaagaaactgaagtttttgtttgtttgttttttctttgtttctgtttttgtttttaacttttatggttgtgtgcccatgggcccccacaagaggtctctgtttgatctcatttctgtgctagtgatatttctaggagtccaataatatggggcatgttataatataccttttagaatgaagaaaaagtggttacgtatacattctcctacatcaaaaaaaggcgcaagagctggcaggtttctttgggttatgagaaacccattcctagtttgagtatgataccgtggcccattcaatgaatgtaatggaaaactgctacttttaaattgggcacagaataatagaaggcctgcaaaaagtccagagtgcaatgcaagctactttgccacttgtgccatatgactgcagatgcaatggtttttgaggtgtgactgggagataggaatgctgttgtatctttgataggttgctatacataaagcctggtgtaggtccttataattttggagcagagccttaaaaccttctgcagataattctttctttctttctttctttcttttttttctttcttttgaggcagtgtctgcctctgtcaacttggctagagttcagtggcataatcatggttcactgcagcctcaacttcctaagtgcaagcaattctccagtctcagcctcctgagactacaggtgcatgccaccacattccatggattttaaatatttttgtacatatgggggcttgctgtgtgtgcccaagctggtctcgaaatccttgcctcaagcagtcctcctgccatagcctcccaaagtggtgggattacagttgtgagccaccacaatcagccttaccttttgaaactattgtaaatggaattgtttcttcatgtcatgttgagattgttcattgctagtgtatagaatttttattaatatttttatattattttaaatcatgcaatcttaactcatttattatagtgggtatttgtgaattttcttttttcttttcctttcttttcttttttttttttttttttgagacggagtttcactcttgttgcccaagctggagtgcaatggcgtgatcttggctcactgcaacctccgcctcctgggttcaagcaattctcctgcctcagcctcccgaatagctgggattacaggcgcgcaccaccacgcctggctaattttttgtatttttagcagaaacggggtttcaccatgttagccaggctggtctcgaactcctgacttcaggtgatccccccgcctcggcctcccaaagtgctgggattataggcgtgagccaccacgcctggccgaattttctagaaagttttatatacaggatgtcatctgaataggcttccgatctttatctgaaggtcatgaatttatttttgttccatgatatttctggccaaaatctccagtatactgttaaaatagaagtggtaaaaatatattcttgtcttgtttccaaactaacgttctcaaacccaagatttcaacattatgcatgatattagctgtaggtttttaatagatgtcttatagcaggtgtaaaaattttgcttgtgtttctagtctagttagggttttttcataaacgggtctagatttgtcaaatgttctgtgtttttcagaatgatcattttgatattttattgttttattaagctgtattatattgactgatttttgaatgttaaatttgtattgtgagatacccctcttggtaatggtgtccaataattttcatttgtggctacatttattttgttattatttttgtggatttctgtgtcaatatggataagggataatagtctatagtctcgtagtgatttttcctgacttttgtctgggcaatactggcctcatggaatgaattggtaagtttcttctgttattcagttttgttttgttttgtttttttgtggggcagtcaactaaaagacctggttttaactcattattaaatatttggtcaaatttacaagtgaaactatctactgagcttttcttcatagaaaaagtttaatctctaattgttttggttctattcatatattctacttattcttgaacttactgtaataacgtatgcatattatccactaatcaatttctaatttgtagcatactatctttttatattttcattgcaataaaaagtaaagggaagaataatgtggaaagacaaagattttggcaatccatgtttccctagtgtctcagggtcctctgttgtagggaggagattattgtacttgttgtacttaatactcacatatgttcatgaagtagatgggacccatcatctaaagtaaattagagaactttgcaaaatgtaaccaaaataaaagtttgtgcctacctctcttttaatcaatatttagacgggacaggaatataaatttcaagaaaaacaaatacatatttcttggaggctttgttgatttctttttactgtttttttctctaaacttctcttcttgcttcatttcattcattttatcttcaatcactgataccctttcttccagttgatcgaattggctactgaagcttgtgcattcgtcacatagttctcgtgccatgggtttcagctccatcaggttatttaaggacttctgttaaccggttattctagttagccattcgtctaatcttttttcaaggttttcagcttctttgcaatgggttcgaacttccttctttagctcagagaagtttgatggtctgaaaacttcttctctcaacttgtcaaagtcattctccttccagctttgttctgttgctggcaaggagctgtgttcctttggagggggagaggcactctgatttttagaattttcagcttttctgctctgttttttccccatctttgtggttttatctacctttggtctttgatgatggtaatgtacagatgggattttggtgtggatgtcctttctgtttgttagttttccttctaacaatcaggaccctcagctgcaggtctgttgaagtttgctggaggtccactccagaccctgtttgcctgggtatcagcagcagaggcttcagaacagcgaatattgctgaacagcaaatgttgctgcctgattgttcctctggaagcttcatctcagaggggtacccggccatgtgaggtttcagtctgcccctactggggggtgcctcccagttaggctactcgggaggcaccctgtccgttcttgaggaggcagtctgtccgttctcagatctcaaactctgtgctgggggaaccagcactctcttcaaagctgtcagacagggacatttaagtctgcagaggtttctgctgccttttgttccataactatagttattaataatgtattgtacacttgaactttgataagaaaataaaactcaaatagtctcaccacactaggaaaaggcaactaggtgaggtgtgagggacatgttaattcgcttgattatattaataatttcacaatatataactttattagaacatatatgtaaggtgatacaacttatacaatttttatttgtcaatcatatcccaattaaaatggaaaaattaagtgtaaccaaactaatgtctagccacatgcaaattttatttagacccatttaaataaattctagattttcaatataaaatccaaactgacataatttttacagaatcaggaaaattctaatgaggaagcatgatattaaagatataattgaatagtcataatacctaatacccctacataataccataatatccctacttattaaagtaggggtaaattaaaatattttcaaaagctaaaattttgagagatttgattaccaacaggagcttaagagtaccttttaagaaaaaagaaacatttactaatatgaagttaaaatgaaaattaaagagaaaaagatttgatatgagaatatcaatttatggtagatattgaacttagcaagctataaagtccttagtaatatcagcttcaaaagtattcatatataattttaaaaggtgatcttatacacattggttaaatcagataaaaaatgagctacttgagcagtttaaataatagcagatgactatttttcagaaaacgtttttcatcaatagcttgttaaaattggtggcacatcaattacaattctgcagaatacttttttttttaatcagaactaatttgtcccagtggaataacagtggcatatgcattgagcacaagcctccggaaattcaggacaactgggtcatacacccataacaggattgaggatgttgaaataagaaggttcataggatacatgaccacaaagcaactcataacagcaggatggtctgggtggcccttttctctgaggagattcttggagagatgctggtgctgtggagctgggattgcttctgatttctgaaaaagaggatccacatgaatgcacttgagagcagcataactctgacaaggaaggcatccctggataatttcactccctgatgatgaggttcatggggaaaagtgagcagtgtttactgacattcaatagatcagtctgagtcacatttgaaaaatacacagtgaagaagattaggctgctactaaaagacaaattgaagaaccaaaaaagaagaaaaacattggtaatgtaatttgtaaatttatgtttaaaccttgccaaccatgagtttctgggactgacggtgatggcctggagcacactcaagagccaggggggacagagggagatgcctcttatcaccctttttgtgtaaaataatagcttacatttaaagccattcccaaattcagtgattcaaacacaacttgaggaaaaaaatccactgcagtaaggagcattagaatatgactgaggaccaagtggcagatgatcaagtcatggaactttggcctgggatccagaagaaatgtaaagatttgaaagaaaaaaaaaatggtattgatgaataatccaatgccaactcgaaaaataaaggcacttgttaatgataacataagtaaaaattgttttcatcttaatgacatagaagaaacatttttgtatgtctggaagaaacaatatacctcacatcatcaatgttcattctaaagtgacattatcccaatcatcattatttttattttgctcatttattcatcattaagcttatctcatatgaattcttgacaatcttcattattcatcattaaccttatctcatatgaattcttaacaatctaccttctgtgttattttgtacagtaaataatatatacattacatgttgttttggttactataactctgtagtataatttgaagtcaggtaatgtgattcccttagttttattctttttgttttatttagtttttttctaggtcttttaaggtttcatatgaattttagaatttttttcttatttctgtgaagaatgtcattggtattttgataggaattgcattgaaactgagattgctttggctagtatagacattttaacaatattgattcttctaatctataaaaagcaaattaaaaaaaaattttgtgtcctcttcaattttttaaaaatcagtgttttatagttttcattatacagatattttacttctttgattaagtacattgctaggtatttcattttatttgtggctattttttcttcagtttctaatgttactcatttctgtctcatacctcattagattggcctttaatgtccatatttttaccaacattgtcttcaaaattatttacatattttctaagaagatgaaaacttcctctgcagttgtattttcttcctgagccctcatcagaattcagcttgattacatatttttaatatgcacttccaaactctttgatgcctttatacatcattcagttccaaagctgcttacacatttaggtgtttattatatcaggaccccacttctccatatcaaaatctgtattagcatcctttagatgctatagtagaataccatagacttagtagcttaaacaataggtatttctttcttgtagctctggagactgaaaagtccaagatcaaggtgccagctgattcaattcctcagcgaactatctcttccttgcttgaagatagccaccttccctctgagttcttgcatgatagataaaaagcatgctctggctgggcatggtggctcacacctgtaatcccagcactttgggagggcgaggtgggtggatcacctgaggtcaggagtttgggactagcctggctaacatggtgaaaccctgtctctactaaaagtacaaaaatcagctgagcgtggtggtgtacacctgtaatcccagctacttgggaggctgagacaggagaatcgccaccatgtgccaccatgcctggctaacttttgtatttttagtagagatgggttttcaccatgttaggtaggctggtctcaaattcctgacctcaggtggtcctcctgcctcggcctccccaagtgctgggattacaggcaagaggcaccatgccagccagagttggttcttgattttaacatcccagttggcaaactctgcatgttgattgttgaatacttttatatttaatgtttctaaattttgttttctacatgtctcatttttttctttccttaactgctttcttttgcattaagtaaatacattttatcttacattttaatatctatatggcttttttctttgagttatttaattactgttcagactaggatttaatacatacattttaactcatcagaatctgcttcagatttctttttttactagaagcatctatttattgcacagttccaggttctttccaaataagccacagcccagtgctttattcagacatacgtactgtccagccagtttggaagaaggaaagaaaagtcaggcacaaataaagacacagaagtgttggggaagtgcactagaaaccatttatttcatttgaaatgacagaagtttgagaggagggggcaaacaaataagatctaataagttagctggatttgtcaatgataacatagtgatagtagctgattatagagtgtaccgggttggagaaagcaggaagacatataattgcaaacatttgaagtctgcagggcaggtgttgagtgtgggaactgtttgcttgagcattagagatgaaatgtgagagagatacttcaaaatgaagctaaacagtttgatctagtacccaggtaaaaaatgtattggtttgttaaaagaaatcttcactttaacacaagatagtgtttggttaagaaagtgggccacaaatatgatagtcataacaattaaggttaaagttagagctaattacacaaagatgtggctagttgttgtcacaaaatcaaaactgaatagtgtttaaaatgtggatgttctcctgctggatatgtgagatccagtgtctcttgagtagaaggaaccgaggagactgaaggttggggttgacagaacacatcaccatgggaggcatggccatttagaactccatgtctaaataagctatattgcaaagaacagtgccgatcctaaccctcggtgttgcttaaatagatggaacccttctgccctccgtaaagaaaattgatgaaataggtgggggaaataagtgttaaaatgcagcctgcattcgaattccaatgccaggtaccctggagcaaggctgtgtcacctggagaacagagcattatttctgggaatgtcagtcagaggagacttttttttctttctcaaaaaggtagttatagtccagctgggaccctaaggtcattggattacaataattgttttatttgaatggctatgggtgacacaggaggacattatgctcagtgaaaataaaccaggcacagaaaggcaaataatgtatgatctcacatatatgaaagctaaaatgttgatctcatagaaacagagaagaaaggtgatcaccagaggctatggtcggggtggaatgggtatagcaaagatgttgatcaaagggtacaggtttcagttaggctggggaaagaagttttagtgatctattgtactgaatgatgaccagagttcttaataataaattgtatatttcagaattgctaaaagaatagattgttagcaatttggttaggcgatatattaattagcttgactggatcttcctataaatcaaaatattacattgtaccacataaatatacacaattacctttgccaattaaaaaaagaaaattatcaggtgcaaggcttcctactgctataagaaacttcagtatttactatgaaaacattcttaagtcaccagagtcacactgggaagactgacatgacattctcattacttagacaggagtgttattgggagaatcctgttttgttgacaaatactgagatcatccaactcaccaggcaaagttgacttgtgtaagtgatcttcagatatgaaaagtgtggaacccagctgctcctcctcagataggtaagttcacttttccctttggtggctcctttttccaccaatctcaacatctgctcttatcctttttctacaggcgacatgacaattgtaggcctggagggagatgagttgacaacatcccttccctataaccacttgttggatctgatctcacatacacagactcactccaaagactgacctgggtgtctgcttctcagcttcattaacagtgggtgctcacaagtctaggtgagtggtgaatcgagatagaattttattagctagttgttagaattagctcctaataatttcagtctgtggttcattgaattctaactatcataagaaggtgtttccagatacaaaataattaatcttatgaagtaacaaatttatagatttgtagaaaaacatttagatttttggagatgttctacttgaatttgtatacatttgacttttctcaatataatagctgaactctcaatataattagctgaactacaactttctgcatttatgtgaagttttaatttgtaaacacagaaatctgaactaataaaattatttagtcatacttcttgcttctttaaactttgaagattgctttatataattctgatattttagaactgtttcaaattaggatgttaaaaacacaagatatgtctaacattttacagtaataagattttagcagatacccagattcttttgtttcatttcattatagtaattgccaatagagatttttttcttgtgatattaaaactatctgaaaatataatgttctgctgtttatataaatttctgttgagctaactactaccttgtataaatggggaggaggtgatactcagtgtgctttgaaatcttttcctaaagtaaattgttttagtatggtattgtttctaagtaaaccaaaactttaaaatactctgtgtattagtttgggtgaggttatttcatgatgagaacaatggtattaaaacaatggtattttcttattataaaacatcctcttggtttagtatttctgcttatacctctgaagactaccaactgcaatgtgttcaataaaacacagtccaaaatgtgacaagtaaatttggtttttaaaaacacaaataatcattgtctgtattcagcaggcatatcgtcatcaagcatgtgtgtttctttaaagtagaaaacagagaggatgaaatcaggataagtaaaacacagaaaggaacaaatgatgataaaataaatttgtggtccatgtgggcatcaaaatattaaggaacatactcagtggacaattgctatatttctgaatatgaatgaatttgtcttaaaataatttgtgttgaaagcccctgtcttccatgcatagtggagagaatgtctgagaagaggaggaccttgactgctcctgaaccggagacctcaggtacacaaggcatgccctccattttcctccaaattctccagttgaatgcaattggtatgactatgatcttctcattactgtgatgcacagatatctgatactaaaacaccacataagcattttcacataagaattgtatatttcgctggtatcttctaggttgtgttgattacaaaaacacatttccaaacaggtttatagggtttcccaaaatttataacacaagatttgtggtcaaacattttgtgtgtttttctgtctcctacttttgcttttttattctgttttctcctttccttgggaaagctgagaattaaatgtctttaagttataatttccttgtcagcagcattgtgttcctagctgttcctacactaatttcaaattccaagaaaaaatagtagctgttttatcagttactcactactgtctcatgtttattatatttattcttcaccatttatgcatttcataaaggtaatttcatggaattaatctagatggaaaggtgttttccttcctgccactgtcagctatgtttctcaggttgccaaatattgccattgggttaacaaactcaccctggccttgtcacctgaaaacttcattatgacttatgctgtccaagaacagcaataggttgtgcaatgctgttcatagaatgtgggaaaaatttacaagcaaaataatgccattaattaatacaataataaagcaaaacacatacataaaggcagagtacaaagaactgtactaaataatatgatttataagatgataaaactctaaaattatattactataaatatgagacaatatattactataaatatgagaaaatagattttatcaaattttattttctccaaaatattttttatgcataatagcacttaggatattataagtagcttcttacttttaacatgttttcctattactttggatgtctacattaaaaaacttttgtacctagtctatttgatggtgctattttctccacctttatctgtgcttatgttcctgcttttgaatttacaatattaagatagcctacagtgaagccataatactaagaacgaactttaactgcattatctgagtgctcaggagcttcacgcttaggccaacaatctggttgtcactgctaatagtaaatgctgagatgtacattcagatttatgtattttaaggcagctgttagaggcaaattctcctttatactctgaccgatatgactttcatgtttttttctattttgtttttatgatactaaccatgttatctaaatttcataattctttcatggtggggtttccagattcaccaaataacaattcaagttgtagttaagtttgaaattcagaaagatgaccgtaactttttagcataactatgaaatattttgcatacttgaatgtaatagttgtatgtgatactttggagatacatacaccgaagtagttattcattttttacctgaagtttaaatactatgtgttgtgctttattctctgaactctaattcacagaaccatggtgctctcctgtccaggctgaacactaatgctcttgagagtcacattgaagaaagccaacatttttaaatctaatggatacattcattttgtggtatgtgatgtttagaaagagggagctaaagttagtggtcatgagctaaataccctgtgaggtaagaaatgaaaatattaacattattatctatgttcttttatgtgataaattttactattttggggatatgacttgtgatagatgcagtatattagtaaaataattcatatatagttactaaatgattacacatatattagtggttcgtgcccaaatattattttactggtactggactgtgattcttaaaatgtggaaattattgtgccttaatactaatcttacacttgttcccacatagcagtagaagtcaactgtgcttagcatggttccatacgttggtagtaattatcagttatttggtttttgtattaaagataaatggattccttcagtagattaagatgtaggaaaagtgttataacaatttaacaaaatatacaatattttctttatatgttcatacatattagtcagttttagagcaatattctccaccatatatgaccttctgacttgaagccaagaacactagcagaatgtctgcattgaaaacataagtaaacattctttcatctcagggaaagtatctgaatgcctatgcacttttccattatttatttattggtgtcatcagctaaactgttctcagcattaaattgatttatatggttgaaatagtaatgcctgcatctagaaaaataacatgataatatcattgcaaacttattcagtgaaattttacaaagggttctaatgtgaaaacatcttgattaaacttcaaaaaagaatcttttccatagaagatctaaatatttttaaaggcacaggaggctatccctccattaaaatctcaagaatagcatcaccatgtaaatatttcaatacaacctcacagatgtcaaaatgtaaagaaatatggtgactgtctttccaaaaattgaaagctagattttaacaattttcttgtgagatgaaaatagtttatataatggatctctcaaatttaaagtaaattagaagatggccagaataatatttaataaaaatagtgaataagatcggtgataaacagactaatgcttttccaacggtgtccacatcctaatccccagactgcagatatattaggtcatgcagcaatgggaaataacattgcagatagaataaaggttatagtcacttaactttaaagcagggaggttatcctggattactagggtgagcttaatataatcacaagggtcctgaaatgcgaaagagaaatagagaagagaaagtgtcagagtgatgctgtcttattagtccattcaagatactataacaaaatatcatagactgagtaggttataaacaacagaaatttattattcacagtgctggaggctgagaacttcaagatcaaagtactggaagatttactgtctggtgagggcctgtatcctagttcagagatggcaccttctacatgtgtcctcacacaactggaagggcaagccagctccctagaacctcttatagaagggcgcagatcccatttatgagggcttttgttgaaaatgtcctaactacttcccaaaggtcctaccttctaataccattacactggtggtttggttttaacatacaaatttggagaaaacagaaacatgcaggctgaaattaatgtcatgttacaaagactcacttggacattctttgttttcagttgcatgttttgggggttcttttaccattagcataaaatttgcttcagctcagccatacaaacacttctgcatcatatacatgcctgtcaccattgtgtgtgctgaatattaaacagtgaaatacagaacagtaaagcaaagttttctaaagagtaaggccaagaaccgtaggagcatagaaaatgagtacattacgtagacatgatagtggatatgctggtgttttacatacactacatcatcacttaatatcatgataggttttagaaatgtgcaattttaagtgtaaaagtttgttttattccatagaaacttagtacctgttgatatctattagcctatggttaaattggtttcatgatacagtatatcattttgattaaagtcaatttttatgaacctagtgattacattaagtgatcacttatgtatatgtatacatatgttagatatgtatgtatatatgtgtgtgtgtacataggctgggcatggtggctactttctgtaattctagcactttgggaggccaaggcagaaggattacttgagcccatggacttgagaccagcctgggcaacagagtaagatcctgtccctacaaaacaaaacaaaacgattatgcacaaacacattatatatatgttacttggcataaaattaatgctgactatatatatgtgtaatgctgacatatacatttacatatagtgtctctcacacacactgaagcattgtgcaaataaatacatgtaatgccgaaggagtattttctaataatttatattacattgtaagtcttaataattgggagaaataaacataatcatagttgtgataattttaactatagaacagcactgaagatgtctaaacttgttttttcagatatacaaatatgtttcctctttgccactacaatgtacatatatatcatgtatgttattaaaaagctgctttgttttacaagttgctgttggaatctcagtcaatacttttctgttcctcttcagcatcttcactctccttctgtatcacagactaaaacccactgacttgatcatctgtcccttgcccctcgtccacatagtgaacttcttcattgcactgttattgcagtctccaaatctgtttgcatcattgaacttcagaatgacttcaagtgtaaggcacttttccacctgagcagggtgttgtggggcctctctatctgcaccacctgccccctgagtgtgttccaggccaccaccatcagccccagcacctcctgattggcaaggtttaaacataaatcttcaaattacattatccatgttttcttcttcttatggttcctcaacttgtctttcagtagtaacaggatcttctacactgtagctgcttccagtgtgagccagacaaatgtactgaatataggtaagtactgctcagttttctccatgagcttcatcctcagggccacgtttcttattctgacaacacttagggatgctttcctggtaggaatactgctgttcttaattgcatacatggtgactctcttattcaggcctcagaggtgatcccaccaccttcacagcaatggtccttccccaggagcttcccctgagaaacgggccatccagaccatactgctgctggtaagtttctctgtggtcctctgttgggtggatttcatcatctccttctcctcagcaatgttgtgggcatatggcccaatcaaccagcaagttcagagtcttgtagtcaatgtctatgccgtgatcagtcctctggtgctcctcacttcagataaaagaagaaccaatattctgaaaaatacacaacagaagtgtcatagatttaatatcaattaataataaaaataattcttggaaaaatgagttcttctgccatcagttaaatcattccagtagcagataacttactttaattaattaaaatatgtaaaagtatacttttattatatctaaataattttgaaactgatgctgccaagaacttgggtgattttttaagtttgatgtgtatgttgactgaagtcccatatgtcttagaagtttcttacatttcattttgattttgtaaagtttatacaaggaaacttttctgtcttcttgagttacatcgttaagaagctcactgttggccaggcgtggtggctcacacctgtaatcccagcactttgggaggcagaggctggtggatcacctgaggtcaggagttcaagattagcctgaccaacacagtgaagccccgtttctactaaaaatacaaaagttagccggacgtggtagcaggcacctgtaatcccagctacttgggaggcggaggcaggagaattgcttgaacccgggaggcagaggttgcagtgaggcaagattgtgccagtgcactccagcctgggtcacaaaagcaaaactccatctcaaaaaaaaaaaaaaaaaagaagaagttcttattgtttataaaagtgttttactttataaatttgtttaggctaccctcattcataaaagatattttagccaggtatccagtataagaacaataataatttttctcggcactacttctctgctctctgactctacacaggctttggacattttgctcttatatttataggtggtttcacttttctttctcacacttcttttagttttctgcttatctttagtattttatagtttgttacattgagttgtatttttatatctttttggtatagtacaattacacatttaaatatttgtatatctgatttacaactttagaaattagtaaattgttttactactgtgattcattattttatgtattctagtgaattgtttttattctatttcaatacacataattatactcatatttttatttatttttatttttatttttgagatttactgacttttttttattattatactttaagttttagggtacatgtgcacagtgtgcaggttagttacatatgtatacatgtgccatgctggtgtgctgcacccattaactcgtcattcagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgaggatgatgatttccaatttcatccatgtccctacaaaggacatgaactcatcattttttatggctgcatagtattccatggtgtatatgtgccacattttcttaatccagtctatcattgttggacatttggattggttccaagtctttgctattgtgaatagtgccgcaataaacatatgtgtgcatgtgtctttgtagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgaattatactcatatttttattaccttttgtttatctggtgatatttattcttctaaatattataattcactattatttttgtcagttcagcctaatgccaaacactgtgcattgaatttatttatttttcaattgttcaacttctttgtggttcttttccaaatatgcttgttaagtttatagtttcttgctttgccaaaatattttcattttctattttttaccatttacttcacttaagcattttaaacacattttcaatatctgaattttatgtgatgtctagtttcttctaattcttcatcttggtagcttcttttgtacttcatagtatgtgagaaattataatttaaaaataattttggttttgtatttgagagattttgtacaaaataactttagtcagtactttttttgttgtttattccaagaaggtagttgaataatccccaaagcctgaggtccctgtgatcatccagtacctggaggcggcactggcttctcactttgattactcctctgggttgttcttttaatttacttcttgtcctggaaggttccatgttttctattagctttggtgggtattttatgaattcttgtaacttctgagtattttcagatgtctgcatcaaatgagatttgtaaatacatttttgttctaaaacatcaaatattcaccatgcatctgtaagtaaaatatttcacattgatatttgttgcagaataatgtctcattggaaatctcaacattcttcatttagaacaccaccgccaatatctaccatatgccgggattattgtgcagggtaatttttattattacttgaatgtatatttatatactgcaggaactatacatgtttatggctagaattactgtttttccttaatattaagatagtattggtagatttaattatctgaatttagtcatttggctccagtcaaaatggtttctccttagcagtactctgactttgtaaaagtaatcacatttggattctgtttcctccagtagtttttaaaatgatttttttgattattcatataacttttttttaatgatcttttaaaaactagtatgtggttatatattacttgttacactttttgttttctttattttttggttggttacaccttaaatgattatttctattgccttttaatgttacttagaaaatatcacatgtaagacttttgcttttataaagttagtaatacattttcaagcctaaactcttgaaattttaataatttctatgatatttgaaaattatttttatcttcttttgagtgctaaaagataatatttgtctacctgattaactagcacaacttttaaaaagttatttagcactctttatattcattcatttgttttctacgagaaaacttctttctctgatatttgtgtgtttgttttagagatgggatctcaccctgtcacccaggctggagtgcaatggtatggtcatggctcactataacctcaaacacctgggtttaagcagtcctcccatctcaaactcccaagtagcaaggacgacaggtgcatgccaccatgtctggctaatttttaatttgtagacattgcccagcctggtttcaaactccaggcctcaagttatcctcccaccttggtttcccaaactgttggattataagtatgagccactgtgcctggcctctagaatgattttaatgtcacctaatatttttataaaggtataaattcctcacttacatgaaaatttgggttacacattaaactctttgttattaaatatatacatacaaatggcttggaattgtgcctaaaacatcatatatcctaagtattaacaactctggagctcagtacaatggctcacacctgtaattccaaacactttgagatgctgctgtgggactgcccacaggagttcaagacaaggctggaaaacatagtgagaccccatctctagaaaaaaatttaaaaattagcctggcatggtgacaagtgcctgtagccccaagctactcaggagggtgaggtgggaagatcacctgagctcagaagtttgaggttgcagtgagctataattgtgccactgcactccagtctgagcaacagagaccctgtctctaaaaaattttaaaacaactctaggccgtgtgtgttggctcatgcctgtaatcccagcactttgggaggctgaggtgggcggatcacaaggtcaacagttcaagaccagcctggcctacatagtgaaaccctgtctctactaaaaatacaaaaaattggccaggcaaggtggtgggcacctgtaatcctagctactcagcaggctgaggcaggagaatcgcttgaacccgggaggtggatgttgcagtgagccaagatcacgccactgtactaaacaactctgatatattaggtttttatcttttcatgccattcttaatttaccatgtcattttgtatatgtttttcttgaaatttatattcctgtcccgtctaaatattgattaaaagagaggtaggcacaaacttttattttggttacattttgcaaagttctctaatttactttagatgatgggtcccatctacttcatgaacatatgtgagtattaagtacaacaagtacaataatctcctccctacaacagaggaccctgagacactagggaaacatggattgccaaaatctttgtctttccacattattcttccctttactttttattgcaatgaaaatataaaaagatagtatgctacaaattagaaattgattagtggataatatgcatacgttattacagtaagttcaagaataagtagaatatatgaatagaaccaaaacaattagagattaaactttttctatgaagaaaagctcagtagatagtttcacttgtaaatttgaccaaatatttaataatgagttaaaaccaggtcttttagttgactgccccacaaaaaaacaaaacaaaacaaaactgaataacagaagaaacttaccaattcattccatgaggccagtattgcccagacaaaagtcaggaaaaatcactacgagactatagactattatcccttatccatattgacacagaaatccacaaaaataataacaaaataaatgtagccacaaatgaaaattattggacaccattaccaagaggggtatctcacaatacaaatttaacattcaaaaatcagtcaatataatacagcttaataaaacaataaaatatcaaaatgatcattctgaaaaacacagaacatttgacaaatctagacccgtttatgaaaaaaccctaactagactagaaacacaagcaaaatttttacacctgctataagacatctattaaaaacctacagctaatatcatgcataatgttgaaatcttgggtttgagaacgttagtttggaaacaagacaagaatatatttttaccacttctattttaacagtatactggagattttggccagaaatatcatggaacaaaaataaattcatgaccttcagataaagatcggaagcctattcagatgacatcctgtatataaaactttctagaaaattcggccaggcgtggtggctcacgcctataatcccagcactttgggaggccgaggcggggggatcacctgaagtcaggagttcgagaccagcctggctaacatggtgaaaccccgtttctgctaaaaatacaaaaaattagccaggcgtggtggtgcgcgcctgtaatcccagctattcgggaggctgaggcaggagaattgcttgaacccaggaggcggaggttgcagtgagccaagatcacgccattgcactccagcttgggcaacaagagtgaaactccgtctcaaaaaaaaaaaaaaaaaagaaaagaaaggaaaagaaaaaagaaaattcacaaatacccactataataaatgagttaagattgcatgatttaaaataatataaaaatattaataaaaattctatacactagcaatgaacaatctcaacatgacatgaagaaacaattccatttacaatagtttcaaaaggtaaggctgattgtggtggctcacaactgtaatcccaccactttgggaggctatggcaggaggactgcttgaggcaaggatttcgagaccagcttgggcacacacagcaagcccccatatgtacaaaaatatttaaaatccatggaatgtggtggcatgcacctgtagtctcaggaggctgagactggagaattgcttgcacttaggaagttgaggctgcagtgaaccatgattatgccactgaactctagccaagttgacagaggcagacactgcctcaaaagaaagaaaaaaaagaaagaaaaaagaaagaaagaaagaaagaattatctgcagaaggttttaaggctctgctccaaaattataaggacctacaccaggctttatgtatagcaacctatcaaagatacaacagcattcctatctcccagtcacacctcaaaaaccattgcatctgcagtcatatggcacaagtggcaaagtagcttgcattgcactctggactttttgcaggccttctattattctgtgcccaatttaaaagtagcagttttccattacattcattgaatgggccacggtatcatactcaaactaggaatgggtttctcataacccaaagaaacctgccagctcttgcgcctttttttgatgtaggagaatgtatacgtaaccactttttcttcattctaaaaggtatattataacatgccccatattattggactcctagaaatatcactagcacagaaatgagatcaaacagagacctcttgtgggggcccatgggcacacaaccataaaagttaaaaacaaaaacagaaacaaagaaaaaacaaacaaacaaaaacttcagtttctttacactgtgaacaaatgtacattaaaatgttgtaataaaacagtgactaaaagtaactaatgtaataatagtcaaacaccgtgatgccatgtctgagactcataaatattttcaattccatgctagcaacactaacttcaggggacacgcccctagcacagcagttgttaacatacagttgctctgtgtgcagtagcagtggcctgtcttaggccagcaacatcacatacatacatacatcttctttgtcaatactctaaagctttccaattcagatatgagatacttgcttgactgcttaagcacatatgttgtaacacacagtgcataacgaaaaagctcttcaaaatttatggtgtgaagaaaagtaaatatcctgagttgtttttcattaattcagtgttgaaggaagccttgtttcttctgtattacacatgtgaagtacaattttgataaatttattagtggtgaaaatatcatttaaggaggaaaaaatgatataagttgaatgataacacacacatatttctggcttagaatttgaggaggtggaggtggaataatgtctctatttttggcaggagcctctgagaataagtgcaatgggttaataaggcggaagggcctcagggtgctaatttcttctccctttgcccagaaatgagctgtgacatcactcagggctttctccttcacatgctccctttctttgcgatctgctgacgctctctgtgacagagctgtttggaacttaccttgtgaccccattgtgagctgctagctcccatctccccatccagagagcagctcctagtgccgatccccaagtgcagggtgctctgagtttctgtcctccttgacaaacctagaaatgggaaagagagatttcagggtgggacttgagccataattgatccagggtcagtctgtggcataagagctgcacctcagcctagagcacatgcccaacatgctcgtcaccaaatgttcagtcaaggaccctctggggcacactgtctaggctgacgtatagcccttttgatgctttcttcttgaatgtatttaccacagtccctgactcagaatagtgctcaataaatagcatgtttcctctttttcctgccagggagttaaaaaaaaacaaacaaacagctacatgggaaattatagaagagaaagaggtttatgattgaagtgagggtcaggaacttttgtggatgaggcagactttagccaagatttgaaggagagattcattcattcattcaacagatgctgcaatatacctgatatgtttcaggtattttaatgaaataagaatagggctgggcatggtggctcacgcctgtaatcccagaactttgggaggccgaggcggggggatcacctgaggtcaggagttcaagaccagcctggtcaacatggcaaaacctcgtctctactaaaaatacaaaaattagctgggcatagtggcgtgcacctgtaatcccagcttctcaggaagctgagacaggagaatcgcttgaacctgggaggtggaggttgcagtgagccgagatcatgccactgcactccggcctgggcaacagagaaagactctgtctcaaaaaataaaaataaaaaagaatataacagtgaccaccatcacaaggtgttcaatctagtgaggccgagaaacttcccccaaatcatcacacaaatataaacttcatgagagcaaactcaatgtccaataggaaaatggtaaaattatgaaatgttcttttgatttaatgttatatagctacggaggttgtttcaaataattataaaatgatcataagaactgttatattctaaaagtatggtataaaagtacagagtataattcttattttataaaaaataaatgcatatttacctctgcatggaggtggttctatgtcacacaaacctgtggttatttatccctggtgatgggattagaaagcatagaccacattctcttaaaagagtaaggctgtggccaggaggcaagtagatttgtttttccactgtttgaatttgcaattagatactctgcatgctttaaatgtaatggaagttgtgatatatactcatattctcatggtaggttgttccattttggttttgatgttggggaggaataaggtgaaggtccctgtggactcttcttgttcagtggcacacgtgtggtcctggggaaagccgtcacacagtgggcgctgaaaaatgtggcctatggccacgaattccctttcagtccctgcctaagcaagattcatcttcctctgcctcctttttcatttcttttcttctattgtctggtatttttgaagataaaaatttgtttccaaaggggaagttccagaaattcttccaagaataatgatggaagtttgatttccaagtgagtgagtattcctgggcaactgattaaatccctttgtcaatactaaaaatctggcttgttctggattagttccaccatctcaccatgataactccctcttctataatccccaccagaaatgactgctttgcttgaaagcttttccctgagaagtcagtggtgtgttactcctttgtcagcttaaaaaaaataattatacatttctgggattttgttttgtgtccctgtgtttttttaagcaactggtgttttcaagccaaaaattagaagtattatggaagtactgatgatgtactcagaggaaaacaataaagcatatgatttatttgttataagatgtaaaagttctagaagattttcctctgatttgtaaattttttcctctcaagaaagtttttccttatgttttataatttctttattttaaagacctgctgggttacttaaagtatgatagttctgttggtggagtgaggataatgctgcattcaacctgccttttgtggcatcttgcttaccctactttgcagaacagagataccaagaatcggccttatgaagctggggctatttttgcattgtgatttcagagatgctgaaaagacctctgactgatttcctaatactcaaaatgatacagtaagggacttgggagtttaggtcttaagacttttcttcatgagtttctgttaaaatctaagataaaaagtagctgccttgaagaatcttaccagggtttgctgccagccaactgaatgacttattggagaaaggactcatgactcctgggcctgagggacaggcagacagggagatggcttcagcaaggattttccacaggtgaccctggttctgcagtgacagaagctcctgttgcacaaggttgtaaaattattcagaaagagtagggataatgcacctacattttacctgctttcaaactcgttgacaatttacttctgggaattattttttctcttctccagttaatttatagtctatctcatttcttgtcttttctgccaaccattgtattttttcagggacagttgcgagacataaactatgatttcctatcagagtgcttgttacaattccgttctacttttctgtgaaaatgtgcaaccttccaactctcagtcatcatctttcccctttctcaattcttattttgcttcttgcaagtgtttttcttttcttttctctctctctctcttttttttttttttttttttttgagacggaattttgctcttgttgcccaggctggagtgcaatggtgcgatctcggctcaccacaacctccacctcttgggttcaagcaattctcctgcctcagcctcccaggtagctgagactacaggcatgcgccaccgtgcctggctaattttgtatttttagtagacacgattcttctccatgttggtcaggctagtctcgaactcccaacctcaggtgatcttcctgcctgggtctcccaaagtgctgggattacaggtgtgagccaccatgcctggctgcttcttgcaagtttttgaacatgttagtgaagaagcagttgagtcattttgtgaaataaatttctatttacaaacacagcaagatgacacattcatggactccaaacataggtagagctgtccctccttatttctgcattcctggattcaacaaatgtgaatcaaaaatattttaataaggtttctgtactgaacatttacagaattttatttttcttttcactattccctaaacaacacagcataacaacaatttaggtattaaaagtaatctagagaagatttaaagtatgcaggagaatatgcataggttatatgtaaatactatgccattatatataaagaacttatacatccatgcattttggtatccaagaggactcctagaacaaatcctccagaaatagcaaagaaatatgataaagagtttacagtgttcataaaactctagctgcttactagaacaacagttcgatgaaataaaaggcagacttgaaactgtccttggcctgtatggcttggctggcagcccctggcttgcatgccccttctagcaagatgcacgttaaggccactatgtgcagctgagggagagtcaggtggctcttcaccaggagcagatcgcatccttcttttgtcacatttctgcctcttaagagtgtcatgctgagaggcatgccttcttgatgcagaaaagaatttgttggcaagctctgccaaacatctgtttccatgtacttcctatgtacccacagttgcagatcatgggaaattagatagtttatcaaaaatagctttcactttttaaaacgttcctttttagttttggttgaaaaagacagaagacacagtcctaatttcagaaatgaaagaggatctatcattactgatcccatgaagaattaaagaataataaagaaacattataaaccactctttgcccacaaatttggtaacccaaatgtaacagacaaattctttgaaagaaacaacctacccaaactcacacaataagaaacagacaatttgaatagtactacatctattaaagaaattgggtcaatgataagtaaccttaccaaatagaaagtaccagacccagatgaggtaactagtatatttatgcaaacatttaagagaaattattccaaccctctacaatctcctccagaaaacagaagcagagtgaatactttcaaactattcaatggggccaggattaccatagtgtcaaattcagacagagacgttacaagaaaaaaatgcaggacaatatctcacatgaagaaagatgcaaaaatcctcaccaaaatattaagaaatcaagtccaaaaatgtaaaaaataattatatactgcaacccagtgagatttattacaggcatgccaggctggttcaacatttgaaaataaattaggctaagtgtggtggcttatacctgtaatcctaatgcagtaggaagccaaggagggaggatcacttgaggccaggagttcaaactaagcctgggcaacatagcaagactctgtctttaaaaaaaattagttcatcatattaagttttaaaaagataagatttcatcagtacattcagaaaaatcatttgacaatatccaaaacccattcatgagaaaaactctccgcagactagaaatagaggaaaacttcctcaatttcataaataatgtctattaaaaaaacctgcacctggccgggcacagtgcctcacgcctgtaatcccagcactttgggaggctgaggtgggtgcatcatgaggtcaggagattgagaccatcctggccaacatggtgaaaccccgtctctactaaaatacaaaaaagtagccgggcatgctggtgcgtgcctgttgtcccagctacttgggaggctgaggcaaggaattgcttgaacccgggaggcggaggttgcaacgagctgaggtcacaccactgcactctagcctggtgacagagcgagacgacatctcaagaaaaaaaaaaaaacctgcatctaacctcatactgaatgtagaaacactagattccttcctgctaagatcaggagcaaggcaaagatgtctcctctcaccattcctatatgatattatactataagccctaggtaatgcaataagacaagaatagaaaaggtacatagactgggaaggaagaaataaaacagtctttttacacagatgatataattgcctatggagaaatacaaaaagatcacaaaacaaaatcttagaataaccaattttaatgagcaattatagcaactttgcacaatataagattaatatacaaatgtcaattactgtcctatatatcagtaatgtaattagaatttgaaatttaaaaattcagtgacatttatgctagcaccaataacaatgaaattctttaggtacaaatataagaaaataaatataaatatagaaaccatatgaagaaaactacaaaactgtgaaaacatcaaagaagatctaaataaatggagagataatccacattcaagtaaagagggattcaacgttgttaaaacgtcagtacttcccaactagatctacatattcagtgcaatcccaatcaaaattccacaaagctagtttgtggatattgacaaactgattctaaagtttatatggaaaggtaaaagactcagaataaccaagaaaatattttaaaagaacagttataggaatgacactacccaactgtaagcactactataaagctacagtaatcaaaacacggtactggtaaaaaataatagagaaacagatcaatcaaacaaaagataaagctcataaattgacccatgaaatatagtcagcttatctttgaggaaaaagcaaaggaaattcaattgagaaacaatactttttcaacaaacagtactggaacaactggacatccacatacaagagaaaagaagaaaaaaaaaaaccctaaacccagacctgacaactttcacagaaattactaagaatggatcatagacctatataggaggaaaactcacaaaactcctagaagataacaaagagcagaatctgaattacctcaggttttgctcctctgataaaacaccagaaacgctgggggcggtggctcatacctgtaatcccagcactttgggaggccgaggtgggtggatcatgaggtcagtagattgagaccatcctggccaacatggtgaaaccccatctctactagaaatacaaaaattagctgagtgtggcagcgtgtgcctgtagtcccagctacttgggaggctgaggcaggagaatcacttgaacctgggaggaggagggcgcagtgagctgagatcagccactgcactccagcctgggtgacacggcgagactccattacagagaaatgaaaattataaaaagaatgggatacagagataatgaaatgaaaaattaaaaagacctttgagtttataaacagagtagaaacagaagacagcaatagaaatcatcatcatccaatctgaagagtgaaacaagtttgaagaaaatgaaaagctccttagagacctgtggaatgactgagtccgagaaggagagggagagacagaaaaattaaatatgatacaagagcaaataaacaactcatagctgaaaacttgcaaaatttggtcaaaacctcaaatttgtatattcaaaagatgagcacacttcaaaagaaaatacacataaaaccataccaaggccctattagaaaactggcagggcagggttttcaagggacttgctatgatttctcattttcactatttataataatggacaatatgctctccttagagttttcttcctgcagaaagtctgatatgtcaggtgcagatgactctttagtctatttttcaaggtttaatttcttaccttggaaatcaattaaatttgttttttcaaaattttgcagtaaaattgatgctccgaaaagatgcccagggagattctgtcctgctgcgtccgccctgcacagaactaacgctatgccaacgccagtttcaaaagcgtgtagttgtggagtacttaagagttaatctaaaaaagcgaatagaaaaatggattcaataaatgatcactgttaagttccatcggcaaagtcttaaaagtggttccaaagggagtatttaataagaggtaaagatttttccagggcaccctattcagagcaaaaacaaagacactgtccaaacctcaccacacaaacttcctcatgtgttgggaggaaccaaggcgctctctggtcctgcacctgtgttagttatggccgggaggtctacactaggaccccaaggcctgggaaccagcctgggtgggggacaaagaagtggtggatgtggctcgcaaagtagtttaggtggtcccttccccgtggcagtttcctgactggatgcagcagggtcaggcctttcccctgggacattttctcatcgttattatagtggcaggagcgcccctgtgcgaggcctgacccaggtgtgggccatgcagccagcccggggtccaacaggtgcatctggggagtacagggggattcgtggcagcccagagagagagaaaaaggtggttttcaaaagggaagtgccaggttaccagagactgggtaccttcacatgaggcagtgagtgagctaatagtttcggacactcacgagggagcttcccgcgctggaccaaggggagcactacgcatgtctgaaggggtgtggccaggggagggacaataagaggacgtggctaaaacgagtggcccttcagagggaaagggcggtgtcgagccggctgctggggggggcgggggcgcaagcgttaccatagcaaccctgctgcagagtctgtgagaggctcttggcctctacctggtctgtggaaaatcaaactctgggcacaagtcatgaagccagcacgttggggagacaccgtgtcacaatgacaaggtgagatcagccgccctggccaagctgtctcctcgcgggcaggagaggtttgtgaacagccaagcttccctccgcacggcggaactgcactggaagcctggaggagctcggtggaggagggacctttgctgggaatggggggagctgtagtctcttatccgcacccagctattagtcgtaggctcgcaggactacaatcccagcactaaacaggattgtgagcggtgcggatccctggagggagacatggcgcggtttgctcctgcggggtatgcaggcaggagtagttttagccgcttccggccgttgatcgcaggcgatcaactacaatcccagcatgcaacgggagtggggggtggtgcgaatgcctggaggaaggggccgcgtggtgcgcgcctcgccaggcattctgggagtagtttcttaaccgctttcggctgttggtcgcagggctaccggcctacagtcccagcaagcgccgggctgcggggtggtgagcagtcccggagggaggcgcaagccgtgtggacctctctgcttccaaacctatgctggccactgattctgtgccatccctggctaaggggagtgagtccagagagggacttaaggggcaagtcggggctgggcagtgagaagagtgtgacgctgcgaagtgcacctcatctttgcctaaatcgggcgggtctcagcctcaccccacctctcgctgctcagctcggtttccctccagagcatcacgcctcctccagcacaggagccgcctgctttcctaggctgctgtggaactggcctgaggtcccagacgctgtccattgtgctgccgccctccgcgctctccagccagagcgccagttcaccggcttttgggagaactccgccgcctcacctgcccgcggacaaggtcacagctttgcagggggttgacatgggctgtggcttcctggaaatgtcaccctcaccagagccttttacatggatgtgaattttgagacatgaaggagggtaattattggtttacccaggagatgctaagagcagaggagaaaaccctaatttccaggcatgtgacttgagccagggacaggctagccagaccctgagcccccagtgccgccagagagcagcctattgccctggtttctgtggaagtctcttcatgctgctgggccttagcctcagggacagctcagtcaggtgagggtggggatgacccatgggcttctggagctgggctggtggtcctggaagggccggcccatgccccttggagagggtctttgtgctgagggatgcccacagaggcctgggtaccaggaacactgctccaggcaaggggcctttcttccagatttggctggaaggaagacttggtcagcttttccaccttgcagggctgcaccccatggacctgggttcctggagtctttgacggctttgtgtggtcgacttgttttgatactgaggacacccctgctggctgttaatttcagggcaagggatatgaggccattattttaagtgaaataactcaagaatggaaaataaaatactattatttttcacttataagtgggagttaagctatgcgtatgcaaaggcatacagagtgatgtaatggactttggagactcagaagcagagagtgggaggtggatgagggatgaaaaaactacctatttggtacaatataaactactcaggtgacaggtgcactaaaatctcagaattcactgctatataattcatccacgtaaccaaaaaccacttgtactgtaagtgatactgaaataaaaattataataaagcaaatttataataaaattaaaattatacttacataattataatataaacaaaaattataataaggagcagcttttttttttttttcttaaaaagaaaaacccagtgccacagttttgggttctagtgttttggatagaaagccccttttgctcagtaacacactcactactggagaagcaaaatcctgaaaattcaagaagaaccttggcataaacgatatttctgacaagttatttatacactgcctacatgagtattgcagatatgttttaaagacaaagatccatgtagactgggtcagctttatgcttggtcattttatttccaattcttctcccctaaaatacaagtcatgggttgccatggtgattattccaactgcattgtggtcagatggaactggtgacctgttctaatttccccttcagttacaaaatgagcccgatgctcttagccatcaaaatctcaccaacacctactacttcagtttcaactctggttcctttttcaaggcaatcactcaaagttgcaaatcacagaaaggcaaaaatgttttaactaaaaacttaataaaaagttataccccccctgaagccatgtaatttgggttttatttattttattgtctattcaggtccataaacctacaactgtaacaatatataccattcatgataagttaatatttattgaatagtaaaatgaatatacgttaagggtagatctggcttcaagtataactgcaatcagggctggtgtgatatgtccagtagtcaaggacaaatgtcagttgtaatatgacctcctccacttgaaacacacagcaatactttaaacgtctgaaaagaaagttacgtagggaaataaatgaaaagttattaatttgattaagaaggaattaaacctgattttaaaatagataaagacatacaaatataaaaaatactgaagaacaattagcataggtagaggagcactaaaagtatgatagaaaagaaatatatttaaaaatattagtttctgagttaagtttgtagatatagagacctgacaaagagttgctcctacacattaaacaaacaaacaaaaatgctggagaaacttcaaatgaatggatggtttctcctgagccctttaaagaactgaggtcacagggcagactacaaacccaacatcaggggatgcagaaagcctgcaggtcacacaggctccaggcttttatgtgtaccctgaagaccatgtaaactggtaaaattaagccagaacttttgaactagttcctggtggctgtgtgtgggtgggtgaggagaatgagaaaccctggagtctacagacgtagggtttataccgttgtgtataatttttctaggaaccctacaaggcctgtcagggaagatggggttagaatcctgaggatgcttaccccacagtgctgatggggagggaccactatcccatccactactgcaactctggagacacagccctcacatctctcctatataacatgaggcctaatctgcagagaaagagcatccaaacctgagccaaagggcactggggaaaagctcatggaactgagggtgaaggaacaaggccaacacccgcatttctgcacagatgcatctcccataaagaaaagaaaccattaatttacagggcactgttcaaggcccacttcaactgggagttaagagcatggagaaggagcacgtttcccctaccatggacaaggagggacaggaatgtgctcttgtcctggcattgcatgtacaggatgggcaggaaactcttcaacggtcagtaaccccacaccccagttcacagtgctaagtctgaggcttcctcagaacattagagatctcctcactccctcaccactgccaccaggctaagaagcatggagtcaaaacagtggaatatagctgggccaagtgcaagaaaccacgtgtgggaagaggcacaaagggaaggcacagcaaactcgggagatattagcaaagtatcatgagagggatttgaatttcctggtcctcagaaggttgttactgccataacgacttttaaccccagcctaccctctcatcaacatgaccacaaacccctatactaaggcagttatctgagagaaaactgctcgtcaataacctaaaacctatcccctttcaatgtcagtgggctgatgaaaaaataaaaataataaaaaaaagatttaccccaatgcactatcctatacaacatatgctattgcttttaacaaaaattagaagccaagacatccctttttatctttagtgagatcttcatttgtgttaaaaccaaattaaggtcccagtgcggagtttaggaggctgggacttcagatcacagcgggcgcccgcctcccgcccgccgtggccacgccgcgccgcgtccgggaaggcccagcggaggctccggggaaggcgacaccagcaggcggcctggccggcggcattgaaatgggcgtccgctccccacggagcgcgggaggtcgtagctgcagccggacgagcgctggcaccagccgggcaccgcgcatggatcccgcgtgcgcactgtcgcggtcatggcgtcccgggccggcaccgcggcctcggctccctgctctgcggctcttgtctccagggcggcgttgggttctgaatgttccagttccacagcagccagacgcgggatgcccagggacggcctgacggcagcgctggctgcggtgcggccagggcgctggcgtggccgaggccatggtggtcgtatgttccatggacaccatcaaggtgaagttcatccacggccagaccttcccagacctccagtgcagaggagtctcccaccaggttagagagattgtgcgagaacaaggggactcaccggggcctcatggcacccacgctaaagcagggctggaaccaggccgtctgcttctcctcctgacctccctgcacagctggtaccgaggggacaaccccagcaagcccatggacccgctggtcgctggggtcttcggagccattgtgggcgcagccagtgtcttgggaaacgctcctctggatgggatcgagaccggatgcggggcctggagcagcacaaacgcggaacacaccggcctatggctgcagatcctgaggaaggaggggctcaaggacctctagaacggcactgtccccgcctggccgctggacgcgtctccctggatgtgaccagggataagggtaacagtatttatcctctaccaggaggtggagaagctgcacaacagtgtggaggatggactaagcccagaggggtaatgagggaaccccccaggcacctccagagcggccaccacccttgtctcacatgattccagcgcagaaatgccaaaaggcccctgcccacgtccctcgagctctgtggcctgccctgtgcattgtggtgtcacgtccatttgtcccctagtgccatgtctccccgtggtgtgtacgtgacactgcgcctgtgtccacgagtctggcccggccgtggctggaggtccatctggcctgtgagtctgtgcccacttgtccatgtgcttattgtgagccctgggcctgtgattcattttctacgtcatgcgacactgcgccccgcctcccggggtgccagtgtggcctgagtccttggccctgtcatcccggcccgggcccagtccactgccttccaccctgccctggcctaccacagctgcctctgggcctcggcctggtttcactgcattcttggggttacacccctgaaccccaaattccacccctcaccagcgcttctcctaccattggcttgactggcccacggcccctccctctgcccaggagagggtgacacccaccactctcaggatcaccctgccaaggcagaataaaccggatcctattgtaaaaaataaaaaataaataaaaagtatgaagcacagaagaaaataagctacgaggaaaaagggttagaagatttttctttttgagacagagtcttgctctgttatacaggctggagtgcagtggccggatctaggctcaatgcaacctccgccttccgggttcaagtgattctcctgcctcagcctcccgagtagctggggttacaggcatgcctcaccatgcccagctaatttttgtgtttttagtagagatggggtttcaccatgttcaccaggctggtctggaactcctggcctcaagtgatgggattgcctctccctcccaatacaggcatgagccactgtgcctggcccggttggaagaaatttgatatcacataaactttgcatactggaaatatatttgtaatattttaaattttaaaagtattataaatatatttatatttgtacatattaatataaaatattaaatttaaatattttaaatgtttaggtaaaaacaattgaggaaaagatgatatccaaataatttttgaaagagcaggaaactataaactgaatgaggaaatttggaaaagagtcaaatagaaatggaataatttaaacataaagaaatttaatatacgatatgtgagttaattataaaattagactacgttgatgagagaattagtgaactggattaatgaactgaaattttgagcagaacgaatataaccaaataaaagaaagagaaacaaaataatagtaatatgaatgtaattatacatatgtgaagaatagaatgacaaagaataaagcacaattatttcacttgaattcatacaaataataagtcatactaataaataattatttacaaatttctaaaagtaaaaaccagacatgtgcctaaaagagacactgtgcctgaaagcaagcaataaagaggctgggtgtagtggctcacatctgtaatcacagcactttgcgaggccaaggagggcgggtcacttgaggtcaggagttgaagaccaacctggccaaccaggtgaaaccccgtgtctactaaaaatacaaaaaaatacaaaaaacttagccgggcatggtgtcagctgcctgtgatcccagctactccggaggttgaggcaggagaatcccttgaacccgagaggcggaggttgcagcgagccaagactccagcctgggtgacagagcaagattccgtcaccaaattaaaaaaagaaaaagcaataaagaaagatatccaacaccataagtcaaactgcataacaccaaagagaatgaagaaacttcaaagccatgagagagagagagagaatctacacatgtgagagtgaaatctccacagcccaggcagagccagaaaactgagaaggaaatattaagagtgctgaaaaattattgttcaaccagtaactgaatacatagctagcatatatttaataaataagggtaaactaaataaccttcagaagtaaaacacacacacacacacaaagagaaattttatctaccaacaggagcatcttaagtgtacacttcaagaagatagaaaagttgtcttatataaaacttaagggatcaaaattaaatataagaaacttgtggacacaggggactatgacggtggactttaaagaaaccaccaagttcttggcagcatagttttcaaaagtatttagatgaaataaaagtgtaataaaataatatataaaatcacctgcttcttgaattatttgatgtccaaatctgtttttcagataattattttcataatttattatcatctatgatatttatataacacattatgcaaaattttgattattctattatcagaactaattagcataaaagggctaacagatagaaattgcccataagcatctggacacccatgatgaatgagtcataagcccataacagggttgaggaggatgagatgatgaggcccacccaatacatgagcacaaagcaactcaccagcatcggaatggtctaggtggcccttttctctggggaggcttttgcagacaggttggtgctgggaaggtactggggttgtctctgatgcctggacaaaagaattaccatgtatgcccttgagagcaacatgactgctacaaagaagacatctgcaagtagtggcagcatgaaagacagactcctgatgatgtagcttatgtaagaaagtgaacagtatttactgatacttggcacattgctgtcggtcacattagaagaggccacagtggaggaaggcaggttactactgagaaagaaactgagaaccccaagaagtgaaagatgcaatgtgtgaatttctgtttaattcttgccaaccaggaggtgccgggggtaatggtgacagcctggagcacactccggaggcaggtggtgcagatggagagccctcatccctctatgcatgtagaagaataccttacacttgaagtcattctgaaaatactgtgactcaaagaggtccagagatgccaagaagctcacagtgaggagcatcactaagtggacaagggccaggtgacaggtgatgaggtcagtgggcttaggcctgcagtccagagggagtgtgcagatacagaagaaaaggaggaaggtgttggctgtgagtccaataccagcttgggaaaaaagggcaatttttaatagtgtcataagtggactatggtcgtcttaatggtgaagagggatcatattttatatatctgaaaaagcaatagatatcctatcatcagtattatttattgcacggtcaaaattattaccaatattatcattttaattttacccatttatcctgattaacctggactatctcatataaattctttaaaatgtagcctaagcattttatcttacaacaaataagttatacgtatctgaaacttccatacatccacaatcacacccatgtagggtgcacattatctatactcatagagtacttgtggctcactcatcagaaagcatttccttcccttctgaattcctcaaatcactgaacattctcagatcaaaactttttttcttcttaaaagcttttcaacttctaagaatatatacatatttcaatgctcaaagatgaaaaaatgtccactaaaaattttatcctcagaaaaactatcaattaaaaataaataaaaaagacatttcaggtaaataaaagctgaggcaattttttgatagcagacagatcatttgagaaagaataaaaataagttttcaggctgaatgcaagtaatcccagataattttaatgcccccaaaagacaaagaggactagtaaatgtaacaaatatttaaggcaatataagaaatttttttctcatattatctgattgtcaaaagcaactgtgtaatattgtttgtaatgggatcttcagtgctataacataaagaaatttaatttatttgccaattacagcacagagaaagtgggttcaagaaaagatatattgggctaagaaaatctttccagataataacttgtatctacaaagatttaaaaaagtacgtcagaaaaagtgaaggattacaataacataatgaataataagaagtttaacaaaacaaacctgtaaatacacaagtgctcttttttcttatttcagcttatttaaaaaaataaaattatgtaagcagataactacaaactgttgtgtttgtaacatatgtagatttaaacattagtacccaaactaggagggaaagacagaataaagttgtacaggagcaacgttttcataaaatgaatataaggttaaaatgtgaagctccaatacctacctacatacatatatatggtgcaattatcaaattaatgtaattagcaggtactatattatgtgtatctgctagtgccctggtcttggacttctcagcctctgtaactgtgagaagtaagtttagactctatataaattacctgttctaaagtattttattacagaaatagggatagcctaagacaacattcgtgaacatccatgctgtgcactaaatcaccggaacttgtttattttatatctaaaagttttgatcaccgtgtcttcatttctgccagccaccaccccctagcaaccactgtggactctctgtttctatgactttgacatttttggcttcatatatgagtgaaatcaaacagtatttgtcattctgtgtctagcttatttcatttaacctaatgtcctctaggttcattcgtattgtagcaaatggcagaattctcttttttatggctgaataatattccattatataaatattccataatttctttacccgttcatctattaatggatacctagattgtttgcatgtctctgtcattgtaaataattctgctatgaatacagaagggcaggtgtctcttttagatactaattttattttctttggttatatatctggaagtgaaattgctggataatatggcaattctattttaattatttgagaaagcttcacagtgtttctgtaatggttgtaccaatatttctgtatttttaagtgtatgttgtactctgttgggagccaatttttatagacctgttggttaatttgttttacatcttatataagcttccatttggacaatcttttcaaggatgtttttaaataactaacagccttgtgtgaagtgagtagtgtctctttttagagcagaggtcaaatacatacataaataatttaataaaattatgttttccccagaggcaaaggttgggaaggttttatttgaaacactttattttttttcagcaaaattctctgtattttaatgaagtaagacagtagtccttgaatggaggagaggacaaaaagggaacccccaaaatacatgatgtgttgagaaccccaaagtccagtggaagtcacatcaggcacaaatcccatagaggttctgagtgaaatccctgctacaaattttagccatgagagatgaaggagttcccccaatttagaggtatcttctaagccaaaaaataaaatgatggaggggggcaggggctcaatctttaagagttttccaattttagaggaactgggaaagcacatcaggaccccctcatctaacagggtgggggatatgagatcctgatgcaacttcaggacagagataaaacattgattcgttggtgggcagggctccttggcatggcgggctcagattggctccctagtggctgggagtaaggtcaggctcaagacagcctgtgttgagtagtcaggaaggaaactcatcagcttgggtttgataaaaggacgatttagaggtattcccctccatcttggggagcgacccttgcagcagaaaaattgtggtgagagtctggggcaaatggagccactccttttgctggaacatgaggcagtcagacagcaggcaccacatggcttcgggcagttgctggagatttttctgaggtccagggatgaagagtcacagcccaccataaagataatctggtcacagctgccaatgtggctgtaaggcagtgagccagtcgtgagattttagagcacagccacactggcatagacgtccgactggaagctgaaggggttcaggtcagctgcgatccacaaaacagaacctgaaggcttctccaagggctgggccctgcttcactctgtcttcactgtggccagacgagagtcactcatctttgtgttgaaaaatgttattagacttgagatcgccttggatgatattcttggcatggaggtagttcatgccctgggcagtctgctgggccatgtcaattagctggactatataatataatatataatgcaacataatataatataatataatataatataatataatataatatattatataatataatatactgtgacataatatatgtcagacataatatataatgatgtcataatatattgtgatataatatcatgtattatacatacgatatatatcataatacattgtgatatcataatataatacatgatatataatcatatataatatatggtataatacattgtgatatcataacataaaattttgtttttttgtatatgttttatgaaataacaaattatatatatgacaccgtatctgacaaaattttattatattacatgatattacataatatattgtgatattataacatataaaattttgtcagataatcttatgagaaaactgagttaaattttgtaacaacattaacatataaacttaatagaacctaagaaaattatctgctcttgtgtaaatgaccattttttcgataactctgaaggccagctatgggtgtgaaaggggtctgctacttactttatgagacattgacctccaaatctttgctgttattaaccagtgcccttgcaagataagagaatattttactctaagaaagcattttcatagataccataataggaattttgctcatgttagttaataaattattataacttttttggttattaatagtttgtcattaaaatatacttctacagataacccattgcacaggtgttttgattcatcctttagccacaggtcaaattttaaaatgtttattcgtcaaattttatttattttagataaaagagtccttgtatctaccatgtgctgtaagatctgtatgttgttagaaagacaaattctcagacaaaactcatgtctattttgaaattctcaaaccaagttcaggtctatttttttcaaaatctagattttacgtaatgtttctaggtgtttcctttcaataaaaatccaaactaaaagaaataaaaaatgtataggtaattcccatgcatatcaatattgttaagtggggtacttttatttttacgaaagggattgtttatatggatgtattgatgtgtcaaacaggtacagttaagattgtacctttttttctcagcgtctcaatctgtcactcagggtggagtgtagtggtgcaattacagctcactgcagccttgacctcccaggctcgagcgatcctcccatgtcagcatcccaaatagctgggactacaagtgtgcaccatcatgcccaagtaatttttaaaaaatgtttgtagagatgatgtctcactacgttgccccagtgaggtcttgttacgttgctcaggctggtctcaaactcgtgagctctggcttcccaaagggatggaattacaaatgcaagccactatgcctggccaagattggtcctttcaatgagctcacatcttattttaaaaaagaaaaactaattaaaagataaagtctgagtaacaaatgggttcacgttaatgattattaacttgggtacttctattcttaaaagaaaaattgtttatatatgtgtactgatgtttaaaaaggtacagttaagagtaaacctttctttttttttttttttgagacagtctcactgtcacccaggcttgtgtgtagctgcccaatcacatctcactaaagcctcaccctgccagactcaagggatcctgctatgtcagcatcccaagtagctaggaatacaggcatgcaccatcatgcctcattttttttttttttttatttttagtagccatgtggtctcactatgttgcccaggctgctcttaaactctgacgctcaagtgagcctcctgtcttgtcattccaaaaggatggaattacacaggcttaagccattgtgctcagccaagattttaccttcaattagcacacatcttatttcagaaaaaaataataataaagtctgggaagaaaatgcattgaagtatggataaaacaaacttggcacaggttgttgagcctgggtaacagttgtattatactgttttattttgtatatgttttaaattttctgtaataaaacatgtatacaaatacaaagttgatcttcagtgttagctcttaagaccttagtgactttgaggagcaaaaagagagaaagtggggttgcttggaacagctccagtctgcagctcccagcaagaccaatgcagaaagcgggtgatttctgcatttccaactgaggtatccagttcatctcattaggactggttaggcagtggatgcagcccacggagggcgagcagaagcaggttggggcatcacctcacccgggaagtgcaaggagccagggaactccctcctccagccaagggaagtggtgagacactgtgctatccggtccagatactatgcttttcccacagtttttgcaatccacagagcaggagattcccttgtgtgcctatacaaacaggggcctgggtttcaagcacaaaactgggcagctgtttgggcagacaccgagatagctgcaggaattttttcttcatactccagtagcacctggaaccccagcgagacagaactgttcactcccctggaaagaggactgaatccagggcgccaagtggtctcgataagcgggtcccactcccatggaggccaccaagctaagaaccaccggctcgaaattctcactgccagcacagcagtctgaagtcaacctgggatgattgagcttggtaagggaaggggtgtccaccattactgaggcttcagtagtcagtttttctctgacagtgctaaagaggctggaaagtttggactgagcagaactcaacagagtgcagcaaagcggttgtggccagactgccattctagattcctcctcactgggcagggaatctctgaaagaaaggcagcagccccagtcagggggttatagataaaactcccatctccctgggacagagcacttgggggaaggggcagctgtgggcacagcctcagtggacttaaacatttctgcttgctggctctgaagacagcagcagatcctgaaaaggaggattctcccagcacagcgctcgagctcttagactgcctcctcaagtgggtcccggatccccatgcctcctgactgggagagacctcccagcaggagtcaacagacacctcatagaggagagccccagctggcatcaggccagtgccccctctgggacgaagcttccagaagaaggagcaggcagcaatctttgctgttctgcagcctctgctggtgacacccaggcaaacagggtctggagtggacctccagcaaactgcagcagacctgcagaagaggggcctgactgttagaagaaaaactcacaaacagaaagcaacaacatcaaaatcaacaaaaaggacccccacgcaaaaacccaagccaaaggtcatcagcctcaaagatcaaaggtaactaaatccacaaaatgaggaaaaaccagtgtaacaatactgaaaattccaaaaaccaggatgcctcttctcctctaaatgatcacaactcctctccagcaagggcacaaaactgaaaggagaatgagtttgatgaattgacagaagtaggcttcagaagttgggtaataacaaaactcttctgagctaaaagactatgttctaacccaatgcaaggaagctaggaaccttgataagaggctacaggaactgctgtaataaccaacagttattatagagtcaccagcttagagaataacataaatgaccagatggagctgaataacacagcatgaaaactttgtgaagcatacacaagtatcaatagccaaattgatcaagtggaagaaaggatatcagagattgaagatcaacttactgaaataaggtagggagacaagattagagaaaaaagaatgaaaaggaacaaagcctccaagaaatataggactatgtgaaaagaccaaacgtacaattgattggtgtacctgacattgatggggagaatggaaccaagttggaaaacacacttcaggatgttatgcaggagaacttccccaacctagcaagacaggccaacattcaaattcaggaaatacagagaacaccactaagatactcctcgagaagagcaaccccaagacacataatcatcagattatccaaggttgaaacaaaggaaaaaaagttaagggcagccagagagaaaggtcagattacctgcaaagagaagcctgtcagactaacagtggatctctctgcagaaaccctacaagccagaagagagtgggggccaatattcaacattcttaaagaaaataattttcaacccagaatttcatatccagcctaactaagcttaattagtgaagaagaaataaaatcctttccagacaagcaaatgctgagggattttgtcaccaccaggcctgccttacgagagcttctgaaggaagcactaaatatggaaaggaaaaaactggtaccagccactgcaaaaacacaccaaaatgtaaagaccagcgacactatgaggaactgcatcaactaatgtgtgaaataaccagctagcatcatgatgccaggatcaaattcacgcataacaatattaactttaaatgtaaatgggttaaatgcccccaattaaaagacatggactggcaaattggacaaagagtcaagactcatcactgtgctgtattcaggacacccattttatatccaaagacacacataggctcaaaataaagggatggaagaatatttaccaaccaaatggaacacacacaaaaaagcaggggttgcaatcctagtctctgataaaacagactttaaaccaacaaagaccaaaaaagacaaagaagggcattatgtggtggtaaagggatcaacgcaacaagaagaactaactatcctaaatatatatgcacccaatacaggagcacccagattcataaaacaagttcttagagacctacagagagaattagactcccacacaataatagtaggagactttaacaccccactgtcaatattagacagagcaatgagactgaaaactaacaaggatattcaagacttgaactcagctctggaccaagcagaccaaatagacatctatataactccccaccccaaatcaacagaatatacatatttctcagcaccacatagcacttattctaaaattgaccacataattggaagtaaaacattcctcagcaaatgcaaaaagaatgaaatcataacaaacagtctctcagaccacagtgcaatcaaattagaactcaggattaagaaactcactcaaaactacaaaactacatggaaactgaacaatctgctcctgaatgacgactgggtaaataaaaaaaattaaggcagagataaagaagttctttgaaaccaaagagaacaaagacacaatgtgccaaaatctctaggacctagctaaagcagtgttaagagggaaatttatagcactaaatgctcacatcagaaagcaggaaagatctaaaatcaatgccctaatatcacaattagaagcattagagaagcaagagcaaacaaattcaaaagctagcaaaagataagaaataactaagatcagagcagaactaaaggagatagagacatgaaaaaagccttaaaaaaatcaatgaatccaggagctggttttttgaaaagattaacaaaataggtagaccactagctagactaataaaaaggaaaagagagaagaatcaaagagacacaataaaaagtgataaatgggatatcaacactgatcccacagaaatatgaactaccatcagagaatactataaatatttttacgaaaataagctagaaaatctagaagaaatggataaattcctggacacatacatcctcccgagactaaacacggaagaagttgaatctctaaatagactaataacaagttctgaaattgagggagtaattaatagcctaccaaccaaaaaaaaaaaaaaaaagcccaggcaggaccagaccaattcagagtcgaattctaccagaggtacaaagaggagctagtaccattccttctgaaactattccaaacaacagaaaaagaaggactcctccctaactcattttatcaagccagtgtcatcctgattccaaaacctggcagagacacaacaaacaaagaaaatttcaggccaatatccctgatgaacattgatgcaaaaatcctcaataaaatactggcagaccaaatccagtggcacattaaaaagcttatccaccacgatcaagtcagcttcattcctgagatgcaaggctggtttaacatatgcaaatcaataaatgtaatccatcacattaacagaaccaaccacaaaaaccacatgattatctcaataaatgcagaaaaggccttcaataaaattcaacaccccttcatgctaaaaaccctgaataaactaggtattgagggaacatacttcaaaataatgagagctatttatgacaaacgcatagccaatatcatactgaatgggcaaaaaagctggaagcattccctttgaaaactggcacaagacaaggaagccctctttcaccactcctattcaacacagtattggaagttctggccagggcagtgagggaagagaaagaaataaagggtattcgaataagaagagaggaagtcaaattgtctgtttgcgggcgacaagattgtatatttagaaaaccccattgtctcagccccaaaactccttgggctgataaccaacttcaacaaagtctcaggatatgaaatcaatgtgcaaaaatcacaagcattcctacacaccaataatagacaagcagaggtccaaataatgaatgaaatcccatttacaattgctacaaagagaataaaacacctaggaatacaattcacaagggacacgaaggacctcttcggggagaactacaaaccactgctcaaggaaataagagaggacacaaacaaatggaaaaaatattccatgcttatggataagaagaatcaatatcgtgaaaatgaccacactgcccaaagtaattcatagatttaatgctattcccatcaccctgacacttttgatatccttcctctagcaaggctgcattggggttgccaccctgattcctctgtaagaaaaaaaaaaagctagcgggtgaggtaggactcaggggccacggacaggacagggcacccaggctggcctcccccaggaccctctaaggcccctgtaggcaggagggctcagtggagttccaggacccacttcaaggatggtgcctgtagcccctccctggacctccaagaagggccaactccctctgcaacctgcacccacacaactccctctaaaaactgcactcacccaactccctctgcaacctgcacccactgatctcttagaggtgagcatccatccatctttgtgcacatggctttccgctttaattccgctggatagtctccttggcagaaacacccagggaatcctgggcctgtgctggatgttctgtaagtaccaaggaaagaggggtttgaaaactcaagaatataattaatattattttctgcactttaatatctcagggttactttccctccaaaatgtgtaaaaacaaatattgagatttctgtcctttctattatgttaattatgtcatcatgcaaacctttcattttcctgaaatttatttttataccaatcattaaatttttgttctcttcattcaaaatgttacctgttttagagacaaaattttgaacattatatgcttcacaaattatatgtttcacaataggaagcagcattttatttatgtaatgactaatgtaattaataagtttattaaacaagtaaataactgaagtaaacttagtttgtattacttatatgaattattttacattttatctttgatcttaaaaaatttttaactagggatgcaattcaaaattgacagatattttaactcagaactttgaacataatatccattgatttgtgaattctatgaagatgccaaatatgggttaaaaatctcttgttgctttgtagttgattcacattttatatttcaatgattttaaatcattttggtgttaagctttttagttattatgatgtttttagatattttttgtactttccttggttgatgttttattagttcttcaaaatgtttaagcatgccatattttctctattttgttcaaaaaatcattagacaaggccaggcgcggtggttcacatttgtaatcctagcgctttcggaggccaaagcgggtggatcacctgatgtcaggaattcaagaccagactggccaacatggtgaaacctgtctctactaaaaatacaaaaatgagctgggctgtggtggccggcgcctgtagtcccagctactcaggaggctgaggcaggagaatcgcttgaacccgggagggggacgttgcagtgagccgagatcgtgccactgcactccagcctgggcgacagagtgagactccacctcaaaaaccaaaccaaaccaaaaccaaacaacaacaacaacaaaccattagacatagcactcttatttcatttttaacttattctgacttgcatattttccactcatttttctccttgtcctgacatctatgtttttttttttctgtttgacggagtctcgctctgttgcccagcttgagtgcagtggcgccatgttggctcactgcaacctccacctcccgggttcaagcaattctcctgcctcagcctcccaagtagctgggattacaggcacatgccaccgcgcccagctaactttttgtgtttgtaggagagatgggatttcatcgtgttagccaggatggtctcgatctcctgacctcgtgatctgcttgcctcggccttccaaagtgctgggattacaggcgtgagccaccgcacctggcattgttagctcattctttttcttatactttagctcctattttttactttgctcatatcccttatatttatctaaatattttaactatgtatgtatatatttttatttttgtatttttatagaaattacgttatgctatgttgaccaggctagcctaaaactcctggcctcaagtgattctactgccttggcctcccaaaatgctgggattataggcaagcgccaccatgcctagcttacatattttctgtacgtctgctcggaattccttgaagtctactggtacaagtgttttatgattgttgttatttttgaacaaaattaatttttgtgtcctttattttgcatatttaaaaaaattacgttgtgtgattatacttgacaagcctgaactgataagattttcagttttttgggttgagggttttttcctcaaaaaaaaaaaattgtcttggaatttttgttttcttctctacatgaatctgaaaacatttaaattaacttattaaatttttctctataaaaactccgggtcaattcaaaccccaacatatcagtacagttggccttccttcccaaatcagccaaggcacggactgactagcttccctatttatctcactttgactgcaggcttcatattctatctcatttttcttagatttgcagaaccttgaggcctttggctttagttaggctggtcaggttcatctcccttactttgattctagtgtggcaccacatctacccctgagagctgtaaaaacccaagaaatgatgcccctattattatcaacctattgtaggaagcctcaccctgccagatggactgtctcatcctcccttctttctgctgcctgtgcttctttctttgttttatttttttgagatggagtctcactctattgcccaggctggagtgcatttgcactatctcggctcaccgcaacctccacttcccgggttcaagcgattctcctgcctcagcctcctgagtagctgggattacaggcacccaccaccacgcctggctatttttttttttttttttttttgtattttcaggggcagacagggtttcatcatgttgcccaggctggtttcgacctcctgaactcaagtaatctgcccacctcagcctcccaaagtgcttggattacaggtgtgagccaccatgcccagccccttttttttactttagcacttagaactaaactctgcagttaagcacttgctacattgtctaggctttatggtgttttttttcaatggaactatttttagaacatgtaacttttcaggatattcccagaatcccagatagccacatttacctttggaggaattgcttatcagaataatgaacacaattatctttagaaaaaccatatgtccccaaggaaagttctaattttttggagtatgtattgtgcaacatttttagtagaatgtagttatgacaatgttgccatatgtttcaaatataaaatactttctgttatgtataacataaggattttatgtgatcatcatgcctttttgctggggagaatgcacctgtgtcttgttagaattgttgatactattttaattgctaataagaaaattaatgataccaaatcctagtcattctcaacagtactactcttttttatcttaatttccacttttatcacatgcaatagaaacgtttttagaaaagtgtttgttttctaggtaaatacattatctttattatgcgttgttaatttttaaaaccataaagtaagacataccaatatgtcctctattatattttactggaatgtgtgaaagatttatagatgccctgtaggagaggttaagcagatttttctattcctagatttctggaggctttattgttaatgagtaatggattttatccaatgcttttgtgtgtctactgaaataattatggttttgtcctctattctattaatatggtatattacattgactgatatttgcattagtgagataattccacttggtcattttgtctaacattttatgtgttgctgaattcagttttctagagtttttaaagactgctaggctgggtgcggtggcccatgcctgtaatctcagcactttgggaggccaaggcaggcggatcacctgaggtcaggagtttgagaccagcctggccaacatggtgaaaccccgtctctactaaaaaaaataccaaacattagccgggcatagtaacgggtgcctgtaatcccagctactcaggaggctgacaggagaatcacttgaacccaggaggcagagggtacagtgagctgagatggggccatggcactgcagcctaggcaacaagagcaaaactccatctcaaaaaaaaaattctgggtctatacttatgaagaataatggtctctcatttttttttttttatgctttcatgtggtttcgtttactgggtaataccggcctcaacaaatgaattgttttcttttcccttttacattttgcaagtgtttgtgtagaattggtattaattattcattaaatgtttagtagaatttaccagtgaagctatctgagccttttttctgggaaggaatcttgtcaatgtctttacctgttataagtatattaatatattctctttcttcttggattaattttgagaatttgtgcttttctgcaaatttgtttctaatttctagtacttcatgcctctagattttcatggaggttaagatgtaagaataaaaagaattgttgagagaatacagctttgggtaattcatgaatgatccaatgtctgatgatcttcttttgtaagatggggaagattattcttcatgcagtacttaaaattcatatttatattataaaacaaatataatattctatctaaagtgagctaagaagatatgttagttaactttgtgcttaatccggatggaagtctgagtctaccttctctcttccatgaatatgtagtcaagtcaaggcacaaacataatttgaataaggacaaacacaaaatgacggtaaatgaagaagggtatgacagattaaaatgtgatgaaacagccctgaacacgtacatagaattcacgatgtgttacgcactattccaaggcatttgcacagacagtttaaataacacctgtaagactaaaataaacaacacaaacattcatgtaaatgagaaattgaaacattaaaaataatattaggtgacattaaactgtcaaaaaataaactttttttatatacaacaaataagtaaacataaagagtgttcattaacatttaagacagtttgattagttattatatgaacaaatggatagcattattaagtagtataaagagcatacatattattttcaaattccatagaaaaatatttaaaattttaaaattttggatgcaaaattatgtcagtaacttcatgaaagtagacattcaataggtcatattttttagacattgtgaaatgacatctgaaactgtgaattagagtgtaacccataaacaacatccagccacagacaagttaaagaccaagttgaataactattaactgtataataactacataacattttcagagggctcttctttcactgcctcaagaaaaccctttacatgctcaaattgcctgcttgactttgctgcaggatttacaacacatactttaacctttcccaggcctttctcagtccctcaaagatgtaaaccttaccacgtatttgaaatgttaacatccaggtaattagcaaaacagcattgcagctgaaatcaaattgaaaaaaaaattgaaggtttttagactcaccctcaaaattttatttctcggttagtacctctagcttaggcaagaaacatttataatgatgaatttatttgttttctatcatttgtatgactctcggacttttggagtacacatttggaaccttttctaccccatggaaattttttgttcttctgttttaccgaccattgctttccatcttctgactggcctttgtgggttgatggtaaactgagaagttgagacactagaatatgtggcctgaaaatgtagattgcaccccatttgcaggaagctgtttttaataggtgttttaatcatggaaaagctacgctttttgtgctctctttggagctttagttaaagccatgcatgacttcttggatttggtctcacacatgtttatttgtgttggttttgagtcactagttcaggtacgcctttaatttaaaattttggttcatatttagagtgtgacagaaatgttttgttttgtttttttcatttaaccttctctcctgacataaataaaaccatatactgtggtttggaagatagaaaacatttactaaaaatttccgaagacaaacagctttaaatagtaattaccctagacctccagtaaacagaaatgtcccacctccaaaatttcatcttgatgtaaactttagaaagaaaaaaacaagtaatgtttgctatttacttggctaaaatttaattttaaaaaatttaagagctctacagtcaaaagtccacttataactgatattcaggctatttatgtatatattaatttgaggcctgtgggtttttttatataagcttctcagtcaactcaattcctctttccctaaactcatgctaactatgtgtgctccctctgtctcttctcttgctcacatgatttttgccaaggataatgtaaaactttactggctttttggaaacctaaatcttctcaaacggccttttctagaattaactcttctgtttacttctatctatctcatcttccttttgcgaccttttggtaccatgtgagagaacctaaaggaaacttctagcagccttggaccccttgaagaacacagataaagcaccacaggcttctccgtctttggcagggtacctctatttttcctcatggagccccaagagttgtgggtggacaggttgctctcaggtctgaagctctactcttttacaatgaactcctgcatctctagggcttttagatacatacatgtgtaagctatattttgtgtctacatgtatgtatatgtctatctacgtgtttgtatattatctacatgatatcaaattaacttaaatgaggccgaggtgggtggatcacctgaggtcaggagttcgagagcagcctagccaacatcgtgaaaccccgtctctactgaaaatacaaaaattgcccaggtgtggtggtgggaacctgtaatcccagctgctcaggaggctgaggcaggcaagtcgcttgaacccgggaggtggaggttgcagtgagcagagatagtgccactgcactccatcctgggtgtcagagtgagactccatctcaaatttatatatataatccgggagacggaggttgcagtgagccgagatggcgcactgcactccattctgggcgacagagtgagagtctgtctctaaaaataaaaaaaataaaataaaaaagagagataaactaagtggatataaaaatttggagaaagagaagagaaaaagagttataaaaggtttatagaaatcttatcttgtatggtcaaagttgattgagattagatacacctatttataaagttttcttaaaggtttatttcacaaaaacaaaagatatttagatctgtaagtaaatacatcctgttccacgttaaaagatgtttcctgctgggcgcagtggctcacggctataatcccagcactttgagaggccaaagcaggcagatcacttaaggtcaggagttcaaaaccagcctggcaaacatggtgaaaccccatctctactaaaaatacgaaaaattagttgggcatggtggcactcgcctgtgatcccagctactcgggaggctgaggtaggagaatcacttcagcccaagaggtggaggttgcagtgagccgagattgcaccactgcactcgagcctgggcaacagagcaagactccatctcaaaaaaaaaaaaaaagatgtttccatttaaaatcctacgtttctaaaaaatcataaaatatgtactcataaattgttagtatatgactaatagttaaaattgcttacttcttagaatttcactatgagttaaaattactaagaattaaaattctggttaagatataactaaaactattgttaagaagagaaacaattctacatagagtgtacaaagaaaataagatgtgtttcttggtgaaaaaatttattttaaaaaggagacatgaggatgtgattttttcttaaaaggcaattttggtgagtttagagtttatttaaaggttgcataaaattgaaagaataaaagccaaagaaaatgagataaactcgacagggcacagtggctcatgcctgtaatcctagcatttttggaggcagaggcaggtggatcatgaggccaggagtttgagaccagcctggccactatggtgaaaccccttttctactaaaaaaaaaaaaaaaaaaaaaattagccgggcgtggtggcacacgcctgtagtcccaaatactcagggggctgaagcagaagaatcgcttgaatccgggaagcagaggttgcagtgagctgagatggtgcactgcactccattctggatgacagagtgagactctgtctcaaaaaataaaaaagagagataaactaaatggatataaaaagttggagaaagagaataaaaaaagagaaaagagttaaaagagttataaaaggtttatagaagtcttatattgtcaaagttgattgagattagatacacctatttataaggtttttcttaaaattagttttaatactaatcatacaaaaatacaatcataaaatttgagtttttcttttaaaccagatttctatgaagaaacagataccctgcaaacctgttggaaggaaccatattaggttttcttggccactacctgtgctgctaagttgaagggcaatgtcttttaggatatttggtcacccctctatttatacacagctccgaagaaacccagcactggacaaattctctcaaacttttccccaagcttggccaccaatctgttttagatgaagactccatttggaggaaatctgctaattatctgcctggctttcaggaaaacagctttatgcattttactggaaaaatgcttttgccttggtgagttgttcccatgaacacatgacttaaaatatttttataaccttggaaaaaattacagatgcaactgttgtattcattgtagctcaacaaaaatgctactgattcactggctaagcttgtactagacaatcatattgctttaggttatatgctagctgagcaaagaggtgtatgcatagtggcaaatacttctttatcatatatataaaaatattccctatgaagtagaaattcatctagaaaaaaatgagttaccaactgtcacaagttctccaccctgcacaagagtgtaactggcgttttcatgaatgtttgtaattcatgtgttaatctgtaagtttcttgtagaaatgtatttatttttatgcaggcataaagagagagacattttctctatttcttttccaaggtagcattcccaaaaccaagtcctgcgactctgtctgaaatcatgctaaaacagaacagaactcagaatcttactacgctcactctgcaaaataaaagcagtacctgagaatttttaaccaatggaatatgatttttttctctcaaatctacctgtttttctcttagaaaacatttgtgtttttttatctttcaagctctaatgatgaaatacagtatatggttaatgaaaggcggaagttgaaataactgaacaaatatattcaaggtgatgaacacctggagaggcggtgctgactggaacacagacattttttttttcattattatactttaagttctagggtacatgtgcacaacatgaaggtttgttacataggtatatatgtgccatgttggtttgctgcacccatcgacacatcatttacattaggtatttctcctaatgctatccctcccccagccccccaccccctgacaggccccagtgtgtgatattccctgccctgtgtcccagtgttctcattgttcaactcccacgtgtaagtgagaacatgtggtgtttggttttctgtccttgtgatagtttgctgagaatgatggtttccagcttcatccatgtccctgcaaaggacatgaactcacccttttttatggctgcctagtactccatggtgtatatgtgccacattttctttatccagtctatcattgatggacatttggtctggtttcaagtctttgctattgtgaatagtgccacaataaacatacgtgtgcatgtgtctttagagtagcatgatttataatcctttgggtgtatatccagtaatgggattgttgggtcaaatgggatttctagttctaggtccttgaggaatcaccacactggaacacagacatattggattcatgtatcaatcacttgagagaatctcctccccacatcctgctcactaaagaacttgatcaccaccttctcagaagacaatgcacttgctccctgtgtgtctgatgtgtatttggctttgcaagttcatacactacctcaatagggtgggttttacttctacttagggatattctcctttcacaagtgtgagagaaacaagagggaaagatgcatttgcgccttttcccctcaataccagcacctgattggctgaccaccaatatgtctgcgaggaataaaagctgggtctgagggaaaaatttttttaatgtttaagcagttagctttttagaggaatggtatatcaggaaactgctctcagcatgaggacatccagctgcttctctgagaggctccacccaatatctcagactctcctctggaagctgacagaaggactgatatttactagacactccaagagacatggctcttgtgggtatcttgggtcatccccagacggttgtagtattcagaaccaggaaaaaacaggacagtggctgaggacacatcaccctgcaaaggttccaaaaagaaaccttcacccagagatattctggtaaggtgtgtgtgcctagggaaaattagacgcgcgaagacttgtcacagcagagtgtcaggtgattaccctttgcttccctgtcatgtgaaatgttcacaaacagacacatatttttagaagagccatccaccacgccgtgaaacaaaaataaacaattaaaatgctgtgtctgttttaaaactaaataaaagactaatagttgataatgttgtgatttggagaagaacggttggcatttgggaatgtgggaaaggaattggaaagttagaattttccacagggcctagaacagttaggctgggagaacagtcatggatttgagaccctgcttgccatacatttgaaaaatgcgaggaaaaccaggccctctgtggagggttaaaataattcaatagctggcacttacactgaagtggccatgctgccctgggattcttcctaaggaaacctaactacatcaaaggaatttattgtaaattactaactttgagaaaataaaattaggcttaaccaaccacaagctgccaataaagctctcattacacgaccaagacatttccacctgatgggtgcaaatgcaatatataactgtaaccaatcagatattgaatttggttttctttctgatgccctttacaaaaaccttttttacaagaccctccttggagcctccaaagaaaccataacttggtgctctctgattcataaattgctgtttgtgcaaataaactctattaatccgttcctgaattgctatgaagaaacacctcaaactcggtaattgattagaaaagatgtttaattggctcacggttctacaggctgtacagaaagcaaaacaccagcatctacctctggggaggcctcaggaagcttaaaatcatggtggaaggggaagcaggagcttgtaaagcaggcaacgggggtgctatacacttttaaatgacaagatctcctgagaactcactcactattgggaggacagtaccaggagggatggtgctaaactattcagaagaaatccgcacccacgatccgatcacctccccccaggctccaccaccaacattggggattacatttcgatgtgagatttgggcggggaaactcatccaaactctatcactgcttaacattctaaagctgtctcaatttaggccgggtcggtggctcaaacctataatcccagcactttgggaggccgaggtgggtggataacttgaggtcaggagtttgagaccagcctggccaacatggtgaaaccccgtctctactgaaaatacaaatattagtctggcgtggtggtgcacacctgtaatcccagctactcaggaggctgaggcaggagaatcgcttgaacccgggaggcagagattgcagtgagctgcgatcacaccactgcactccagcctgggtgacagagcgagaccctgtctcaaaaaaaaaaaaaaaaagaaagaaagaaagaaaagaaaagaaaaagaaacttatatttcccaagtccccatctcatctctgtcacatttgttcacgtgatgacaccacttgtagctagctatcctaagacctcagagtgattacagagagctcacttcaatttctaccccaaatttcaaatgcgtctgctatgtgtgtgtgtgtgtgtgtgtgtgtgtgtatatataaatatatatatataaatatatatataaatatatatataaatatatataaatatatatataaatacatatataaatatatatataaatatatataaatatatatataaatacatatataaatatatatataaatatatatattaatacatatataaatatatatataaatatatatatataaatatatatatatataaatatatatatataaatatatatatatataaatatatatatataaatatatatataaatatatatatataaatatatatatatataaatatatatatatatatatatatatatgtacacacacatatatttggaataggcctcatttacctctctaagaaggacaccatcatcatgtttaatctgtctccacatctgccacagtgctgactgcctgatctgatgctctggactattgcattatttttctctcacctcaattaagtgatcagaatgtggtatttaaaacctataattggatcctgtttgtcaattttggcttttgttgccattgcttttggtgttttagacatgaaggctttgccaatgcctatgtcctgaatggtagccaacccaaatgtccatcaatgatagactggataaagaaaatgtggcacatacacaccatgaaataccatgcagccataaaaaaggatgagttcatgttctttgcagggacatggatgaagaacgtgcaggtttgttgcataggtatacccgtgccatggtggtttgctgcacccatcaacccgtcatctacattaggtattcctcctaatgctatccctcccctagcccccccacccgcctgacaggccccagtgtgtgatgttcccctccctatgtccatgtgttcttattgttcagctcccacttatgagtgagaacatgcaatgtttcgttttctgttcttgtgttagtttactgagaatgacggtttccaacttcatccacgtccctgcaaaggacatgaactcattcttttttatggctgcatagtattccattgtgtatatatgccacattttcttcatccagtctatcattgatgggcatttgggttggttccaagtctttgctattgtgaacagtgcctcaataaacatacatgtgcatgtgtctttatagtagaatgatttataatcctttgggtatacacccagtaatgggattgctgggtcaaatggtatttctagttctagatccttgaggaattgccacattgtcttccacaatggttgaactaatttacactcccaccaacagtgtaaaagcattcctatttctccacgtcctctccagcatctgctgtttcctcactttttaatgatcaccagtctaactggcatgagatggtatctgattgtggttttgattgcatttatctaatggccagtaatgatgagaaatttttcatatttgttggctgcatatatgacttctttcaagaagtgtctgttcatatcctttgcccactttttgatgataattttttttttttttggagacagagtcgtgctctctcacccaggctggagtgcagtggtgtgatctcggctcactgcaaactctgctgcgtgggtttaagtgattctccttcctcagccacccaagcagctgggattacaggcacaccaccacgcccagctaatattttttatctttagtagagacagggtttcaccatcttggccaggatggtcttgagctcctgacctcgtgatccacccacctcggcctcccaaagtgctgggattacaggcatgagccactgagcccagccaacattcagtaaatttttataaataataatttaaaattcagaaattatggcttccaatcacattcctatatctttttttgtttgtttgtttgtttgtttgtttgtttgtttttgagacagagtctcactttgtcacccaggctggagtgcagtggcattatcttggctcactataacctccgtctcccgggttgaagtgattcttctgcctcggcatcccaagtagctgggactacaggtgtgcaccaccatgcctggctaatttttgtatttttagtacagacagggtttcaccatattggccaggcaggtctcgaactcctgacctcttgatccacctgcttcggcctcccaaagtgctgggattacaggtgtgagccactgcacctggccaaccacattcctatatgatctttatcataactggcataatcttcctgtagttaccaaaaggttaaaaaaaatgaaataaaacttttgacaacaatagtcaccaaattatttgttttaagttctctgaacaaatgattactaaataagtcatttcactgtgttactcaatagtatattgttatcttgattaaagaaaatagtttaacattggtggcaggataccatttcatttattgcacatcagtgtcaaaacattgaaaaccatttagtttattaattaaaactaagttcacacatagtctaagtaaggcattccaaaatccactatattcttcttggtgaaaatacagtcacaaacactgaataagcattattttttctctgatgtaattatcttagatacttcctttctccatttttaaagactaaggttaattatttaggaaacattgatttaaaacacattaaaatcctctcatggaggtgttatctttacttttctctggtatctgtaattttttaaaaaattatcacactgaatgatattcaagactttaaacttttactataatacactggtattttaatagactggccagcttttttatccttcaaggagagatgattggtaaaattatttatttcagaaattcaggatttttcactcttgctttaatagagaagaataacttccagaacacctccctcatgcagactttaagtaaaccacaaagaggatctctccttaaatttgttttttctttcttttttttttttttgagacagagtttcactcctgttgcccaggctggagtacaatgatgcaatctctgctcactgaaacttctgcctcctgggttcaagcgattctcctgactcagcctcccaagtagctgggattacaggtgcctgccaccacgtctggctaattttttgtatttttagtagagatgaggtttcactatgttggccaggctaatcttgaactcctggcctcaggtgatccacctgactcggccttccaaagttctgggattacaggcatgagccacagtgcctggcagttttatttttgtttttatttcttaattttacgtttgccatgaaggttccatggagaaattcatgtagaatggcctctcccagctctgatgcagcaacagtaggtcacatgttttcatataaacactaggaatgtagggacagggtcaactgaatggaaagttgaattacatcaataatagttgtttctaaaaaaaaaaaaagcaaataatgacaatacaaaacgagtatccattgatatataattatacctgttcaaatacaaagccgttgcttcattgaaacatacaaataaattatctaattgttttgactttagattagtctctatattagatattcttgtttaatgtaaagttttaaaattgtagtgcctttgtactttctcgtggaaattctccgatgtttatttagacttgatttttgaatacttcctcacatttattgcatctgaaaagtttccctatggaagaattccgtatgaattctggttatttctaaggtttatattttaaatcaaactccttctacatccattacgtgtatagtgtttctctagcatgaattatctgatgttgagtaaagtgtgaacaataaaggctttgccacgttttttacactgtatttaaaatagcgcatagaaagcaaatctgttttattcatcaagacaaattaataatctgttttccattttaaagaaagtgtgacggtcttttttccagctagtcgccatcagttatagagacagatcagggtccctgagtgctggaaaaggggtcctgtgcccattcagatatctaagaaggttctggttgggattcattcatttaacatagaaatattaagcacttcattttgtgtggttgcttttctagaaccttggcatatttcaatgactacagcatacagatctctgggccgcaattctgttcaaggagttagacactccttgggggaaatacaaagaccatggttgggaagaggcagaaagaaccctgggcctcatgcgtcttatgattcccatgagaaggctggggtctgggtgttctgcagaataaaaggagtcaaagagagctgcggatgggcctcaggccccctgccaaggagagaggaggctggagctcccagccagccctcgacagacccatctccattacagtcacatcccagctctgcctgtccccctctatcccacgtctaaggggcccagaactggagttataatgagcagcctgcttctcataaccctccttctgcgggtgccatagacgggcctggggggcagcatgccttccggtagtggagggcaccagttaaagatgctaagatcccctctccgccttgggcgtctcagcctgcaccattgtgctctgcctggctgtgacccctgtggccagcgcctcctcaaagctcctggagagcagcaggtgaagaaagactcagccagcacaaggcaaaggcctgggttcagcgggttgaggctttgaggaggcggaacgggcgcctgggtggaaagtggttgccaggtgtgagtggcactgtggggccagtgcccggttttgctgcccccgcttcctgaagatggcggctggagccacctgggtgcagcagttgatgtggcacctgcaggggcagaaccgacacccaaccgtggggacactgcaggaagccggcacggagacgtctatctcctctgtccccaggccctagtttctggccagctttggccaaagcaagaggttggactttggagggtgagtgtgagtgtgtgagctcatgtccagcccccgccagtgctcggcacaacaaggtgacaccctctagtgtcaccactgcccccaccctgctttcctacctggcgagctaatgggtctcccccccaggggtgctgaacgcaaggaggagggtagcgggccaatgtcccagggctgtggggcccctggctgtcaaggtcaggtggaatgtggtgggtcttcgagaagggtttgtggggtcagccggggaagggtatgcaaaccctaacctgcaggggtaccatggtacccataatgcagtgcccacagtacgcggccgggctaagcgctccgtgagccacctgctcctcacatgcgctccaggctccaggcagtaagcagagagaagtggcctggtgggcagctgccgggcacctgcaccctggggacagccaattcctagggggaccgaggcatcctcatccctagcctggcagctttgcaggaaggctgttgcctgacaagggaaaggggagggtctggggaggggcagtggcccagtcaacttgagtgatttccaagtgaatgaactggggtcccgctgcctctggctcaggcttgtggcggaatctgcctggacctcaggggctccaggctgccagctgcctgtcgaggctctaggcgcctcctccagacctcagattcctcagctgtctgagaggactgatagggcatcatatggcaggggtgtttcaggattgggccagatgatcccctgtaatctcttattaccccctccctcccctccactttccttcaccccgcctccttttttttttttttttttttttttgcctattctgagtttgtcatgagactttgtggaatgtctctggtggggaggtaggaaaggtggaaacccttacccttggcttcaggattccttccaggcaccccctcctcttaggcttttttaaagcacagacctagcaccatttcctgtacctcagagagctgcagagaacttcatgtgtttccaaaaccagaacactttgatgctgactccagacccttatctcaccccaaaacccaaatgccttgggacagccagcttcagacaggagtgaatttgatgctcattctctgggattgacccaaggcttatataatggagcacatctgcccccgtgtcttgggggagtcaacggtagtgacccagaactgtgaacaccattccccacacagagcacagggaacgcagccctctccagcaggctggcctggccgtggcctgatgcacatcagtcctgaggcaagagacccaaggcaggaaatgtctcttgtgcatcccctttcacaatgcagccatttaactgggggtggtgcctctgtgggtcctccagccttcagagtgggattgttaccctgggccaccaagggaagcggaagcacagggccagtgggtggcaaagttagagactctgtgattgggaaatatcaccttagacccagcacggcccgttcaggacatagcgcctcttgggctccatccatgggctgttctttccatggggcgctttggttgcagtcagcaccctgtggggtgggggtggagcaccaggaggagcaagtgttatgggatccacagggggaaggaggggatattccccttttgccccaccctgggcacaaaagctttgttctctgatgtgtgtgggcatcagggcctgtgtgggtatgggtggggttgcctcttttcttgaccaagaaagaaccatttctgggtctcctgggaggcttatgggcactacatgtacctgggagctgagtggagtgtgtgagggctctgcaggactctcccctgctgcctcctctccagtgggagccaggccatgtgctcttagtgccgactcacgcccaggcccacgctgcccttcactcagcaggcccctccctgactcccccagctcagctccttttgggtctcctgaggaccttgtgggccctgggatagaatcacagaagttgacagctctgctgcctgcctctgcctgaagtcagagtccctcgtgggcagggtgggtgggcaggtcagggctcagcttttggctgagtacagggtccttttttcatgccacactgatggaaacactgggcagggctggcctgggggctgctctgtggctcccctggtctgtcactggaccaggttgaaggcagtatttgtgcagatggcttcacctgttgtcaccatccagacactagaaccaactggctgttgctcttgggccagggtcttgggctgaggctgtcatgaccagcatgttctctgccatgtgggggcctcaggcagctcccagtgctgagtggtccccaaaagacatgatagccagtactggaaggctggaagtcaggacaggagtacatctgactctggggcttccagaaagctggccctgagctgtggcccctgcaaaagacaggctcctccgagatcataccactgcactccagcgtgggtgacagagcaagactccgtctcgataaatagataaataaaaaagacaggctcttgtggatatttcaggggaaaaaagtgagtccttctggctggcaggattcttgtgatcactgggcaggtagggctggcttaggtaggtcaggcacaattgggcctggcagaggagccagggaatggtgtggccagaatggacagctggacctttgaatctaggccatacataggcagaataacaagtgatggtgcagccagctcaggcaggtctaggtcagggcacctgccaggtaggaacatgcacccctgccccagactccaatcccagaccacctgcctgcactgggcattgtctggtctcggcagaaaggcctgggggtgatgatcaggtggtgtgtccctgggtctcaggcctcagtggctccctaggaactgggcagtcactgggcaccggcaggggcccagggaccacttgtgtgcatctgcccatgggttgtgttcccaccccagcttctcagccctcactgggagaggccagggctccctgcctgctctgtttccagctctgacccctcacctggtgactctgatgacttcctcactccagcctgggtcctcctctgttagacacgggtcccaggcttcctgcagacagaaaccaaccaccagccacaccttgtgggcccacctggacctcgttaccccactgaccagtgagacccaactggccagtactggtgtcctatttgtatactgcccttttacccggtgtgttttctgtaatgactgctgtgtggagcgtccatataagtgcagaatacagcatgtcctctatcccacagagcccccaccatggtccccctggggatggtcatgccttgctcaacttggtgtaaatggctgctgttggccgggtgcagtggctcacacctgtaatcctagcacttgggaggccaaggcgagtggatcacctgtggtcgggagttcaagaccagcctggccaacatggcaaaacctcatctctactaaaaatataaaaattaggctgggtgcagtggctcatgcctataaacccagcactttgggaggccaaagcaggcggagcacgaggtcgggagcttgagaccagtctggccaatatggtgaaaccctgtctctcctaaaattacaaaattagccaggcatggtggtgcacccctgtaatcccagctactcaggaggctgaggcaggagaattgcttgagcccggcaggtggaggttgcaatgagccgagatcaccccactgcactccagcctgggcgacagagcaagactctgtctcaaaaaataaaaaataaataaaaaataaaaaacaatggctgtggtagcatgcactgttgagcgccatccatccacatggctgcccaaccctgcatctccttccttttcgttgctgaggtcttttctgttcccctgctcttcacctgaactgctcttgaagccaagatgagggataagtagggtggtgctggcagggacccctcctggggtaaatctcagctgtgagggggctgggctcaccccctcctgtcatctcctcctctgagcttcatttctgccagaggtcatcaaggtgcagcctgtccctgcctgctttcctgtctcccatgagccaaggatgaattttacatttccaaatggtcgaacaaaccaaaagaagaatcatacttgatgttttgaaattggagttttcagtgcctgtaaggaaagttctatgagattgcagccatgcaccttcattcccaggttgtctgcgggaggctgctgtcacgctgcaactgcagatttgagtcattgcaattgacatgggttggcaaagctgcaaatactgaaccctagccattttgaggaagagtttttagacgctggtttgagaattctctggtgggactccaggctctgggtcagagtcttccccactcagggctgctttgaccttcactggggtgtctgccaagtgggggtgccatttgcctgttgtgcaggtgttaagccccagagcatcaaatattggggtgcctgcctcatgctcacccacatcacctgcagaggtcctgggatctaatcccaaccagcaggagcaattggtctttggtaacagagacaccatggagctaagttgccacccacatcgaggttgttccctggggctcactctctaggtcaaggatggtacagggctgatgtcctgaatcacattctggtggagcctcagacactacaggtgctggatgagctgctggcctgctgggataggggcggccgctggcagaaatggttgtagctgcaggacattaaggcagctgtgaggctaccaggagtcacacctcaggtctccctcccggtacctgcccagctggaatatttgtgccccaggggtcactatgcaacaggacctgacactggccagggagctatggccacaggctctctgtagctggccacaaaaaagtcttttcctcccctctgctaatttactgggtcctcttctctcattctcacttaaccacttcattgtctgaaagcagacccaaaattgctccttgggctgaaaatagtcattttttccagccacctggagtggctacatctcctggagaactttgattttctagacacagagggaaggacaggatactcacagggcctgggtggaagatgctcaaggggccttgtggggaagggagggagcagggacccagcctcttggggcctttctcttaagaggctccttcctctcctccaatcccatgccgccccagtctgttctcagagttagatacaagcagtcctcctccaaagattggtccttgatttccgtcccctattcacacactttatggagatgggtctcctctttctctgtgtgtcaaaccctcccaatatatctaaaatgaagagaatggagccaggcagtgtgctgcccagggaatcctctaacccctggcccgtggataaaccccatccccactccctctcatgctgcactaccaccagcgccaccagggtcaggtgttggtatcaggatgatgcaggcctcactaaatgagttagggaggagtccctctttgtcaattgtttggaatactttcagaagagaaatggtaccagctcctctttgtacctctggtagaattaggctgtgaaaacatctggtcctgggtttttctggttagcaggctatttattactgcctcaattttagaacttgtcattggcttattcaaaggttcaacttctttcaaaaaaaagttcaacaacaacagataaatctagaatttaataacagatgtaccatagttcttaaagtataattttttactctccccagtctgccattttactaaagacaaatcatggtatgaccaagttgctttattatacttggcctgattatttgtacgaagtgcagcaagaataattatttttacataggttttaaaaattggatttgatgaaactgttccataaaatgaatctcagataagactttttaaagctgagccagccatgagtctataccctcaaatatgagttgcataaatttcttttttgataccacgggataacttggggctcatgaacctgtcaaaaagtgacattatttacttaccccaggttaggaaccctgtatagggactgtgtagacaaggcataaagccagttttcccaaggggcttttattggctctataagtcaagtttgattccttaaaggaaagcacgtcattccagccaaagccttggcaaaataactaatttctccaacagtgtcctgttgcagaagaaaacattattttgcacttatacaaattatattgccataagttaagaatactcacaaatagtttccaaattctggagaaaacagatagaaacaaatgtgctccaaattttgtttacagaaatatattttactcaattgctaaaagctgtaaatagctcaaaataaaagtttccaggactctgaaaaacaaaacaatggatcaccaatattttaagcaaagtcaaaaagattactttagtcttacattagttcactccacgcagttatctcctgttctgcttgatactgatgaacatttcagctctccatgagagttctgaaagttttttctttattctattgccaaaatttccaaagttatcagaaacctgcatttaagagcacctgtcaatgtcctaaacctgattataaatcacctttcaaagagcgttaaaacaagacaacaattgtctgtggatgacaaagaagtcttaggacagccactattaaagctacaattgacagattttggttacttctgttgcatacaatgattttacataacaattattactattaataacatacactaagttatattggaattatgggagttttccctttttttgaatcacataccaataacatatttatacaaatacagcccaaggaaaaccaaacaccatttcatatttgacaatattttctttctttcctttttttttttttttttgagatagagtatcactcttgttgcccagactggagtgcaatgctgcaatctctgcttactgcaacctccgtctcctgggttcaagtgattctcctgcctcagcctcccgagtagctgggattacaggtgcatgccaccacgcctggctaatttttttgtatttttagtagagacagggtttcaccatgttgtccaggctggtctctaactcctgatctcaggtgatccaccctccttgacctcccaaagtgctcggattacaggtgtgagccactgcacccggcctgacaatgctttctgacatttcctcctgtttgatttttatacgaaataagccaaatgtcatttttgtattttagaggacctaatatctaaaagatatttaggtaagaaaaatacataatttataatttgattttttaaaggtttgtcaaatatcaaatcccaggttatcataagtcactcactaaccaaaatgataactcaaaaattttaaaaagacaaaaacctttactcactaatagagggaagacttcactttccacacaatctttttttcctttccttttgctccagtttattcaaaagggcagacaaaaatatgtcatttttaaaatattacatgaaaatcttgttcatgaagaaaagctaaatctcacccttgcattaatgtactattgatgtcaaacctaattcttaataaaaccttatagacaaatctatctagtcttaatcagtttgacaataaggtaagattcctataacccttttataatactttacaatttttgtgaaagagcagagtagtgctctaaggaaaaccagttgtacttttattccagtgttcaatttataaaaaactgaatacccctttaactttagccaatatgttaacacacagaatttcttttaccagatgtaaatttttacgaacttttcacaacttggttaatccttcagctctgttttatctaatttaaaacaatcctttgaccctttaatttaggacaaaagtaatctacattcccatgacttcttgtaatcttttactgaaaacacatttgactttttttacatacctagcatgtaaaactgtttttatttcccaatgattactaaagtgatgtaaactaaaatacaccatggtttctatttttctgataaaatatttgatttgagctcttattatttttaaaccaattaatcaaatctccttcatattacacacacaacacatataaatacacagctggaagaagatcaagtacctgtaagatttttcatttgtcagtttctcaattggattaccaccctggctttaagatggatccataggataaataggaccaggaaagcaaaaactaagcaatttcaacagcttaataagtaggcacagctggaaggcaaaacagatttgcgcccccccccccccaccccgcaaattaagactcctattttcatactagaacctggatcccaaaaagagggaatcagcccatctcccattggcatcttacctgtcagtggggggcggggacatttccatgccttctaggtggccaagagcacacttctctgattcaaatatgcaaaaagccaagtatccccccatagctgccattagccatccctgaatgtatatttcctacctacttattacatatctaaattttttcgtaacgtgaagtaatttctgataccccagaaagtaaaaaccatcagataatgcaaagcaaaaatggaacagagccttagactttgagagggatctatccacttccaattcctggagtttcatgaagaaaacagatgtttttcccaaaatgcctatcgtggcacctcctctgttttttctaaggacttctagctgttggagcttgaatatctgcaattaattaagctgacttttgggccaggtgttgtggctcatgcctgtaatcccagcactttgtgagaccaaggcaggcagatcaattgaggtcaggaattcaagaccagcctggccaacatggtgaaaccccgtctctactaaaagtacaaaaattagccgtgtgtggtggtgggtgtctgtaatccctgctactcaggaggctgaggcaggggaattgcttgattcccgggaggtggaggttgcagtgagccaagattgcaccattgcactccagcctgagtgacagaccaagactccatctcaaaataaataaataaaataataataataattaagccagcttttaaccatgatgctctttctgaaaacatgtatttaattctctcattgcttgactttagccatgccaaattgccaatatttctggcttttgaactttactaacataatgtcacaggtgaaacaaataagcctttttttgttttgtttgttttgttttgttttgttttgtgatggagtctcccactgtcgcccaggctggagtgcagtgaccaaacttggctcactgaaacctccacctcctgaaaccaataagctttaactaaggttaagaacctaaccacaagtgtacaaggtattttcaaaaaggtggcaaagcagtttttacaaaatctagaatcttcaaaggtagctcagagaaaggaaaatccaaaatgtttcatggaggggaagagaatcaacaaatgttcacacagatatcaaatcagaaaggactcatctcctaagctagaaattgaaccctgaacccaggctgccactgtgagacagcaaagcccaactactgagctacagcactgagcagtctccgttggagtctcccagaagaagcctccagcagccaattttgagcttgcaaaggtttttaactgctcaagatcatttttagagttaagtataacataaatttcaaaatttatgtatgctggatggtagaaaccaagagaaaatactgccacatggctacaaggtcaagctcccaagaacataaaacaagagggaaacttcatccattgttttgttgttgttgttgtttgtttcagggacttcttttttgtttctttgggagtattttttttgagactgagtcttgctctgtgtcccaggctggagtgcagtagcatgaactcagctcactgcaacctctgcctcccaggttcaagcaattctccctgcctcagcccactgagtagctgaaactgcaagtgtctgccaccaccctggctaatttttgtattttttgtagagacgaggttttgccatgttggccaggctggtcttcaactcatgacctcaggtgatccgcccacctcggcctcccaaagtgctgagattacaggcgtgagtcaccatgcctggcctgtttcagggacttctgaccagaagtttcaacatgtgatctctgcgcaagatggtggcctagagtaacagaaaagataggaaaggaaagagagacagagagagagagagagagagagattgcctatggcagggcaggaaaggtgaggagctgaggaaagccagagaaagacccaagcattgcaccgaatcaaaagtttaggtggccgcttgttggttgtgaaagaatcttttttgcagtcccatctgctctcaagtttcccactttagggaggaaaaatctccacatgttccatgattctgtactcacctaattctgtcagccacagccattagcaaaaagtgcaaggcaacttaatacaaagataaggcctggttcggtggctcatgcctgtaatcccagcactttgggaggctgaggcaggtggatcagctgaggtcaggagttcgagaccagcctggccaacatggtgaaaccctgtctctactaaaaatacaaaaattagccaggtgtggtggtgggcgcctgtaatcccagctatttgggaggctgaggaaggagaatcacttgaacctgggaggtggaggttgcagtgagccaagatctcaccactgcactccagcctgagtgacaagagtgagactctgtctcaaaacaaacaaaaaaacaaacaaacacaaagacagcaatggttaatattccataatgccaaatctaatcttaactgagagggactttactgagaggggcctctaaccccctaaatcttaggaaagactctaacctttctaagttgcacctcaaacacaagtttttcaagtgttcttgccttttattaaaagggaccttttatcttatctgtcttaggagacactctaactccactaaattgggctactaacccgattccattctttacccgggtatgccaccacttacaaaaagttagccaattggtaattcagtctatttcctttgagctgcgggtttccttagtatcatccttttgtaattcactgaaaagaagcttccagaaatggccccagttcagaaatgaagattgggttcttggatctcgtacaagaaataatttagaaccaggggtagtggcttatgcctgtaatcccggcaatttgggaggcagaggcgggaggatcacttgaggtcaggagttcgagaccagccttgcaacatggtgaaacccaatctctactaaaaataaaaaaattagccaggcatggtggcgcatgcctgtaatcccagctactccagaggctgaggcaggagaatctcttgaactcaggaggcagatgttgtagtgagccgagatggcgccactgcactccagcctgggtgacagagcaggatgctgtctcaaagacaaaaaaaaaaaaaaagatagaagaaagagttttgggtgagtctgcagtacaaagcaaaagcaaatttattgggaaagtagaggaataaaagaatagctactctccaggcagagcagcaatgtgggctgctcaactaaggatacttaacagttacttcttgagtatatgctaaccaaggggtggattattcatgagttttacaagaaagacgtgggcaattcccagaactgagtgtttctcttctttttagaccatgtaaggtaactttctgatgttgccatggcattcgttaactgtcacggcgctggtgggaatgtctttcacatgctaatgcattataattagcgtgtagtgattcctgaggacaaccagaggtccctttcattcccaccttggtttcggtagatttttgtggcttctttactgcaaactgttttatcagcaaggtctttgtaaaatggatcttgttccaatcttctatttatcctgtgacttagaaagccgggcctcatggaaatgcagtcctgtaggtctcagccccattttacccagcacctattccagatgcagtttctctgcttcagacgcctctgacatagctacagggtgctggaatgtggctagtgtgaacttcagtgtgctagaaaggtaaaatacaagattacattcagagatttagcttcaaaaatgtatgtgctttattaaccattacatagtaatcacatattaaaataataatattttggatatattgggctgattaagttgttgcaatcaattccacctgttattccacctgtttctttcttttttattttgagacagagtttctctgtcgccaggctggggtgctgtggtgtgatctcggctcactgcaacctctgcctcttgggttcaagcgattctcctgtctcagcctccctagtagctgggatcacaaatgcctgtcaccacgcccagctaatttttctacttttggtagagcaggggtttcatcatgtaagccaggctggtctcgaactcctgacttcaggtggttccccacctcggcctctcaaagtgctgggattacaggcgtgagccactgcgcccggccccaccttttttttttttttatttttaacatttggctactagaaaattaaaaatttacatgtggctcatattttactgcagaggattgcctcccttctgaaatctcaggctgtccgcatgtattagtccattttcacactgctacagacaaatagctcaaaccgcgtaattttttttttaaagtaaattgaatcatagccctacatggctgcagaatccttgggaaacttaaattcatgaccatgacagaaggtgaagggaaagcaaggcacatcttacatggtggaaaaagagagagaaccggggaggacgtgccacatttttaaaccgtcaggtgtcttgagagctcccttactactaccagaacagcatgaggataatccacaccaatgatccaatcacctcctgcccggtccctgccctgacaaatgggaattacaattttttttttctttcagaggaagtctctctgtgtcacccaggctgcagtgcaatggcgccatctcggctcactgcaacctccaccccctgggttcaagcaattctcctgcctcagtctcccgagtagccgggactaacaggcacgctgccacgcctggctaatttttgtatttttagtattgacggggtttcaccgtatttgccaggcctgtctcgaactcctgaactagtgacctgcccgcctcggcctcccaaagtgctgggattataggtgtgagccaccgcacatggacgggaattacaatttgagattagatttgggtggagccagaaagtcacaccatatcactgcaaaggatccgcagcaaggaagggcataaaatcctaaattttaaaataattgtcattatttcaatttatgaataaatattatatatcatttataaatgcatatcacattatacacaaggttaaatgcaaatatcctctgaagttggcctggctcagatcaaggaagaagccctgcctgtgaaggctgcagcctaggctgttatttttgcttcgctcagcccagtgtctgatcaaatattccctcactcagggcatgaaggctggggcctgaaaccttatccaatcaggagccgtggtctagaaactgtccaatcaggcatgcagctggaaagaacaggctacttccgtaattttgcgggtcctttgtgtttttctgcgtccagagctgcagttcttctcttcactgctctgtgtcctctgctcctagaggccaagcctatgtgtccttgtgtcctgcaggtatctgcagatttatggctaaaagaccgggaccccctggaagccgggaaatggtgagtgctgggtctgtcatcgtgagagaggggtgggggctggttggaaccggcagaaagtggctgtagcaggtcccagactttctcgcagtcagctccagagcctgacgacccaaatcgtctttggcccagctcggctctcgtcccctccagccgcaagatggtgcctgggccagcgcctgggaccctgggatttctgtctttttcctctgcagtggctttaccctggactggaggcctctctggtttgctctgcactcccagcgcctcatctcacccagattgtacagggatgggaaagtcatcaggggagaatcctgactcagggtgcaagattcatgagtggaaagagctgtggtcctggggtccttagttcctcatttttccttttagagatgtacgggagtcactctaaaaatgagaatctgatcaaagtgtgattcaagaatcatagagtgcccagctatggtttgtgggttgtgatccatgggagagacttgaagaaaagtctgttataagtttcatgacgaagcaaaccagattcaataattggtttggtacagttatgtagtttatttgtgagatccaggtaaaaatttcttggttatgtcatcagagattaattggcaggctgtggttgcctaggcttgaatattttcttcaagatagtaatttccaagaaatgcttttttttttttttttttttgagagggagtctcgctctgtcctccaggctggagtgcagtggtgcgatctcacctcattacaacctccgcctcccaggttcaagtaattgtcctgccttagcctcccgagtggctggaattacaggtgtgtgccaccaggcccaactaatttttgtatttgtagtagagacgggatttcaccatgttggccaggttggtctccaacttttggcctcaggtgatctgcctgcctcagcctcccaatgggctggggttacaggtgtgagccaccgcacccagccgatttttttttttttttaccttttattttaggttcaggggtacatgtgcaggtttgttgtataggtaaaatcatatcatgaagtttttgtgtacagattattttatcactcaggtactaagcatagtacccaacagatttgttttctgattttcttcatcctctgatcctctaccctgaactgagcctcagtgtctgttgttctcttatttgtgtccacgtgttctcattattttgctcccacttataagtgacaacatacagttttttattttctgttcctgcactagttttctaaaaataacggtctctagttccatcgacgttgctgcaaagtacatgatgttgttctttcttatagttgcatcctatttcatggtgtttacataccacattttccttatccagtctaccattgaagacatacaggattatttcttgtttttgctattgtgaatcgtgctgtaataaacatacgcgtgcatgtgtgttcatggtagaaaaacttacattcactgggtatattcccaattgcgggattgggaatggtaattctgttttcaggtttttgaaaaaatgccaagctgcttttctcaatggttaaataaatttatactttcaccagcagcatataagcattcaatttctccacaacctcacaagcatctgtttttgtttttgtttttactttttattctaattgtttttatttgaattatttctttttttcccatcagtctagtgttttatctatcttattatgtttacattgaatcaacttctggttcctttgaattttttttttaagacagagtttcactcttacacgcaggctggagtgcagtggtgcggtctcagctcactgcaacctctgccttccagtttcaagcaattctcctgcctcagcctcccgagtagctgggattacaggcatgtgccaccacggccagctaatttttgtgtttttagtagagatgggctttcaccatgttggctaggctggtctcaaactcctgaactcgtgatcttcccgccctggcctcccaaagtgctgggattacaggagcgagccacagcacatgcgtggcccattgaactttttatagttatttatgtctcaaacttcttcattttggctctgattttggttatttcttgacttttgtgagctgtgaagttggtttgctcttacttttgaaattcttttaattgtaacattagatttttaaattgagatctttctaactttttgatatggatgtttagtgatatgcattttattcttaacactgccttagctctaaccctgagattctggtatgttgtatttcggttgtaattagtttcaaaaattttatttctgccttaatttcattatttccaaaatagccatttggaagctgattattccatttttatgtaaatgcatcctttcacatgttttttttgtattgaattattctatacattttctttttaaaattaatgagaaagataagaagaaataaaaatgctgtgctcttaatctaaatgctaaaaattattcagcacttagtaccaactcccagggtgctatgaaaattaaatcacaaaatgtgttattcccagcgcagtgttctgtgacatgctcctgagcacacagtacctgcttagtaaacgttttattagtacatgtgtacaggtttcccaggtgcagattcactcagacgttgctgtcttctgttgtccctgtaaacttaaaaaagccaacaaaaatatagcatttcagggtggaaattggttgtttttatttgtagcagaagtattagtattgtgacaaatgtggtgtgtgtaagggactctgctgtgcctgctttctcttgctaatgctaataatgtgtctgggaaagcacaatcagcatttacaggggacttgttgtaaaagcccattcctggacccttttggatcctgcagaatcacgttgcatagagcggggccaagattaccaagtgatttataaacttgaggggttcaagatacattcaggagagtttagttcaacctttgcctcaaaggaaggctgcactgcctgccctgtttcagtttggtaggaagaggtcagtgcggttcatgttcccattactctaaagaaaattgctggtttctgataggggagggcagagacaaagaaacttatattttaatagctgtggagaagctcattgttctctcattgctcttaaatcttttcagttataaacaacaaaaatgggtgaatgttttctgcaagtctcggtcttccgcccgtgggtgtgtgtggtggtagcaggtgaataggttgcactttaaagtcatattctcaagatgcaggtttgatatgtccagagcatcttatctgaaaatacatttcagagaaagaggaggaaaagaaacaaatcactttttctcaggtgagcatgtctcagatcaagcgcagtgtccactctgccttttggaatgccttgtgttcagaacttgcaaagttttacttctctactcgtgctgttgatccctaatgagtttgtttcaactattttttgtgatttttatgatagtcaaggggttctgaaaaaaatatttgttttctctatgccatagcattctatacatttctcttcatcttggattcttgtatatcatgcagaattcttaccacaaatttatgacctacgatatataaaatgttcccattgtagctgttgaacattagaaggtgtggatactcaagatttctattggggaaacaccgttgtctttggagattagtgaaaagtgaaacatgttatattgaggtttcatctgtgtgctctattagttccatgcagaacagcgtttagaaaatgctcatttaaacagggtggcatttattatacagaaagttctgaaaaaactgttaggagatacttgctttccagggtgctaaggaaagactccttaaaattactaataaaaattgcagaacagggaagttatctgcaccttcaactttgcataaaactgatgtttctttatgattaaatttaggccaggcgcaatggctttggcttgtaatgccagcacattgggaggccgaggcaggcggatcacgtgaggtcaggagttcaaggccagcctgaccaacatggtggaacaccatctctactaaaaaaaaaaaaaattagccaggcatggtgcatgcacctgtaatcccagctacttgggaggttgaggcaggagaattgcttgaactcaggaagttgaggttgcagtgagatgagatggcaccactgcactccagcctgggtgacacagcgagactctgtctcaaaaaaaaaaaaaaaaaaaaaaaaaaaaaaaaaatatatatatatatatatatatatatatatatatatatatataaataataaaattaaatgtagattataatttacttttctgagaggagagaaatgccacagcagtgatgctgtgttgtgtgtgcatcagcacataataaaaatgtgtcctaataaagttgataacaattttattcacttggttcaagatctctatgacatttttttccactctagagttaattcttattctcttaattattaaggacacttaggagatttactagctgaagtgcataaaccgttgcatttaatctggaagctgtcctttccttttagatgacttttgcttatatttgtcttttaaaaatgaaggctcttatctttatttacaggtgagagaaactgggaaaaacccaaactctgccatttactggatatttgacaaaatattcttactaggctagaaacattggtgagcttgctaaaaattcagaaattcagacttcctccgaaatctcctgaaacaaaatctcacaagatctttagttattgcacatactaagacttgagaggtatcttccaattcatcatgactcttctatctgagaaatatacacaacttattctatatgatgtaaatatagcactcaaaaatggacatgtccggccaggtgcagtggctcatgcctaccattccagcactttgggaggctgaggtgggtggatcacctgaggtgaggagtgcaagacctgccaggtccacatggagaaaccccgtctctactaaaaatacaaaaattagccagtcatggtggctcatgcctgtagtcccagctactcagggggctgaggcaggagaatcgattgaacccgggaggtggaggttgcactgagccaagatcataccactgcactccagcttgggcaacagagtgagactcggtctcaaacaaaaagaagaaaagaaaaagacatgtccatgttgatgcccttaattttataatgtatcatccagaaaagtatcaaatctacagtggtattgtggatcttatgctatcctcttttctcagagttagagaatacttcagtgttaaaaattatcttattgaataattttagtcactcttgtaagtgagaaccacttctttttactctcttttttaacttgagtcaaataaaaatctctgcctatggccatgtggtaagtgcttgtgtgttcatgagtggttttgtttgtttgtttgttttccagggactgttgacattcagagacatagctatagaattctctctggaggaatggcaatgcctggattgtgctcagcggaatttatatagagatgtgatgttagagaactacagaaacttggtctccctgggtgaggataacttcaatacataattcctaatatattgcttttctcttttctaagatgtttttggtaatttctgctttgcatgaatgaattctagatctccaattttaagaaaatcttggggattcattgctgtagaacaaattcttcaagatgttttatcttgaccagaacttttgcctttcctgagcttatgtatcttttgctctaggttagtgggaattccaaaaatgccatggcataaaagatcgttgcccacacattagaattcagttgctgccaccaatttttgattcagtagtactgagtagtgaaattaaggacctacaaatttaaaatattttctgaatatttagaaagttctattatgaatcaatattaattttctagaattttctattatatcctctaagcataatactaatttggtaattaaagaattcagcatgatctatgttacttttttttcttaataaaacaggtattgctgtctctaagccagacttgatcacctgtctggagcaaaataaagagtcccagaatataaagagaaatgagatggtagccaaacgcccaggtaggtgagagcaaatgaagcagatgagacagatgagaggtacacaaatcaaggaggcagccagtccttaaaatgtggtctggggagctgtcctttgatgaaaagagtttctgagaagctcaagtcattttttccttttgctctcacatagggacacctcctgcctcatgctgttaaagtctctaaggattccacttctgcttcaataatctttcttcaggttcacagtgtgagccaaagttttctttaaaggttatcagggactgcgcaaactgactgctttgccattgcttttggggacacactaatatctgcatatttttggaaaactctaaaccattaaaattttttttttgcatcatgtctaagatgtgtgagaatagtagtttctctttcattggtggtcatccatttttctgcacatgccattctgtttttattactatagccttgaaatatattttaaagtttttacaaattttttacaaattgtttaattttttatatgtatttatttatttagaggcttggttatccccccacttgctgtggggggatatgcaagcagggtaccttttatgccttcattttactgtgttgcatattttagatatagactcataaatggtattgctgtattatataataatttcattttagattatttaaagaatgcttatgatgtttttatgatggctgtatcttttttctcataaaaaacaacttacataggtttcaatttctttacatcgtcaacagttggtgttttaaaaaaatttatagtggccatcctaattgatgtaaggtgattttgttttgtgattatgttttgcatttttctataaattattaattttgtgcaacctttcaaatgcttcttcccctttgtatatcttttttattaaaatttagtttaatcatttttccatttctttcttttttgagacggagtttcactcttgtttcctaggcaacaagagcaatggcacgatttcagctcacagcaacctctgcctcctggattcaaatgtttctcctgcctcagccccctgagtagctgggatcagggatgtgccaccacacccagctaattttgtatttatagtagggatgggtttcgccatgttggtcaggctggtctcgaattcctgacctcaggtgatctgcccacctcagcctcccaaagttctgggatcacacgtgtgagccaccgcacctggctcatttgtccatttctaaatcaagtaattcaattattgttgtctagttctaggagtagtttatgtattctcaatattaagtcttatcacatgtgattttcaaatattgtcaccgatttcttgggagacactgtcactctattaaatgttttatttgattgcagaaattttgaagtttagcccaattaaatttttctgttctcctctttgttgcgcatgcatttgatggcatatctaagaaaatgtgccaagaccaatgtcatgtctttgcactatactttttttctaagagtttcattaggtttttcttagtctaagtactttgtttaaaatattttttgtatgtgatgcaattaaaccattcaacttcatttttttcaatgtagatgtccagttttcaacatcatctgttgaagggattatattttctccattgtctgctcatggcaaccttgaggcagattatttggtcatacacagaagagttcattgctgggctttctattttgttctatcatgtctttatctgtctttttgtgaataccacatagttattgttattgcagctttttattatgttttgaaattatgaagtatagtgcctctgtgtttttcatgtgtgtttctctagatttggttcataataaaatttaaaaattttaaacaatatttcaggaataaatatacttttggaattttgatacagattatattaaatttgttcaccactgtgggtcttaacaaattaagtcatcacttaaatatgttggcccttgagaaaaaatattaaattaatttaaattatttgaccctgtgcaagaatacagtgaagagtgtgtttatttccatgtatttttgatttgccagtattactttttttctttttagttttattcagtttgggttagaaaacatatactgtatgattttgctcttcttattttttttttgactcagagtttctcactctgtttcccagactgtagtgcagtagcacaatcttggctcactgcagcctcaacctcttgaactcaagtaatcctttcaccttggcctactgagcggctggcattggaggcataccccacaatgctcagctaattttgaattatttgtagagacagggtctcactgtgttcccaaggctagtatcaaacttcttgccccaagtgattcttccaccttggcctcccaaactgctgggattacacctgtgagccactgcacctggctgatcttttgaaatttaccaagacttatgtgttctaacagaatgcaccaggtgcaaataagaatattgtgtatctacttgcttttgactggagagttctgtacatgtctgtttagcctatttggtttgtgatatggtgtagatgccctccaaatggcatgttgaaatgtaatctccactgttggatgtggggcctaatgagagctgtttgcatcatggagacaaatccctcatgaatgacttggcacaatcatagagttctcacgctattaattcacatgagagctggttgcttaaaggaacctggctcctgcacctcacactcacatcgtctttcaccatgtgacatgtttggttcttctttgccttccactataattgtaagcttcctcatatcctcaccagaagcagatgctggcatatacttcttgtgcagtctactgaactgtgaatcaaaaaatctttttctttatgaattacccagtctgaggttattttctatagcaatgcaaaataaattcatacacaatataatattcttcaggttttcagtttttttaattgatcttttatttaaattttttatttattattgaaaaggaggtcttaatgtttataattttgtgttgctattttatttcttgcttcatttctgtcaatatttgctttatatgttttgaagccctgatgttatatatgcatatacatgtagatagacataataattatagattcctagtaaatggactcattttaccattatataatatcaatctttgtctcatgctagtaattgactcatttgctttcgtgtgtctataaagattttttctttgtgctacattggagattctgtaaaacatcttaaatgttacaacagtatattttaaactggtaaaaaaaaatgacttcagttgcatagaaaaatttgtcctcattatatctaccctatacttcttattgatgttgctaattatatctttttatgttttatgttttttatgcttatatttttcaaattttaaagaataactaaaagtattttctgcaccaccacaataatgccacagaattttactttttgtatatgcatatgtttttcagaaagttatgtattttcatatgattacatatatttttcatcatgttgttttaagtggaaagacctcttttcagcattttatgtagggcacatacaatgattatgtgcttttccagcatttattcattctggaagagttttatttttctttatgttgtagtacatttttctggttttattattctcaccatgaaaatttttttcagcctttgaccattttacacagttcttttctgacctgcaaggtttctgtttacaaattcactggttgtctcagaggactatgcttataaataatacttcacttttatcttgcagctcccaagattatcttctggtttgtgacttttgaaactttgcttaaatttgtgttgcggatctttttgtgtatatcctagtttgtttgtttagcttcttcattttttacgtacttttttcttacttttaaattttttcagttattcttttttacctccaccttgtttatttttattattgcaagttttgttggtattcttatttttcttattttatttaggtgtctggttttccatttttctcattgagcataatatggattatcttaaattttaaaaatcaagatgtacatctttatttttatagttgctttttcaaaatttttgatttttttgattggaccatgttgtcctcatgttttatatacattgtaatctttgttggagatttagacactaacataaaactacctttcatgatctttataatgcagctccttcctctcatagcatgacaccaattgtctttggtagagattctgggattctcacaaacatgttctcaggatgtgttttgtctgcaatttgtatttatttttcaattaaaagacttcttcatatttcttcttagtggtcagtaactacgttctacacctatcttctacccatcatactgcagtctttctgcggttgtaacattcacttttgagctcagaagacttaaagctgttattaaaggcactatgttcttctactgggcatgaggaagggctgtgttgggtaaatgtagcagacctttcttttctctctatatggctctggacatcgtgctcacatggtgcacacacttactttatttataaatttccaacaaaggtattttgatcactatgattttgttacatttatacatctatgaaggaattatggcctgtggtattttgatatggcattttgctaatgtaccttgtgtaattttatatatttcatgtgtagaatacatttatatgagtccagaaagtggagtaacttgtgctttttgtgtctttcagttacgcgttcccatttcacccaagaccttcagccagagcagggcatcaaagattcactccaaaaagtaataccaagaacatatggaaaatgtggacatgagaaattacaatttaaaaaatgctgtaaaagtgtgggtgaatgtgaggtgcccaaagaggttatagtgaagttaaccaatgtttgtcaactacccaaaacaaaatatttcagactcataaatatgtcaaagtctttggtaaattttcaaattccaatagagataaaacaagatatactggaaagaaacatttcaaatgtaacaaatatggcaaatcattttgcatgctttcacacctaaatcaacatcaggtaattcatactagggagaagtcctacaaatgcaaagaatgtggcaaatcctttaactgctcctcaaaccatactacacataaaataattcatactggagagaaaccatatagatgtgaggaatgtggcaaagcctttagctggtccgcaaacctcactagacataagagaactcatactggagagaaaccctacacatgtgaagaatgtggccaagcctttaggcgctcctcagcacttactaaccacaagagaattcatactggagggagaccctacaaatgtgaagaatgtggcaaagcctttagcgtatcctcaaccctcactgaccacaagagaattcatactggagagaaaccctgcaggtgtgaggaatgtggcaaagcctttagctggtcctcaaaccttagtagacataagagaattcatactagagagaaaccctatgcctgtgaagaatgtggccaagcctttagcttatcctcgaaccttactagacataagagaattcatactggagagaaaccctacacatgtgaagaatgtggccaagactttaggcgctcctcagcacttactatccacaagagaattcatactggagagagaccctacaaatgtgaagagtgtggcaaagtctttagcttatcctcaaccctcactgaccacaagagaattcatactggagagagaccctacaaatgtgaagaatgtggcaaagcctttagcttatcctcaaccctcactgaccacaagagaattcacactggagagagaccctacacatgtgaagaatgtggcaaagcctttaattgctcctcaacccttatgcaacataagagaattcatactggagagaaaccctacaaatgtgaagaatgtgaccaagcttataagtggcattcaagtcttgctaaacataagataattcacactggagagaaaccctacaaatgtgaataatgtggcaaagtccaccctcaggccttataatacataaaataatttacactggaaaaaaacactgcaaatgtagagaatgtggccaagcctttaaccagttccaaaccttaattgaacgtaagagaattcatattggacagaaattttataaatgtgaaaaaatgtaacaaagcctttaaccaaccctcaaaccttaataaacctaagagaatttattttaaaaaaatttttttgagttggagcctccctgtgtcacccaggctggagtgcagtggcatgatctcagctcactgtaacctctgccttccgggttcaagcgattctcctgcctcagcctcctgagtagctgggattacaggcgtgtgccaccacactggctgatttgtgtatttttagtagagatagagtttcaccatgttggccaggctggtcttgaactcctgacctcaggtgatccacctttgtcagcctcccaaagcctaagagaacttatattacagagaccctagaaacaaaaaaaaagtgacaaaacctttaagcacatctcaggccttacataatatctgatcattcattctagagagaaactctacaaaagcaaagaatgtggtaaagctgttaactagtcttgaacccttattatacataagagaattaatactgaagagaaaccctgcaataagcaatatggtaatgtctttaaaaagtcctcaaacctgaataaatgtaagataattgatattggagagaaacgctgcaattgtagaaaaaaatgtggcaaaccctttaactggttctccatgcttattcactgaaaaattttatactggagagaaattctgcttacataaaactgtgacagagcatttaagcacacctcaaacttttctaaaaaagagaaatcatactggtgagagactctagaaatgtgttaaaggtggcaaggactttaaatggtagtcacacgttatggtaggtaagatagtttatactgaagaagactcctacaaatatgaagaatgtggcaaaacttttaacaaattctcacaccttacggtacaggaaagcatttatactagagaaaaattgtacaaatacaaagaatgtgaaaagccattaatatcaggtcacatcttactcaatatcagaaagtttatacttaataaagggattataggtcaggtgtgttggctcatgcctataattccagcactttgggaggccaaggtcggtggatcatgaggtcaggagttcaagaccagcctggccaacatggtgaaaccccatctctactaaaaatacaaaaaattagctgggcgtggtggtacgtgcctgtattcccagtgactagggaggctggggcaggagaatcgcttggtcctgggaggcagaggttgcagtgagccaaggtggcagacaggcagaggttgcagtgagccaaggtggaagacctgcactccagccaggatgacagaacaagacaccattaaaaaaaaaaagtatatatatatatacacatatatatgtgaaagttatgtagcaagtgagtgtgtttgtgtgtgagtttgtatgcattttcagaacagaagaacaatattgaaacaaaatattattttaataaggtggataattaaagagaaacctggaaacctcagagattctcaaaaaaatctatattctgtgacttgtattgaattcgttactgtaaaattttatcccacccaaatcttatctcaaattgtaatccccatgtttcaagggagggacttggtgggaggtgattggaatatgggggtaattttcccccatgctgttctcatgatagtaagtgagttctcaaaggatctggtggttgtataagtggtatttatttctgctctgcctctctcttgctgcctagtaaagaaggtacttgcttcttctttgccttccaccataactgtaggtttcctgagacctccccagcaatgcagaattgtgagtaaattaaacttcctttctgtataaattacccattctctggtagtaactttatagtagtgtgaaaacaaactaatacagaaaattaatacaggtagtttggggcactgctataaagatagttgaaaatgtggaagtgactttggaactgggtaataggcagaggttgaaacagtttagagaactcagaaaaaaatagaaaaatatgggaaagtttggaacttcctagagacttgttgaatgcttttgacccaaatgctaatagtgatgtagatgataaagtccaggctgaggttgtctcagatggagatgagaaacttatttttaaaatggaagcagaacataaaagtttggaaactttgcacctgaccatgaggtagaatataaaaccccattttttagaaagaaaatcaagccactgcagaaatttacaaaagtaaagagaagctgaatgttaatagccaagacaatggggaaaatgtcttcaggtcatgtcaaagatctgagacaggttcttctatcacaggccaggaaccctaggaggaaaaaatggtttcatggtcgaggcccagggagggccccactgctttatgaagccttggggctgggtgccctgcatcccagctgctccagatccaactgtggctaaaaggggccaaagtacagcttgggttgtttcttcagaaagtggaatcctcaagccttggtggcttccatgtggtactggccatgcatgtgcacagaagacaagagttgagctctagaaacctctgcctagatttcagaggatgtataaaaatgcctggatattcaggcagaagtcttccacagggtcagagccctcatggataacctgtgctagggcaatgcagaagggaaatgtggggttggagccctcatgcagagtccccactgaagctgcctactggagttgtgagaaggccactatactccagacccctaaataacagattcaccatgagcttgcaccgtgcacctagaaaagccacaggcacacaatccagtccataaaggagcttcccaaggccaggagggcccacccattgcatcagcatggcccacatgtgagacatggagtcaaatgagaacatctcagagctttaagacttaatgactgccccattggaattcaaacttgcatggggcctgtagctctttggttttggccaatttctcccatttgtagtgggagaatttatctaatgcctgtacctccattgtatcttggaagttactaacttgcttttgatttacaggctcataggtagcagggatttgccttgtctcagatgagactttggacttagacttttgggttaatgctaacttaagacttgggggactgttgggaaagcatgtttggttttgaaatataaaaagggcatgagatttggaagaggccagaggcagaatgatactcatgctgttcttgtgatagtgagtgagttctcatgagtttggatggttttataagtggtaatttttcctgctctccgtcacctagtgaaaaggatacctgcttctccttcaccttctcccattatcgtaaggttcttgaggcctcccaagccatgctgaactgtgagtcaaataaacctctttcctttataatttacctagtctttggtgtgttcttcagcagtgtgagaatgcactaatagacaaagtaacttaataacaaaggtgtcactattatcctcaatttacaaaaaaaaaaaaagaaaagagccagagagagaaataacttgctcacaatagcagagccagtattaaaacagtatcaactttaactccagagataatactcttgaataaaacaataaaaacactttcaaacagaaaagaaattacttttaacatccattcttaaaaatttaacaaaaatgaaaatggatacatttgtattgctatatatttgtatatatgtgaatgtatattacaaataagaaatacttcatataagccagaaaaagataattattttaatgaatacaatggaaaagcagttcaattaattattatttgcagatgatatctttgtttacttagaaagacagcaaaagcaactgaaaggtgattttagaaatctattcaggtgggtagggaaaattctcagatgaccctcaggttcccacttcagtgcacacctgctgtgtaatccttttctcttgagcatcacaaaatgtgtgtgactgtggcaaaacagtattcacgtatttatattactaatgtattggcttcctttttatcatacaagtgattatcttgattaggctaaacttaatcagaggtgctttaagagaaagagcacatcatagaaaaatatccctgcttccctgaaattaatcaaacttcttggtaagcaatgtcgtaaagtgtttatggtggccagatggcaaggtatatatttgtatattgtctacatttctgcgttcaacatattactttcagtaaggagaataggaggatctcattgcagaggaaaaagaagggatctcatttatgcaagaaataatcacccctcatctgggacagcttaagaaaaacagagaacagatcatgacctcatcaatgggaaataaaggcaacttggttgaaagggctccctggcgttatgaagcaatgtctacacagctgaagtaaatgatcagcctctgggataccaatagtctaccaacaaggccgtattcattttcattctgattgcattagcacttctgcactattctggtaactcggatttacatatttcatgacaaagatagctgcagggtgcggtggctcatgcctattatcctagaactttgggagggtgaggtgggtggatcacctgagattgtgagttcaagaccagcctgatcaacatggagaaaccccatctctactaaaaatataaaattagccgggcatggtgctgcatgcctgtaatcccagctactcaagaggctgaggcaggagactggcttgaaccctggaggcgaaggtttcagtgagccaagatcatgccattgcactccagcctgggcaacaggagcaaaactccatcccctcctgccaaaaaaaaggaaaaaaataccatgcagaccagtgagtactatcctagaattgaacttatcatgaaaaagccttgccaattcttcaatttcaacattggaaaatgttgaaaaaaataatgaatttattaataataatctgactttctaactttagactattctactattctatactacaatattgaactttgatcatcgtaacatgaacatttcgtgaatgcataagttgttatgtagataggttctcttttagattaacacaataagacaattagagcaaacaattagaaaaagcatttgaaatcaaataaaagtcatcagatccacatctttcaatggcttggcataattgccatgttctttgaaagaagcaaagacaagattttggcttagcccaattattaagtccttgaccttttgaaatctaatatcctggctaaaaaaaacagtagggaatattttttgggtggctgtctaaagtgtccaaggcaatatgagaagaattttaatagttaagtaagaaaatgcataccacatacacacattactcttctctactttgctctaacattgaaagattagaaattgcaaatctagtcccttaatttcgggtaaattagcaaaagattcatatttcagctgagcaaattgttgtatgaaacttataggtaacagatgccattatctgcaaaacacaaaatagtatgactagatccagtaactatctagccatgcaaatgatagaccaattagattaagatcctaacaggtgcaggtagaaagcatttatgtgcaatgttgtgacccttccccaaagacgtttttctgactccttacagagataccaatttttctgaatgactcagagtgaatactgggaactgagaatgctcagtgttcagagttgattactgggaacatatttaacacatttcttcgatattatgaagaaattttatgaatcttaagagaaaggctttttttttttttttttttttttttttttgagacggagtttcactcttgttgcccaggctggagtgcaacggcgtgatcttggctcaactcaacctctgcctctcgggttcaagtcagtcttctgccttagccttctgagtagctgggattacaggcatgtgccagcatgcctggctaattttctatttttagtagagacggggtttctccacgttggtcaggctggtctcgaactgctgacctcagttgatccgcccgcctcggcctcccaaagtactgggattacaggaatgagccactacacccaacccagaaaggtttttaataaaagactgttcatgtataacactctatttggattcatagaaattttcaatatgccatttaagtcaaagacactgaaatgtcaaccaaatttcacaaaatgtatttgaatgagatcaagtcttccttagctgagaattgtatttcatcagtaaatttagaagaaaataataaatgtgtttactttagaccatataacagtgtttgccacatgggaccaattcaaacaagggctcttcatcattactcttaaagtagcaatagcaccacatccatttcctggtaccagccagcctgtttttcactgatatgaagtgcagaaggcattgaaacagtgaagaagggtgatataaatggaatacttatatgaagtacaattgttaataaaaagtagcatttgatattatacgactataggtaagatgattagtatgagataaaaatatttttactttaattgacagaatatcttaatccacattatttctatttcaaataatttttttgctctatatttgctgcctttttatttgctattacctgagctcaataagaatcaacaaaatgaatctttattttaccacaagaattttattcatgcatatgcttaatttgctgaaaacatgttagctttccatgaaagatttatacttttattgtgtcattctttgccaagaagtggctgtcctggcagaaaactgctatttctgagctctgctcactttgactctgctcagcatagtgactggaagtgatgtgtggataaaaagcaaatgtgtcttctttgcatcttttttgatctattggctttagaaacaggagaatgtggatagaaaatttagaaaaaaatctaatctccaaataatcatgaagaagtttttttaaccagaagtaaaccaaaggggaaggtggtgtgtgcataaaatgtattattttgctaagcctttgaaattgtagggtttattagtatgacaacctgcattgctttaacaaacatattagtcttttagttttaattcttctggatatgattcaatttcctgatgaatctgaactgagaggagaataacttacttgttaaaattaaagacacaggaaaaattatgttgactaaaataagatagccaaaaaaagacagacaaaacagaaagtaaaatgatgttcttcagacgcggaaaagagagaaggagaagacagtttattgaacattagattgtacttttcaaagataaaattatctagagatttgtttcatataatataaatatacttaaaagtactaaacatatagcttaagtatataactttaaaatgtttaagatggtaattttatgtttttaatcacaaatatttacaactctcaaaaaatagttgtatttttcaaaaattacttcaaatatcaagtgtttttctcacacaataacatagattcaaacaacaaatagacagtaattttagactgcctttctgactactcatccagacaatagaacactgacaaccacctgagaaaagaaataaacaagataattaataaagaaaatggatcaatatttatacacgcaaatatcacataaataacttttataggcaatagaaatgtctgacttacggggctgggcgtggtggttcatgcctgtaatcccagcactttgggagactgagccaggtggatcatgaggtcaggagttcaagacctgcctggccagcatggtgaaatgccatctctactaaaaatacaaaaaattagccaggcatggtggtgcgcacctgtagtcccagctactcaggaggctgaggcaggagaattgcttgaacctggaggcagaggtggcagtaagcctggatcctgccactgcactccatcctgggtgacagagcgagactccgtatccaaacaaacaaacaaaaataagaaatatctgacttatgcttgttttttaaaatttgctccaagtgaaacccagggatttatatttgagttaaacaccacatttttttttcttaagacggagattcactcttgttgcccaggctggagtgcaatggcatgatcttggctcactgcaacctccacctcccaggttcaagcaattctcctgcctcagcctcccaaggagctgggattacaggcatgcaccaccacacccagctaattttgtatttttagtagagacggggtttctgcatgttggtcaggctggtctcaaacacccaacctcaggtgatctgcctgcctcagcctcccaaagtgctggggttacaggtgtgagccaccatgcctggccctgttaaacaccgcatttttataaataatacagagtgaaaattactttccacatcataaatgtaacgttaaaaacaaaaacacaatttaatcatcaaaagaaacctgtacgaaaaaattgcagtataatggacttaaaaacaaaaataaaacatgttgacctataaaatatggaatattagcgtagatgtatgagaaaataattttttaaataactacagttttcaaatatgactatgaacttatgaaaatctggcatttttaattattggcatgcaatgtatagtagtaaat

SEQ ID NO: 770 - DNA, 389686 bp, Homo sapiens
atctaaaaatttcctatgtcccttgtccctgagaaaaaggtgtgataagtggctaaatgtggaagatgacccctggagtagcatcataataaggatgaatggagaggctactgtgatcagtatgaatctagttagcagagtaccaaaggggaagaggacattttagtgcactgcagtaagtgtcagttccggtgaccaaagatgttaatggtgactatatttttcaacacaaggcagcatgcatggatgcaataaaccatggacacattaacctcttccctgaagccagaatgacaaggccctacctgtatggaatttagatcaaaggtgtgaggagaagaaaataagtgaaaaggaaagaccctgaagtcactaagtagaaacatagaattgagcaaacttaaatcataaagtgaatgatttgctctgaaagtgtttttttattatactttaagatctagggtacatgtgcacaatgtgcaggtttgttacatatgtatacatgtgccatgatggtgtgctgcacccattaactagtcatttactttaggcatatatcctaatgctatcccttccccctccccgcaccccatgacaggcctagagtgtgatattccccttcctgtgtccaagtgttctcattcttcaattcccacctatgagtgaaaacatgcggtatttggtttttggtccttgtggtagcttgctgagaatgatggtttccagcttcatccatgtccctacaaaggacatgaactcatccttttttattcctgcatagtattccatggtgtatatgtgccacattttcttaatccagtctatcattgttggacatttgggctagttccaagtctttgctattgtgaatagtgctgcaataaacatacgtgtgcatgtgtctttatagcagcatgatttataatcctttgggtatatacccagtaatgggatggctgggtcatatggtatttctagttctagatccttgaggaatcaccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgacttgcatttctctgacgaccagtaatgatgatcattttttcatatgtctgttggctgcatcaaggtcttcttttgagaagtatctgttcatatccttcactctcttgttgatggggttgtttgtgtttttctcgtaaatttgtttgagttcactgtagattctggatattagccctttgtcagatgagtaggttgcaaaaattttctcccattatgtaggttgcctgttcactctgatggtgatttcttttgttgtgcagaagctctttagtttaattagatcccatttgtcaattttggcttttgttgccattgcttttcatgttttagacatgaagtccttgcccatgcctatgtcctgaaaggtattgcctagcttttcttctagggtttttatggttttaggtctaacatttaagtctttaatctatgttgaattaatttttgtataaggtgtaagaaagggatccagtttcaggtttctatatatggccagccagttttcccagcaccattttttaaatagggaatcctttccccatttcttgtttttgtcaggtttgtcaaagatcagatggttgtagatgtgtggcattatttctgagggctctgttctgttccattggtctatatctctattttggtaccagtaccatgccgttttggttactatagccttgtagcatagtttgaagtcaggtagcatgatacctccagttttgttcttttggcttagcactgtcttggaaatgcaggccttttttttgttccatatgaactttaaagtagattttccaattctgtgaagaaagtcattggtagcttgatggggatggcattgaatctataaattaccttgggcagtatgagcattttcacgaattgattcttcctatccatgagcatgtaatattcttcgatttgtttgtgtcatcttttatttcattgagcagtggtttgtagttctccttgaagaggtccttcacatcccttgtaagttggattcctaggtattttattctctttgaagcaattgtgaatgggatttcactcatgattttgctctctgtttgtctgttattggtgtataagaatgcttgtgatttttgcacattgattttttattctgagactttgctgtagttgctgattagcttaaggagattttgggctgagacgatggggttttctaaaaatacaatcatgtcatctgcaaacagggacaatttgacttcctcttttcctaattgaacacattttatttctttctcttgcctgattgccctggccagaaatttcaacatcatgtggaataggagtggtgaagagggcatccctgtcttgtgccagtttttaaagggaatgcttccagtttttgcccattcagtatgatattggctgtgggtttgtcatgaatagctcttattattttgagatacatcccatcaatgcctgatatattgagagtttttagcatgaagagttgttgaattttgtcaaaggccttttctgcatctattgagataatcatgtggtttttgtctttggttctgtttatatgctggattatgtttattgatttgtgtatgttgaaccagccttgcatcccagggatgaaacccgcttgatcatggtggataagctttttgctgtgctgctgaatttggtttgccattattttagtgaggatttttgcatccactttcatcagggatattggcctgaaattctctttttttgttgtgtctctgccaagctttggtatcaggatgatgctggcctcataaaatgggttagagaggattccctctttttctattgattggaatagtttcagaaggaatggtaccaggccatctttgtacctctggtagaattcggctgtgaatccatctggtcttcaacgttttttggttggtaagctattaattattgcctcaatttcagagcctgttattggtttattcagggattcaacttcttcttggcttagtcttgggagggtgtgtgtgtccaggaatttatccatttcttctagattttctgttttattttcacagaggtgtttatagtattcactatggtagtttgtatttctgtgggatcagtggtgatgtcccctttatcattttttactgctcctatttgattcttctctcttttcttctttattaatcttactagcggtctatcaattttgttgaccttttcaaaaaaccacctcctagattcaatgatttttctaagggttttttatgtctctatttccttcagttctgctctgatcttagttatttcttgccttctgctagcttttgaatacttttgctcttgcttctctagttcttttaattgtgatgttagggtatcaattttagatcattcctgctttctcttgtggggatttagtgctgtgaatttccctctacacactgctttaaatgtgtcccagaaattctggtatgttgtgtctctgttctcattggtttcaaaggacatctttacttctgcttttatttcattatgtacccagtagtgattcaggagtaggttgttcagtttccacgtagttgagtggttttgagtgattttctgaatcctgagtcatagtttgagttaactgtggtccaagagacagtttgttataatttctgttcttttacatttgcagaggagtgctttatttccaactatgtggtctattttggaataaatgcgatgtgttgctgagaataattaatattctgttgatttgggatggagagttctgtagatgtctattaggtccatttggtgcagagctgagttcaattcctagatatccttattaactttctgtctcattgatctgtctaatgttgacagtgagctgttaaattctcccattattattgtgtgggagtctaagcttctttgtaggtctctaaggacatgctttacgaatctgggtgctcctgtattgggtgcatatatatttaggatagttagctcttcttgttgagttgatccctttaccattatgtaatggccttctttgtctcttttgatctttgttggtttaaagtctgttttatcagagactaggattgcaatccctgcctttttttgtttcccatttgcttggtagatcttcctccatccctttattttgagcctacgtgtgtctctgtacatgagatgtgtctcctgaatatagcacactgatgggtcttgactctttatccaatttgccagtctatgtcttttaattagagcacttagcccattttcatttaatgttaatattgttatgtgtaaatttgctactgtcattatgacgttagctggttatttttctcattagttgatgcagtttcttcctagtatcaatggtctttacaatttgatatgtttttgcagtggctggtactggttgttcctttccatgtttagtgcttccttcaggagctcttgtagggcaggcctggtagtgacaaaatctctcaacatttgcttgtctgtaaagtagtttatttctccttcacttatgaaccttagtttggctggatatgaaattctgggttgaaaattcttttctttaacaatgttgaataattggcccccactctcttctggcttgtagagtgtctgctgagagatccacttttagtctgatgggcttccctttgtgggtaacccgacctttctctctggctgaacttaacattttttccttcatttcaactttgaagaatctgacaattatgtgtctcggagtttctcttctcaaggagtatctttgtagtgttctctgtatttcctgaatttgaatgttggcatgccttgctagtttggggaagttctcctggataatatcctgcagagtgttttccaacttggttccattctccctgtcactttcaggtacaccaatcagacgtagatttggtctttttacatagtcccatacatctttcagactttgttcatttcttttcactcttttttctctaaacgtctctttttgcttcatttcattcattgcatcttcaatcactgataccttttcttccagttgattgcatcagctactgaggcttgtgcattcgtcacttagttttcatgccatggttttcagttccatcaggtcctttaaggacttctctgcattggttagtctcattagccatttgtctgattttttctcaaggtttttaatttctttgccatcggctcaaacttcctcctttaactcgaagtagtttggtcttctgaagccttcttctctcaacttgtcaaagtcattctcgatctagctttgttccattgctggtgaggagctgcattcctttggaggaggagaggcattctgatttttagagtttccagtttttctgccctgttccttccccatctttgtggttttatctacctttggtctttgatgatggtgacgtacagatggggttttggtgtggatgtcctttctgtttgttagttttccttctaacagtcagggccctcagctgcaggtctgttggagtttgctggaggtccactccagaccctgtttgcctgtgtatcagcagcggtggctgcagaacagtggatatttgtgaactgcaaatgctgctgcctgaccattcctctgaaagttttgtctcagaggagtacccggccatgtgaggtgtcagtctgcctctactggggggtgcttcccagttaggctactcaggggtcagggacccacttgagaaggtattctgactgttctcagatctcaaactgcatgctgggagaaccactactctcttcaaagctgtcagacagggacatttaagcctgcagaggttactgctgccttttgtttgtctgtgccaagcccccagaggtggagcctacagaggcaggcaggcctccttgagctgtggtgggctccacccagttcgagcttctggccactttatttactactcaagcatcagcaatggtgggcaccattcccccaacctcactgctgccttgcagtttgatctcagactgctgtgctagcaatgagtgaggctccatgggtgtaggaccctccaagccatgtgtgggatataatctcccagtgtgccatttgttaagcccactggaaaagggcagtattagggtgggagtgacccgattttccaggtgctgtctgtcacccctttctttgagtaagaaagggaattccctgaccccttgcacttcccaggtgagataatgcctctccctgctttggcttatgcacagtgcactgcactcactgtcctgcacccactctctggcactccccagtgagatgaacctggtacctcagttggaaatgcagaaatcacccatcttctctgtcgctcatgctgggagctgtagactggagctattcctaattggccatcttggccaccgcccaaaacaaaatattttcatactattggttcactaatctactttcaattatcaataaagctatatcattagagccattgtaaaaaatctaaaagcatatatatttctaaattcattttatatattttatagtactgaacagtttctaataagtttatttgaatgttcgagtaatctcaatatattccagaataaactgcattctcccaaacaataggctatatagtaaagcataaaaataaggataaatacaaaggtgcaaactcatgttagttgtacctctaccctgaccctctcctattttcctcaaaatttcaccatttactttcatcttccagtttttttccagacatttttctctaaatctttttgttgctgttgttcctctcacttggccccctttactttttcttctacacacctcttctctacactgtcatatattcctgactttggaatacaaagaatacaagaatggaaagagagtaatacctaatctcccaacctgaggactcaccacgtcactagtaaggagagaaagaaattgcattctagtttgttcaagtgccttaataacctaaagaactacaagcaatcatctttacttttcttaatactcataactttatgcattgtcacttttcacatggagcatttccttttccagaaaactgtctactcatgagggtaagaccaatgttttctgctttttttaattttttttttgagacggagtcttactctgtcaccaggctggagtgcagtggtgcaatcttggctcactgcaacctctgcctcctgggttcaagcaattctccttcctcagcctcctgaggtcacaggcacacgccaccatgcccagctaatttttgtatttttagtagagacaagatttcaccatattggcccaaaaaacggtgacttacatgtaatagatccccaacaaacattgtctaattatacaattgttgaaattctcatcctttatgcccacagaagaaacattatggacaactctgaaaagaggggctagaatcagaatcaattgcactacagttctaaatgaaagcattgtgtgtttttaacatactgtgcatagggagctattgtgagggcattaattatgtgagcatgtctattttattggacaaatgttgctgacctattgatgtaccaatcaagtatctccttttttccatctttcgaacaagacacagtagtccacattcaagttgtgaagccaaaaactcgtgggttcagatctttactcagccatttaatagcactaagacattgaacaagtcatctgtgtgatcctccattttctcctaaatattattatctatgataatatactctcatagtgttgcaaagatgaggctctatctgactaagcacttatcagtctggtccagaatgttgattcataaatggaatgagatctcagcagggcagcagcaacagaactagcagtaaatatagctacctacgtgctatctggacttctgatgttaataaaaatgtattaacaaatactctgtagctttcctttgaaactgaatcattcacagttatacttgattataggatcccatatttatttccttggttttgataagagaattccttataaagggttgcatttctgtatccaccacagaacttatttctgtactaactgaaaaatcttttcaaatgcaagcaagatacatacacacattacatatctatagctttcttcaaaatgttccaaagaaaggactaaagtcctagaagtcacaaatgaaaaaaaaaaatctgttttgttcttagttgattgtaaacctctaaaaatgtcttgatacttttgacacatttacagttttctgttccaccttctcacctgtcatcctgttacaggctttttaaatcacattttcaaaattacacttttaatactcagcttcacctcacaatatcttaacttctcaacatcagcagtgtcttcctttcttagccacatgctttaccatactctaaaatttattcaccatttgatgatgttccactgtcaaacgctggaaatacaatattcttttctgaccaaacccatccatccttgcgctattctcattctactaaaattagtgagcctgctattcattttcatcccgctcttcaggctctcaaatcttacgagttcttattctgttcatctcgtggagctgcccttgctctctttctcagcccagattaatttatgtcttcatattcactacctctggaaagctcatcattttgttttatacaaagtggatgccttgctagtctctaaccaagtaatcctcagctgtttccttaacccactcagattacaggctaagtgttgctagagaagtgatgtaactgtgttgactaaagtgacaacaaatgttaattttgccaagttcctcattatggctctacaatcttttctgtacttcatgcttatttcctactacactcccctggctcctatccccataccagttaatctcaagctaggacctcatttacaattatctgagaagactgaagtccccattagatggcaaactctttgcaattagggttgttatcagttgttttatttaccacagaatcctcatcctccagcacagtacttacaaagaaaatgctcaaaaaaatctgttaaataaataatgagttacttagtttaagtaatgaactgattcaattcccttcctcttctgagatgtgaccagcctctccctgtgctactactaatcacctaaccttcttagaacatcctgaaattgaccctgaaaaattattttcctttctattatacctccgcctcttcctgcaaggggattctatcctgaaaaacataaatatacattcagattttccttattgtggctttaaaaatatcctgccttcagtaatattaattactttcatgagtaatatttccttcccacaatttaacattaaacttttttttgtctccatatcttcaagatcccagatggccttaaacatgggcaattggacttctgcttctatttaacctcaataaacatatttttttctcagtggcaactaatagactattcaactttctttatgaaaaaaattcaaatagatggaatacttgaaagaataatacaataaaaccagcataagcactccctgattcaaagttggttaacaaatgattatttattttacatgcacacatacacaaccacacacacacaaacacacactccctccctcctttgatgactcataagaaattcagttgtgggctgggcacggtggttcatgcctgtaatcccagcactttgagaggccgaggcaggcggatcacgaggtcaggtgttcaagaccagcctggtcaacatggtgaaaccccgtctctactgaaaacacaaaaaatagctgggcgtgttggcacacgcctgtaatcctagctactcaggaggctgaggcaggggaattgcttgaatccagcaggtggaggttgcagtgggccgaaatcatgccagtgcactctagcctgggcaacagagcatgactctgtcaaaaaaaaaaaaaagaaaaaagaaaagaaaaaggaaaagaaagaaaattcagttgcctgtatcactgcatatttatcccaaataattcagcacacatctcctaatatgatttattttctagcccatatgaaaaatttcccaattctaccaaaatttttttatagaccgcgtttcaaaaaagtgaaataaaataaaacttcaagcactgcatttgtctgtcgttagtcccttttaatctggaaaagtccctccacactggcactaactttttacaagtctaggccacagggctggtatgtatcttcaatgtagaatacctcaccttatgcatttgtctcattatttcctcatgttttagtttaactggccctttctctgaatttttctataaacgggaagttaaatctaaccaggttttattagattcaggttagacattctagcaacaacatttcacaaatggcactgtagccttcatatggcatctcctcaggaggctcatggtgtcaggttttctagtggtgatgttgggttaaatcattcagtcacttaaaatgatgacttgcagatgcaattaatacttgagcactatgagaatacattattcaccaaaataattttaattgatgattttatcacttgatcatctttgactgaatcacttacttcactgagagttacaaacagtaattttctaattcttacatttcttacacttaactcacattattttgtgaaaagctgtccctcatcaactaagaaaggcaggctaatcatttaattatttcaatttaattattgtcatttttcttttttatttttttatttagagtatcattacacactcatggattttactttattcaatgtttacaatatgttaaattcactcttgaaattcaaactgatttaaattgcacaactgtaaggcccttcaagctagcacttgtttacaatgatacagccttatttgtcgttgaccatttccttactttgtggtaaaatgagttctcccaggctcatcttgtattttttctgcccagaattagagtcagccaattctaggttaaggaagaccaaagggttcttgtcctcttgagtggagaatgatattaagaagccctgctttgtgcgctagatgtgctcattgcttcctgaaagacattgctttgaagatttttcagtagacatagctagtaaatatatttatttttgaaagctttatagtgtattttattatctaattggttagccccctcttttctttctcagaatattctctgctatttttacatataaatatacatttcaaatcaatttagctaattccagaaaaacttcctactggtcctcctatttagatcatgttaccaccatacacacacacacacacacacacacacacacacacacacgacacacacaatcctgggaacaacagccctctttatgatgctaccacatcatattgaggatcatcaatcacattcatttagtttcttctcaaaattcatggattttagtgatggattacaaagcttttatctcaggccttaccttcttttgagcctatgcaacattagctctgttgaataatacttacatacacacacacacacaccatacactttttctgagtttcagtggctatcatcttaactctatttttctgccttttatcagccccttttacatccactaaaaaaaaatgcagatgttcccaaatttctacttgtgcaggacttattcccacttaagagtttcaatgtagatgatactgtcatatctccttctaatcttaaatgtcttcccagctctagacctgaatttccattgcacattggtcatttaatccagaagttaacgtcagaacttcaaattactatgttcaaaactgaatcattttcccacctccaaccaaatcaggctctcctctagatatttctttctcttgttttgttttataccacctgttttcaagatatccagattccaaaattcaaaggcagcatttaaccctccttatactttgacctctaaatccactgattttatcaacttgtggacttatgatcaagtcttcaaaatccatctcatcatgttcattcacactgtttccactatagtttatgtttcccattctgcattgaaaatattcactttttcaagttccaaggaaactaatgatggaagactttcttacacatctgaagaggcaactaagcacagaatcttcaaataatatgttacacttatatgcgtttttttactaacaaacataaaatgagcttgaaaaatgtcacatccaaatacgtgtaacagtaaaattgtgaggtggtatgatgttgacggtgagatgttggtagacagacaagaaagacacctatatttatagagctctgtgttatgaaataattaactgttcagttttccttgcacaaaagactaattttccacatcacactgcaaaacttcaagagtagagattacattttgtactcagtaagtaaatgttcaatgtgtttcccaagctctgtgcaaagcaactaaggacagagaaccatctcttctgacccaaccacagaacgacagtggtaactcacaaatgtgatgccatgcattggctctcttcagaaaacctgtcttggagagacatgtgatgacatggtcacaggaaggtcctttcacgaccagttaagagtatctatgtgggacaattttcttttgtttctgctcaaagcacccactagtggtaagcactcactgttgaaaacttgccaaactacagacattttaagtaatgtctcaagaataaataaatagcagttgttttatattaggaaaaacaaaagaaacaaaaaaatcctctccgcaaatgaagcatccctgtatagaagaaaaaacatgaggtgtcagttaagacttcttgtatgtcagatttccctttaccacctgtggagctctgagctccaagtctcagtttcctccaacatataaaataatattattatctaatcatggaggggaagtacaaatggaattgcattcatttgacacatcagtttctttccctgtcatcttgatttagtgaaaaaatagctgttccttactcgcacctgttaataatttctgaaatgactcagaaatgtgttgcccctcttattatttagcatatggctatcaaaaggtgtataaaaattttctctaaacacatggattatgtatgaatgcaattaattcccactctgaagtttggggaagaattcaaccatattattctaagcaaaaactatattagtgagttaaatggaattttaccaaacatatttctgcacagcaaatctctagtgttttgtgatataagagcacttggggatgcatgctattgtatcttccagaagaccagtgcaagacttccatgctctactccagaattttcctctctatttagatttttacatggtcaaataaataactcttgaagtcttgaccccaactgagaaatctgcaaagacagtccagaaaatataaatcctaaatactaaccgaagtcctctgactgccatctctgtggctacaaatggatagaaaaagacattaaactaatgcctctttattttccaggactcagtcccaggaaaatagcaagataattcaaaactaacaaacaaaaatctttttaaatgtacggaagaatttagaaaaacacaaagtcaatttgccacaaggtaagtttgatatttaacataagtctaacaaaagaaaacaaaattcccaatgtattatcaaaaatcttaaagcaatgaggataaacaaaactattaaagttggcaacagctgtgttagatctatgtagtctgcagatcaaaatttaataataaaaggaagggtgatgacacataaaattatgtaaacttgttaacagtgtaacttgctattgatacattcagaaatcaggtattacttacatgttattgaatattgttttcaaaatcatgatgtagcaaaacaaactgtttttattgccaataaaatgaaagtttatgttgcctgccaattactgaagagaaatttattaaatcaaagaatcatactgaattatgaaaatgggatctttacaagcatttgtacaagtcactggcagtagtagatagtagtactaataagagaataataacaataactgcagatcgatacagacctttttaaacataatattatttactttctggaagtccataaaaatttgaagaataaaattaatcattacttcaggttttcatagcaaaacacagagttttcataatgacagtatgataaaagaagtaaagaaataactattttttaaagtctcagctaatcatcatttaaaaataaagatttcatggctgataaaattatctgtacaccaaacccctgtgacatgcaatttagccatgtaacaaaactgtacatgtaccccttcaaactaaaagttggaaagaaaaaataaaaataaacaaataaaataaaaataaaagtttcaaaagtcagagagaaaaatcaattgtaattgaaatatttttatcaaatttgttcttattattcaaactatcttatatatccacttctcttctacttccataacggagctttttgaagacttgaaatatagttatatcaatgaatgcccaggttaattagttgcttacactatcagtaaacagtaaacaaaacatgaccacattcttactgggatagagttgcaaaaatgcaacagacatatacttctcactggaatttctatatacttattactggctcttaaaataagtaaatattgcatttaagaaacagctatccaaatatttcacatttcttttaactaggaagaaaatatttagcatatcaaattatttttctaattaacaatttatgtattctgaagacatcatttttttgtattgttatagtagctgttttaatcactagactttcatacaaattagagaaaataaaccaactaccatttttaagaaaggtaacacatctattatggctaaggatgtgtctttataattgtatgtttggaacttttcccccttgtatatacaccaccacggtgtggctatttgatgcatgttaagaaaaaaatcagggtgctacttgattgtttatgaccatgaaaaataaatataaaaaataagtgttaatcttcaatgatgaaaagttattcatttagatattcttggacagaccacacactcaagacagaattccaaatagaactttctttctttatatcaagactgagacagacattgcaaaattaatttagtaatccaagattttaaacaatacctatattttagcatcccatagaaagttctagaaaatttagcaggttttcagtttgtgattatttctttgtcacagtttaaatagtaaactgtttgaggtcagagagtgatccaatgccaattcactttgtgggtcttctttccttccgtccccatcgttatcttggaaaccctctctccttacaaaatagaaacttttttccctccttctctctcagtaagcagttgaaaagatctgcacaattaaattgatctaaatccctgtgggttgcttggtgaatgaaaaaataaattttttccatgagaagccagtaggtggtgctaaatctaggatactaccttcaacaattttaaaccaaaaactaaacaagtggccagtttaagagttgtagaattcccagtatgattcacacaggaagaaatctgaaaattttgaatgtaatagaaatgtaataaaagtatacaatataattaaagatgaatcttaaataaatgaaaacatagatatctaaatgttcttagaatgatcttaagttacagaaattaaagcacagctacctctctgtcctcacattaaaatcgtcttcggtcccattaatgatttcaatctcattgggaaatatgtccaattgcccatgtttaaggccatctgggatcttgaagatctttatatcagatacaaccacattaatattctacgatagaatcttgctaataggattataagcagtcaaaaaggttaggaagaaatcatctgagaaagtcactccctaatattaagaggatcaattagccaggcatatttggggatagaggatactgtgcagtaaccaggggcttatgaagaaaagaggcggggggcaggatttatttattttggttagggaggcattgtggacttccaaataaaggttccagaaaaggacttcttaacttctgttaatacaaagtaaatgactttatcatcctcaaagcttttcttggctccccactgactgatttcttggctatcaaaaaataggttaaacctgtttaatgtgttttcacctgagaattaatacaaacttggcctgtggtgggaccaagttcagaggcctttcacatatctctagtgatctcttagggcctcaaagttggaaggaacttttgcaggaagtaaggtccctggatgtattttaagtgagagctggcatttactccccagctaagagcatatagtcctatccactgagacatctttgttcaatctctgagctgacatcccaaagtcaatatcttcttttacttaagccatagaaaaatggagaaatagtggaccaacattgcatatagggtctcctcctctagaaacttctagccagtaaggatgtgtgggttaaggagcatgccctggcacatattgggcagctttctacagggtaggttatactgatgctatacattttaatgctgagacttgaactctgagaataaaaggatcagatttgactctgtgaaaatctggtcataaaaaaaagaagaattcagccaggcctggtgactcacgcctgtaatcttaacactttgggaggccgaggcaggtggattgcttgagccccaggagttggagactagcctgggcaacttggcaaaaccccgtctctacaaaaaaataaaaaaatagctggatgtggtggcaggcacctgtagtcctagctactcacgaggccgaggtgggaggatcacctgatcccaggaagtcaaggctgcagcgagccgtgattgtgccactgcactccagtgtgggtaatagagtgagatgcagtctcaaaataaaacaaaataaaatgaaaaaccatgaattccatttttaacattgttacaagattttaaaaattatgtttcatattgagtattttttggtagtttgtagttttcaaggaattggtccatttcatccaacttcttgggattatatacgtagagttgcttagtatttccttactatccttttattaggttttttttttttggttgtttgttttttgagatggagtcttgctctgtcacccaggctggagcgcaatggcacaattttagctcactgcaacctgtgcctccctggttcaagtgattctagtgccttggcctcctgagtacctgagattacaggtgcccgccaccacgtttgactaatttttgtttttgtttgtttgtttgttttttgttttgagacagagtcttgctttgtctccaaggggggagtccagtgaccgatcttggctcactgcaacctccacctcccgggttcaagtgattctcctgcctcagcctcccgagtagctgggactacaggaacccaccaccacgcccggctaattttttgtatttttgtagagatgaggtttcactgtgttagccaggatggtctcgatctcctgacctcatgatccacctgcctcgccctcccaaagtactggaattacaggcatgagccatcatgccaggcctaatttttgtatttttagtagagacagaatttcaccatgttgcccaggctggtcttgaacccctgacctcaggtgatctaccctcctcggcctcccaaagtgccaggattacaggcatgagccactgcacccagccttgttttgttgttttgttttgttttgaggttttgagacggagtttggctcttgtcacacaggctggagtgccctgtcacaatctcagctcactccagcctccccctcccaggttcaagcgattctcctgcctcagcctcctaagtagctgggattacaagcatgagccaccatgcctggccctctttttttaagacagagtctcactctgttgcccaggctggtgtgcagtgacatgatctcagctcactgcagcctctgcctcccggactcaagtgatcctcccacctcagcctccctagtagctgggaccaaaagcatgtaccaccacgtctggctaattgttgtacttttatttatttatttatttatttatttatttatttatttattgttgcacgagggggcaggtggcaaggtgccacacctgagtggggttggccagatttttctccaatcgcgaacctcagtggtgcaatgggagatgaacacgggaaggctatggcctcacgggccctgtgacattatggcaggatccagggaagggaagcaaagcaaagtaacaggcagcagactgtggcaagaatatggaatgcatcacaaatttgcatgtcatccttgtgcaggggccatgctaatgttcactgtatagttccaatttgagtatatgtgcttccaaagtgagcacaatttttgtgctttttgtagagacagggtcttgctatgtcacccagactggtcacaaactcctgaactgaagtgattctaccaccttggcttcccagagtgctgggattacaggcatgagccacagtacctagcctcaaatggaaaatttaaaacaaaaatacaataacaaaaatttaaaactcactagatggactcaattaatgctatgaagaggaggaagagtcaggagacaagggtggattgatagaaagcactcaaactggccaggcatggtggctcatgcctgcaatcccagcactgtgggaggctgaggtgggtggatcatttgaggtcagaaatttgagaccagcctggccaacatggcgaaaccccgtctttactaaaaatacaaaattagccaggcatggtgacacatgcctgtaatcccagctactcaggaggctgaggcaggagaattgcttcaacccgggaggcggaggttgtggtgagctgagatcgcaccattgtactccagcctgggcaacaagagcaaaactctgtctccaaaaaaaaagaaaatagtacctaaactgacccttgacagggaggctcacgtgtgtaatcccagcacttcaggaggcgtacgtgggtggatcacctgaggtcaggagtttgagaccagcctggccaagatggtgaaatcccatttctattaaaaatagaaaaataagctgggtgtggtggtgtgtgcctgtaatcccagcttctcagctatgcgggaggctgaggcagaagaatcatttgaaccagaaagtcagagtttgcagtgagctgggattgcaccactgcactccagcctggtgacaaagtgagactccgtctcaaaaaaaaaaaaaagccaggcacagtggtgagtgcctgtaatcccagctacttgggaggctgaggcaggggaatcacttgaatccaggaggcagaagtggaggttgcagtgagccgagatcacactactgcattccagcctgggtgacatagtaagacgctgtctcaaaaaaaaaaaaaggaggctggtggctactggggaacacacctcaggggatactgcggtggctgctgcttcactcattccttccttcattctttttgtatctttggagcatctattctgtgtctggcactactctttgttgggggatagaagacagggtaaccttggggaggacagaggtgggtcagggaagtagcggctgctacttgagattacaggagtgggtgtgtcccaaggttccagaggcaagggagcttaggcaggaaccctgggaaagagggaggaagaccctgatctaatgactgcctaccacgtgtcaggctggcaagcgctgtctcacagcaaccctgcaagcttggtcctgttttcctcactttgcaaatagagaaaataaggtacgtgcacagttggtaagtggtagagccagttctgaggctgggttggcctcactccaaatcccatttcttttatttatttttttttatttttttatgagatggagtcttgctctgtcacccaggctggattgcactggcttgatcttggctcactgcaacctccgcctcctgggttcaagcaattctcctgcctaagcctcctgagtagctgggattacaggtgtgcaccactgcacccagctaatttttgcattttttcgtagagatggggtttcaccatattggcaaggctggtcttgaacccctgacctcaggtgatccacccgccttggcctcccaaagtgctggaattacaggtgtgagccacagtgcctggcctctttttattattattattttttagagaaagggtctaaccctgtcacccaggctctagtgcactggcataatcatggctcactgcagcctgaaccttctgggctcaacctatccccctgcctcagcctcctgagcagctggaattacaggcatgcaccaccacacctggctaatctttgttttttgtagagatgggggtcttactatattgcccatactgtcctcaaactcctggcctcaaacaatcctcctgcctcggcctcccaaagtgctaggattacaggcatgagccagagcgcctggcttgaatcccatttctttccaccatcacaaggaacagaactagtccttcagcagcattgttccttgggatgtgtctgcagaggctttggagacaatgagaggcacccagtgaacagggagggaaggggatgaaggaagggcactggctttttcagacccttctcagggaacagggaagaacacactcattcactccttcattcacatatttagtcaactttttttagagacaggatctcattctgccagcctggctggagtgcagtggcacaatcatagctcactgcacccttgagctcctgggttcaagcgactgtcccacctcggcatcctgagtagcttggagtacaggtgcacaccaccacacttagctaagtttttaatatactgaagagatgggatctcactatgctgcccaggctggtctcaaacttctggcttcaagcaatcctcccaccttggcctccaaaagtgctgagattacagatgcaagccactgtacctggccatatttagtaaaatccttactgagccctatggggtgccaagcatggtgtccaggtgctggggatatgcatgcgtgaggctgacacgtgcttaccctcatagagcttccatctgataaggcaggcagacactccagcatgctaagtggtgtgacacgggctcattgtgccccacgaggctcagagaattatgtaacacagaattgcatggtggagggagacttcttggaagagtttactgctcatgaaatactgggaaggctgggcgcggtggctcacacctgtaatcccaacactttgggagcctgaggtggctggatcaagaggacaggagatcgaaaccatcctggccaacatgcctgaaacctgtctctactaaaaatacaaaaattagttgggtgtggtggcttgtgcctgtactcccagctacttgggaggctgaggcaggagaatcgcttgaacccaggaggtggaggttgcagtgagccgagatcatgccactgcactccagcctacgcgacagagtgagactccatctcaaaaaggagaaaaaagaaatgctacgaagagccttctggaaagttacatacaggagggtctgctaatggcagagctgattgatcgcagtcacagctgacatgagcccagtgctgtctggtaacagtatgtggtgtggtgggtgacagggaaaaaggctagaagcagggccagggcattggggcctgacaggccttgtaagaagttcagactgggtccagggcaataaggggaaaccagtgaagcgtgtgaagttgggggtgatgacctgcgaagcctgagtctgcaacacaaggggagaactgtccaaaggtttgccaagttcaggccaggcacggtggctcatgcccgtaatcccagcactttggaagtctgaggcaggtggatcacccgaggtcgggagttccaggctggcctggtcaacgtggtgaaacctcttctctactaaaaacacaaaaaattagccaggcatggtggtgggtgcctgtagtcccagctacttgggaggctgaggcacgaggatcgcttgaacccgggagacataggtttcagtgagtcaagatagcgccattgcactccagcatgggcaacagagcaagactctgtctcaaaaaaaaaaaaaaaaaaaaaaaaaaaaaaaaaagcagcatgcaggaaggtctgccggtggcagaggtgagtaatcgcaatcgcagctgaggtaaacccactgctgtttgaaaacagagtgtgtggggtggcaggtgacagggaaggaggccggaagctggaccagggcatccgggcccaacaggtcttatgggtcctgggcaataatgggaaattggtgaagtgtgtgaggctgggggcgatgacttgtgaatctagaggctccagcacgaggggagagctgtccaaagatttgccaaactcgggcagaacggtgcaagagtgagcatgtgagttctgtcttttttttctcatgaaccaaggtttctaagaagggcacagagcagtgagcaataaagctaggagtgactaagggtgatccaagtaggagctgccagcgccaggtgccagggctacagtttctagctttggagccaactttcctgagcacacatctccctcttgtggccgagagcggtattgccactgaagagatagtgctggggaccccctccagactctcattctgaaaaccccaagatataggccaggggccgaatctaccttgtggaccccatgagatttcccacttcgtttttagaaaaatgtgattaaggccgggcgcagtggctcacgcctgtaatcccagcactttgggaggccgaggcaggcagatcatttgatgtcaggagtctgagaccagcctggccaatatggtgaaacctcgtcgctactaaaaatacaaaaattagccaggcgtagtagcgggtgcctgtaatcccagctatttgggaggctaagacaggataattgctcgaatctgggaggcagagtttgcagtgatctgagatcgcgccaatgcactctagcctgaaaacagagcgagactccatctcaaaaaaaaaaaaaaaaaaaaaggaagaaagaagaagaaaagaaaggaaaagaaaagaaaaatctgattaatggggaaaatctatatgtatacttagaaaaaagtgcagaaggacactgaaatgttaccagtaattctttcaagaatatgtgactttttttcactttatctgtctttttttttttttttttttttgagatcgagtctctctctgtcgccaagccttgagtgcagtggcgcgatttcggctcactgcaacttccgcctcccaggttcacgtcattctcctgcctcagcctccggagtggcttgggactacaggtggcagccaccacgccctgctgactttttgtatttttaatagagatggggtttcaccatgttaaccaggatggtctcgatctcctgacctcgtgatccactttcctcagcctcccaaagtgctgggattaaaggcgtgagcccccgcgccaggctatgtatttcaaaatgttctatttcatgcctgactttcgttgataagacaaaaaatgtattatgattgaaaaaaaaagaaaagaaaagatgcagggcgcggttgctgatgcctgtaattccagcactttgggaggccgaggtgggtggatcacgaggtcaggagttcaagaccagcctggccagcatggtgaaaccccgtctctattgaaaatacaaaaattaaggccaggcgtggttggtcatgccggtaatgctggggcactttgggaggccaaggcaggcagatcacaaggtcaggagatcaagaccatcctggtcaacgtggtgaaaccctgtctctactaaaaatacaaaaattagccgggcgtggtggtgtgtgcctgtaatcccagctactcaggaggctgaggtaggagagtcgcttgaaccagggagtccgaggttgcagtgagccgggatctcaccagtgcactccagcctggtaacagtgagccgtctcaaaaaaaaaaaaaaagaaaaagaaaaaaaaaagccaggcttggtggtgggtgcgaagattaaataatatgctctatgcaaatgaatttactatatagtgagtgctcaacaaaacttagcaactattatactgatggtccctggcttggagaactcatagccagtgcacagccagatatgtaatgtcattaaggaagaagagcccactggtcttcactgtgccccacttctgtcctcttccagagaatactcagaaaacaggtttgactgcattctcctcagtcctgcctccctttccttccctgcaccctctccctactggtagctgaggtagctgtagggtgctgaagggctgctggcctgtctccaacagcactgtgatcaggagttgggggaagtgggaccagctggaaagactctagcaaatgactggctgtagtgggcaagcagctgggcataactgaggaggctcttaggcactgccattggcgtttatgactcttccttggaaggtttaaagaaaaaaagagagatatctgtcttttggggacaggtttagaaatcacagtttctgggaggtggctgggaggatgtcccaagtcctctgagtttgtttaatgctgggcagaaaatgccccccaccattggatatcacattggacaaggctgttggtggcatgtggaccaagggaggcttcctagaggaagaagtgaggtataaaggatgaataggagtttgcaaattggatgatcccagaggaaggcattctgggcacagaagacaacacctgctcatgcaggtgatctgtcccatcctttctgtttctggtacaactgcactgtgtttgctgcagtccaagtttctctagggcctgcttagtttattcccactggctgagacctgatctgttgttctaggcagtgtcaccagggttgttttggtggcagtgctcactggaaaaggtacagccttataatccacaaattcaaatactgaagatcttgggggaagggtggagagtacatgggtaaagagagtacctgggtaaagggaatggcaggaaggcacaagatacaaggatctctacatagggacagattgaaacatttagggtgattaatcttgtgatcatggtgatggttccacgggtttctacatgtgtcaaaacttatcaaattgtacatttaaataggtgcagtttattttatatcagctttacctccacaaaacggttaaaaagaatatagatgcctcaaaaattttggttgctttacaaacgtatgtttctaaagcataaaactaatacaggataatcagacaaatttaaaaatttgtgaaagcaggaaaaagataaatcactcatttcatttttgtgtatgttggggggattgttttcaacataaaaaaagacatccagggctcaccaatgaacaaggctgtagtcccagctccagtgggccaagatgcttcattgaactgagcagtgtcccctgcgggcttgggtcctggcaatgtccagctgctcccactcagtgattgcagtgcagcaggtctgagaaggagacccagaatctgacttaaatccagtgactcatgttattctcttccagccagtccacagaccactctgtgaaatgctgaaatagggaatgaatcacaaatgccttgatctattttcctttggccatatccatgctaaaaatcctcctgtttacagatgtggggttgccactgtgtcttgagatagaactatctagctctagtcttgggaaatcttgtagtaatagcagaactggtagaatattaatagtaatggtggtagtaatattaatggtagtaatagtagcagtaatttttaaaactttttattttttgtgggtacataataggtatatatatttatggggtacatgagatattgtgatacaggaacacaaggcataataatcacatcagggtaaatggggtatccatcacttcaagcatttaacctttctttgtgttaccaacaatccacttatactcttttagttatttttatatgtacaataagctattgactgtaattaccctgctgttgactgtagtcaccctagatcttattcattctaattatattgttgtccccgcactgccccccgccacacccagcctctactctctatctcatctcatcattctacctctgtctctgtgaattcaattgttttaatttttagctcccacaaataagtaagaatatgttaagtttgtctttctgtgcctggcttatttcacttaacataatgacctccagtttcatccagtttttgcaaataacaggatgtcattcttttttatggctgaatagtactgcattgtttatatgtacccatttggtttattcatttgtctattgatgagcacttaggttgtttccaaatcttggctattgtgaatagtgctgcaataaacatgaaacagcagatatttcttcaatatattgattttcattctcttgagtatatacctagcagaaggattgctggatcatatggcagtcctatttttagttttttgaggaacctcaaaactgttctccacagagactatactaatttacattcccaccaacagtgtacaagggttccattttcttcacatttttgtcagcacttgttattgcctgtcttttgaataaaagccattttaactggagtgagatgatatctcattgcagttttgatttgcatttctctgatgatcaatgatgttgagcacctttttatatagctgtttgccatttgtatgtcttcttttgagaaatgtctattcagattttttgcccattttttaattgcattattatatttttttcctgtagagttgtttgagctccttatatattctggttattaatcctttgtcagataaatagtttgcaaatattttctcccattctgtaggttgtctcttcactttgttgattgtttattttgctgtgcagaagctttttaacttgatgtgatcccatttttctgtttttgctttggctgcctgtgcttgtggggtattactcgagaaatctttgcccagtccaatgtcctggagagtttctccaacgttttcttgtagcagtttcatagtttgaggtcttagatttaagtttctaattaattttgattttatttttgtatatgaaaagagataggggtctaatctcattcttttgcatatgaatattcagttttcccagcactgtttattgaagagactctcctttccccagtgtatgttactggcacctttgttgaaaacgagttcactgtagatgtatgaatttgtttctgggtgctatattctgtttcattggtctacgtgtctgtttttatgcaactaccatgctgtttttgttattatatctctgtagtataatttgaagtcaggtaatgtgattctgtagtataatttgaagtcaggtaatgtgatgttatttttgctcaggatggctttggctattctgggtcttttgtggttccatacaaattttaggattgttttttctatttctgtgaagaatgtcattggtgttttgatagggattgcattaaatctgtagattgcttctggcaatatgtacattttaacaatattgattcttccaatccatgaacatgaatatctttccatattttgtgtcctcttcaatttctttcgttaatgttttataattttcattgcagagatcttacacttctttgattaagttttgttgttgttgttgctgttatttcaactactctgtctctatgatacctttggttaagttaattcctaggtatttaattttatttatagctattgcaaatggaattactttcttgttgtctttttcagattatttgctgttgccatatagaaatgctagtgatttggatatgttgattttgtatcctgcaactttactggatctgttgatcagttctaatagtttttttgctggagtctttaggtttttctaaatataagatcatatcatctgtaatcaaagataatttgacttcttcctttccaatttggatgccatgtatttctttcttttgtctgattgctctactaggacttcaatagcagtaatgttagtggtagttgatatggtttggctctgtgttcccacccaaatctcatgttgaattgtaatccacagtgttgggggtggaacctggtggaaggtgattgtattgtggggacagatttcccccttgctgttctcatgataatgagtgagttctcatgagatatgattgtttaacagtgtgtagcacttcccttttcactctccgtctctcttactccactatggtaagatgtgctttcttcccctttgccttctgccataattgtaaatttcctgaggcctcccagccatgcttcctattcagcttgtagaaccgtgagctgaattaagcctcttttctttataaattacccagtctcaggtagttccttatagcggtgtgagaacaaactaatacagtagtaatagctcacatttattgggcacttactaataaatacatccatcgcactgtttcaagagctttacgtgtcatctcagtactagttgttaggagcaagttcctgcaagcacatgaaaagatgcttgcatatcatctgtaatcaaagataatttgacttcttcctttccaatttggatgccttgtatttctttcttttgtctgattgctctactaggacttccatagcagtaatgttagtggtagttgaaaagatgctcaaaatcacaaatcactagggaaatgtaaatcaaaaccacaatgagatgttaccttatgcccatctttggctactatcaacagaaatatgtgttggtgaggatgtggagaaatcagagcccttgtgcatttggtgggagtgtagaatggtgcagccactgtgagaaacagcatgaagtttcctccaaaagttagacatagcattaccacatgatccagcaatcccacttctgggtatataccaacaagaattgaaagcagggtcttgaagagatatttggataccaggcccacagctgcattattcacaacggccaaaaggtacaaacgacccaagtgttcgttatgggtgaatagatttaagaaaaatacataagtggaatattattgagccttagaaaggaaggaaaatttgacacatgctaccacatggatgaaacttgaggatgttatgctgcacacttaaaatagttaatgttctgtatattttacaataattttaaaacagttccaaatcccctatctctaaaattgggtgaaaaagccttccctgcctctgagagtgatgagggttgaatttgtcacatgtctaacaccctcagaaaatgatccagcccaaagtcagtgataagtgacaccattgaagagtgtgatggtctttcctgtccttctgctggctcatgttcagggatggtcagcccttgggcacagtccttcacctttctgggcctcagtttccccacacagaacagatgtgttgggacaatgcccaaggcccctctccttccctgcagtggtgttccccactggttacatgctggcatcacccttcccaggatctggaacgaaggttactgggggcagggcctgcggattttattctgctgctctggacgatgaggggtaaaagacaggggtgacctgtgctccccccaactggagaagcctaactctggcatttgatggtcctggcgggtgtgcacatatgtgcatatatgaccaagtgtgtgtatgtccacacttgggtgtttccatctatgtggcggggtgtggaggtgggaagtcctagccgtgtgtgcacagagggaggggctgctgtgctgaaggtcacagccctcattctggtcctcagatgaggaagattgaagagtctttccatatttgtcgatatcagtgttttgttaatcttttctgcacattggaaaacattataagaatgtgggtgcctgaggcctaccccagaggccctgatttaattgatctggcggtggcctgggcccaggatttcaaagctcccttggtgttttaatgtgcatccagttgggcactgctgctccttggggcagacagaggaggctcaagcccagatttgctggggctgttcccagtctgagggctgaggaagctggtgtgtgtgtgtgagggaggctacctgtaagctattacctccttgaattactgggtaaatattgacaggaggcgctcgtgtcccagcagctacctgtggttaccaggggcatattcctggctcagtgggatagatgtgtctggctggggctctagatgggccacacagaggggaagggtatccttgaaggacgcagtggcaggaccctccagtggagaacagggctcttcagacaggcatgtccatgtgcagtggaagccccgggagatgaggttgggctgaattttgctcatttgagctttgagagcttcggcagggtttctaatctctccgaatctcagtctcaatctgtgcaaagacagcagcagtgacctgcagtgttaccatgtggatgaaatgacaccatggcgcacaaagcactatcacacagcagtcagtcaataaacaggtgtttcttttttccgaatggatgagagaactggtgggctgcctggtctgttggaaggtgcctggtcttcttgctgtggcaattccatgcctcctggggaatggggggaagagactgaactcctttccttctgggtaggggctgaattgtgtgcatccaaaattcatatgttgaagttctaacccccagtagctcagaatgtgactgtatttggagagtcttgaaagaggtaattaaagttaaacgaggtcattatgatgggccctaatccaatatgaccggcatatttataagaagaggagattagggacatagtcacgcacagaggaaagacccagtgaaaacacagggaggaggcgacagattctacaagtcacagacagaggcctcagaagaaactgatcctgccaaccttgactttggacttccagcctccaggctgtgaggaatgatttttgtcattaaagctcttgcatctatggcactttaggcagccctaactgacagatacacttccccacctcaaccccactccagccctagagcacatcagccatatcagcactcaccctcctcctgcaatgtctaaatccttcatctttcccttctcccatcttccaagtaacaccagtcaccaagtcctaaagtctcccagcttttcctccactataaccttcggcctcccaggcctccttctgtgtcatcgccacagcctccaccacagacatgtctgtcagctttgcacatgagcacacgatggggcggtgttcagatcctgatgcattagactccaggagagtccagatcgctgggctggatggccagccctccatggccagccatgtctttcttccaccacaggctgcatggacatctggacagtacctgcatagtttccagaacatgccatattactctcatgcctctgggcctctgggcatcactgcctgagaccttcctctctttcctgcccatcgaactcctattcattcttcaaaggcctctttcagtgtttctctcctggaagttcttccctctttccttccagcgcaacacttcacctgtgtgtcttcctccctgccagagtgtgagctgaagacaccaggggccatgctttatttatcctcacatcccaagcatctagcccagcatctgggggcatagttggtgctcaataaatgtttctcaagtgaaggaaatgaatgagtagtttaggtcagattttttggccagagaattctttgctggggagaaggggtcgtcctgtgcatggtaggatgtttagtggcatctctggcctctgtccattagatgtaggtagccctcctgcccccactcccaagttgtaacaacccaaaacatctacagagattgtcaaatgtcccctggggacaaaatcccctttttgagaaccactgacgtaggcctgcagggagttcagaatctcttgaaattcactgtcggtacatccaagtttagtaggacacagatattgattttactagagcatgaacaggagataaacagcaattttggaggccttgtcctgaagtggattctattagaaatggtgggagggaggggtctttttctagtaataaggctagggggctttcttttcccctgagattttgacttgaatttcctgttaaattctgtgcaaagccagtgggagaagatacactttatgtaccatgcagtgactctgagaacagtcgggattacaattttcagaaatcaaattggcacctcttctgcctccctccaattaaatcccctctttaaaaatctttaactgattttctccaaaatcaccttgttcctgaagcttcccggacgcagtaagcatcataaaacactttgtacaaacctcctttcgctgggaccatccacgaagtgttggggacaccaagcatccttctgcatccttgctgtccatctgtgtctctctgcgcccagggcagcagcttaaggaagagctccctccctctcaggttggtcctgaatcgctctggtgactgcttcccatggggtgaacttgacatgtttctaacctccctgcactcagtttccccttttgtaaaagtgggtgataatatccccctcatcatgactgtaaagctgtgggcacccagcaatgccatcaccatcacaggccatggcacagagcttgtttagggaccgggtggcctgataagctgccccttctgacacgaagcacattcttaggtgaggaagctcctctcatctggggaactctcccaggcccacaagccctccttcctaatcacaacgttggctattgttgtctcctgttagatatcaaattcctttaaaaggtggcacattgtgccttagcagtagggctgccagatgaaatacaagatgcccaatgaaatttgaatttcagataaacaacaaataataaattagcttatgtatatttcaaatattgcacaggacatactatacttaaaattattcatcgtttgtctaaaatataaattcaactgagcagtttgtattttatgtgcaaaatctggcaaccctacttaccaaccatttacacctcaggtaagtacgtccattggatccttttcagagagggagtttagatagagaataattgtgaagttcatggaactacctcttgggtggtaacaagtacggtggccctgatgggtcattttgtatggattggcttaccagctgagttttgcctgtcatgaaacagctttaaaaaactaagggggggctgggcgtggtggctcacgcctgtaatcccagcactttgggaggccgaggcaggtggatcatgaggtcagcagatagagaccatcctggctaacacggtgaaaccccgtctctactaaaaatacaaaaaattagctgggcgtggtggtgggtgcctgtagtcccaaatactcgggaggctgaggcaagagaatggcatgaacccgggaagtgaagcttgcagtgagctgagatcgcgccactgcattccagcctgggcgacagagtgagactccatctcaaaaaaataaaataaaataaaataaaataaggaagcctagtttccactgaccctgtgactttatatgaaacatgcttgtaaggcttctgtgctggacaccttcctcaagatttttggcaaagaggatcaaaaaataccttctgcggatattatttatttagcattaatgtggcaaagctaggtcttagctagacatttcaagtaaacaggatcacgccacatacaattgtttgaaaccagagatttcctgtgacctccagagttttaacaagaaccagagaagtgattatttataggaacccgttaattttccctcctcccccgtttaatcccaaatacaacaaatcccggaacgtctgcagacagtggcttgtttgatagatgaagccaagaggccatcctccaatgcagttgtgctgatgagtggaggctggggcagctgccagtccatatacaataatttcaagaagctgaaaacacaactactgaagaaaaacattaacccccagcatacaatgtcttttggtcaagtctcttggagggctttgcaaatctcttctgacctcagcagcttcaaagagttcccaggcagagatggaagcacggtggctccttcatatttctcctggagaaatctattgtctccagaccctgaacatttgcttatgtttgtgtcgtgctgtttctgatgcagtttcctagtttgtaaatagacatacctatacatatgtttttatgttagagaaagcatttgcagaaattaaataaagccaatgaaaaactgtatggctttgacaattgcatattgtaaagatgtatgatatgacttgctgaaatagaggttcaatcaatctaatgatcttccactgtgctttctgactttatccctaattctgaggtttattcatctgaaatagtttctcactttttggggggtgggggtggaggatcatgtttttccttataaattgccttcagtaattgttcaacaaaactttaaagacattggcactaagtagtacaaaagtgatatgactgcaactggtaggaagatatctaaccagaaatcaacaatttgatgggtttttttccccagagtgtatactttaccacctcttcttataatcatagtaaaggttgtattgctggaatttaactatttaaaaagctctatgaaaatatattcctcccaaagccttgctgcatctcgagggtgacctttgaggaggaagcatcttgggaatagcacacatgaagcagaccagcctcttccaaaactgcctggatcagtcttaatcctcccagaaacagacgctaagatggtatgaaacatgcaaagattttattaggggaaatgcaagtgtgagagaaaatgaggaaggagtaagagaatctggaactttcagtctgcaaagcaagtttaaattggatgaaggagagagggagagaaagttgggtgaaatttctcacccaacttggtcatctttgatgaccaagatgccatcaaaggcaagtctggcaaagcagtcagggagtcattgtgctcatgctggccacaggaggagcccgcctggtctccctgctgtactcagttgtggctgggagcagcctgtgcatggtgggaagggaggccatcctagaaatgctgcctttgatttcagagcggcggtgcggcctggtcagttagcgctgccctagtgggcaggtggggtaggaaggtgtctataaggcgcattcttagggccacgctgcctaacctggccattttcctacctacctgatagggatcttctggactctttacatccgtgcttgcttaaagatacttctgcagtgtgcaataattttctgttttgtgattagttactattcataggtaatccacagatccatcacgctgcttacagcatggcaaatgtgcctcctccagagtttggttagcagattctacagctagagaaagcaaagagctcagggagtggatcaagttctgatggagtgacccagactgggctgtgtgttcccaagcgagcagagggggtaagctccctcgcgagaagtaatgcccattgtgtgttccgtagtgcatcagaggctagctctgcacttggagcctctctgccccttggcaactcaagtgcatctcactctgatcctgtggcacagcctggggaagccccgaggcctcctgagactcctgtgaagggccagcttctcttccttatggcccttgctttggcccctacatccagatctgtcagctctggtcagcctcctgccagctggcatgacgttggacccttcacttcttcaggcagaaatctcaccactctggtatgtcatccagttagcgaattcactgcagctttaaggatcacttcaggtacatccttctgccaccttgcctcgcctccctcctcactccaagttctttccaaaagcccatgtttcctggagccccgggttccccctgaccccatgccccccacactccagctctctggggagtcactgcatctgctctaagagcttctttcccagacccctccccaccaaacccacctttctcaggctccaagaattctggggagtaagagtctcctctccttatgatcattttttaaagaattcttttccgaaataatttcaaacttacaaaaaagttgcaaaactagtacaaagaatcaccacatacccagatttcccaaaggctaacagctcacagaaccacagtaaaatgagtgaaatcaagaaactgaccttgaggcactttatcgtctaatctgcaggtccctttcaaacgttgccagtttcccctcaaatgtcctttttctggtctaggatccaatttgagacaggctcacacattgcatttcattgtcacatcactttagtctcttttaatcgaaattctggtggctgggggggtcggggggttagcaacatttttctgtaaaagaccagatatgaaatgttttaggttttgcaggccatgtagtcgctcttgcggttatttttattgtttctaaatgaatgtctggcaaatctaggcaaatagattctgtagattaaaaaaacgcagtctctgaaatatttcctcattaaaagtgcctgacagccatccacatttatccagtgtgttttaagcaatgctcaggtggagtgagtgagacagtgcccatgagcacaggctcgaggctccccatcctcctttggaccaggaggagtgggcgcgtcctgaggttgagccctgacctgggcagatggcttgcagagcagctgtgtctggcttgccggctcttccacatcatttagaatggaggctgctcacgtctcaggggtctgggacccacccagccgtcccctcagtgccctccttccctcccccaatcggaatgcctggggaacaggcttcacttcagattccttctcaccccagactcttcttccccagtgtgagatgcttggaatcccagacaggcagagtcagctgaggacggtgggaaaacagggcgggggcgggcggggggcggtgtggtcgggactaagccttctcagcaatcaaagctggcattgttctcaaagagttaacctgcataccaggcttgcaattagcagggaataatggggtgtgatggctgtagaacagcagctggaactgattttcagcctcacggtgagaaactgctctgctgacttccctgctgtatctcctggtaacttgctgtgggcaagctcagtagagcagaaatcctcggggtggggggagggagcaatccttcgaataatttaaacaatgcagctcagccaagctaaatggagcttatcaaatgttacacctcttaaagctgcaatcaggggcggcaggatattaactgtaaagctctgggttctgctcagagagaagcaagggaccagacttactacttaaccaaaaaggaggaggagtttgagaggtgacgggagagagaatgggatcagctttgaagcccagatcaagaagcagatatttgaggacaggacagggagacagcctttactgagcacctactgtgtacgggcctggtggctgttttacatagattgctttctctaacatttgccccagctctgtagagatatgctgttattcaaatgcatttttaaatttctctaacctctgccccagctcggtacacacatgccgtcattcataggcattttttttttttttttttttgagacggagtctcctctgtcacccaggctggaatgcagtagcgagatctcggctcactcactgcaagctctgcctcctgggtccacaccattctcctgcctcaccctctggagtagctgggactacaggcgcccaccaccatgcccggctaatttttttatatttttagtagagacgggatttcaccgtgttagccaggatggtcttgatctcctgacctcgtgattcgccctcctcggcctcccaaagtgctgggattaaaggcgtgagccaccgcgcccagcctctcatatgcatttttaaatagtagggcgaatcacttgagacttgttcgcttgcaaaaatgttagaaaaccctgactccaactggcctgagcaaaggggttttgttttcctctctgtctcttgtagttaagaatctagtgaacaaacttgattcaggactgaaaggatgtcagcagcagctgatctctctccacctcttgggtctgccttttgctgtgttggctttagattcaggctccttgaagaggtaaaatggcaacagccactcggatccctggtgtcctctgaggtcgaggcccagggaagaagaactctctgctctaaaagtctaagcaggactgacttccagctccagccaagatggagtgaaagaccatattcactctcaccttaaacattcaaaaccagtatatgaagcaatggtttttagacaagaaatagcagtcagtgggggacagggaccctcgagggaagcaaaggaatgcgttgacacccccattgcccctgctcactccctggggagtttctaggctgcagcgctgggacgggagagtcaggtggagcctcgtggtctccacgagcagaggcggacccgggaatctggggaggacaggcagctgcaggtcccaggagagagctgcacagagagagaactctggagacccgcagagggtccccgctgaacattcagccgaggatggaccagaccagaccatagcattcacacaaagaaactactagagcctggggaaagggccccttgaaggaacgggcataccaattcccagagctcacatgtatcaggaacaactcctggtcctgccagccagagtggagaaagcttgtaagacggggcatcaggcggagcactcagaaagctgccgcctcagtagtgccaattagtccaattagccctgggcttaaggctgttctggtcctaacagacctcatgcaagtcttgaaaggaataaactgtttccaagtgactgaacgagattccagaataaaaactcaggaacatttgaagaacatgttaaaatatccatcacccaagaaggtaaaattcacaatgtctgtcagtcaagtagaaatgaccaagaacacagaaaatacgacccttaatgaagagaactagcaatcaatagaaatagagctagaagtgataccgatgatagaattagtaaacaaggacacaaactgttattataagttgttgtttgtttgtttgtttgtttttgagtctcgctctgtcgcccaggctggagtgcagtggcacaatctcagctcactgcaagctctgcctcccagattcaggccattctcctgcctcagcctcccgagtagctgggactacaggtgcctgccaccacgcccggctaattttttgtatttttagtagagacggggttttaccatgttagccaggatggtctctatctcctgacctcacgatctgcccacctcggcctcccaaaatgctgggattacaggtctgagccaccatgcctggcctattataagtattttttatatgttcaagaaggtcgagaaaaacacgaacatttacaatagagatatgaagcatagaaaaggacccaaatataacttctagagatggaaaaactctagttgttatctcaatgtctgaggtaacaactagagaggatgggattaacagttttgacattttagaagaaaacattactttacttgaagaaatagcaggttggtgcaaattaatttgcaaaaactgcaattactttcacaccaacctaataacaatagaaagtattcaaaatgagagttcagacaagccaggcatgctggctcatgtctgtaatcctaccactttggaaggctgaggtgggtggatcacctgaggttaggagttcgagaccagcctggccaacatggtgaaacctggtctctactaaaaatacaaaaattagctgggcgtggtggagcacacctgtaatcccaactactcaggaggctgagacaggagaatcacttgaacccgaggcagaggttgcagtgagctgagatcacgcctttgcactccagcctggctgacagagtgagattccgtctcaaaaaagaaaaaaagaaacaagaaaatgagagtctaggtggggtggctcatgcctgtcatccagcgcactttgggcacccaaggcaggtggattgcttgagctcaggagtttgagaccatcctgggcaacatggtgaaaccttctctctacaaaacgttaaaaaattagctgggtgtggtggcatgtgcctgtagttccagctacctgggaggatcacttgagctcaggaggttgaggctggagtcaaccatgattgtccagcctgggtgatagagaccctgtcaaagaaagagagaaagagagaaaggaaggaaggagggagggagggagggagggaaggagggaaggagggaaggaaagaaagaaacaaaaagaaagaaagaaagaaagaaagaaagaaagaaagaaagaaagaaagaaagaaagaaagaaagaaagaaagaaaagaattaattcaaaatgaaacacaggaaaaagacaggaaaataaaagccccaaatggaacatcagtgagctgtgagactgtatgttggaatccctgaaggagaacagatgggcagggcctctgatttgcacactgccaccctcggggacttgtgtatgggggtgctatgttgttaaataaatggatggtgctgttgccttgtgaccttgcactcttccgttgtatggagttggtctaataatgacagtgatagtgatgatggtgatgatgacagaccttgattcactgatcacagtacatgtgagaatacatagaatcctttcttttacccctgcaacagtcctgtgaaaactgggtcattatcctcacattacagatgaggaaataagcatatgaggcttgtttgtcccatgaaggtgtagccaggacaagtatcttggggaatccaatttgattatataaattcacacagttttgtgagaagttgagctcctggatgtgatttgagctagaggagagggaattggggaacagccctgatttaatcttacatttaacttgagtacatggcaaatctttttccatctctggtcctcatgttttcttcctatagtaggagaatgtttgaacaaattggtttctatgagcccttccactgtgagtattggtttccatcacttgtggcttgggaatacatttgtccaggctacttagtacagtcactttcagttatgtggcatttatttgtacatgagaagcttgtagcattaatagtctcataaatgacactgaaaacaaaactttaaagaatgttgataatgtttgatgactcaaaaactgccacatagtcccctggttccctaaacaaaggctatattcttttttttttttttttttttttttttttttttgagatggagtctcactccaatgcccaggctggagtgcagtagcatgatctcagctcgctgcaacatctgcctcctgggttcaagcaattcttctacctcagcctcctgagtagctgggatcacaggcacatgccatcatacctgactcatttttgtatttttagtagagacaagggtcttatcatgttggccatgttggtctcaaactcctgatctcaaataatccacccacctgggcctcccaaagtgcttggattacaggcatgagtcatggtgcctggcctattataacctatttttgatgacaaagagtaacacagtgatgcctccatgaccattgagatgtagaacgctatctacccttaaactatatgtccacattggtctgttttaagtaggttaagtttaccatctcatctttaggttgtcagctctcagttttcactaatatgagcattcctttctctctaaggtctccctccagtgtgctgtgggccagaccccgtgacaagcacacacactcactgtttcactgcagcatgaccacccttaggctgcagaattggtttttataactgtgatcctaagtggacgggtgtcacgcaggccatgagaagggaggaccgcagtgtgcatgtagcatggttctgtgtggagcctgtcctagacacctccctctgggctcctcatctttgcagggtcctccctctgagcttgtcttcccagctttcccttggttctggcttttaaatttctagcatagcctggaccctggttctggtctttgagttgctcttcatggaagtgggctttgcaagtacatggtcttggtcattgctaagtactgtttgcatttcttttaacagtcactcctcaggcatttgaagcccttgccccttgggataactctcaaactccccaataattgcacatgcatggcctcagacatccaaggggctcccgttgtcatgaacaccattttgaccggatacattgtcttcgctaacacctctacagctctttgtatgacaaagttatgaatgatttgacctgttacacataacatacataatatgatataaagctgctatcagcatggactcaacagttgtaattactttcatgattgctgaaactcctagtgtctctaacttgcagtttctcacaattgcatcttcccctgtaaattgattatatattcgactatatattttaagctgaaatattttaaagtgaattgtagctatatcccccctaagtatttccaaatgtatctctaaaaaaatagaccatttttgcctataatcccagcactttgggaggctgaagcaggcggatcacgaggtcaggagatcaagaccatcatggctaacacagtgaaaccccctctctactaaaaaatacaaaaaaaaaaaattagccgggggtggtggcgggcgcctgtagtcccagctactcaggaggctgagacagaagaatggcatgaatccaagaggcggagcttgcagtgagccaagatcgcgccactgcattccagcctgggtgacagagagagactccgtctcaaaaaaaagaaaaagaccattttcttacacagtctcatatagtttggatatgtgttcccacccaaatctcttgttgacttgtaatccccaaggctggaggtggagcctattgggaggtgtttaaatctctcatggtttggtgctgtcttcatgatagcgatttcttgggagatctggttacttaaaagtgtgtgcaccttctctctctctgtctctctctctgccttcctcctactttcgccatgtgacatgcctgctccccctttgccttctgccatgatcagaagcttcctgagccctccctagatgccaagcatatgccagcatcatgcttcctgtaaagcctgcagaactgtgagccaatttgatctcttttctttataaattacccagtctcaggtatttcttgttttttgtttgtttttgagatggagtctcactctgtcacccaggctggaatgcaatggtgcaatattggctcaccacaacctccgcctcctaggttcaagtgattctcctgcctcagcctcctgcatagctgggattacaggcacccaccaccacgcttggctaattttttttttttgtattttagtagagtcagggtttcaccacattggtcaggctagtctcgaacccctgacctcaggtaatccacctgcagccacctcccaaagttctgggatttccggcatgagccacagctccaggccaggtatttctttatagcaatacaagaatgacctaatatacagtcaaaataacagtataatatcaaaaaactaataataatgtattagtattctctaacatctattttgtgttcagtttctcccaaagtccccactggaacccaatctgtgactgtgcattgcacctggctgtcacttccctcgtctctcttttaatcagtggagctctacgcgctgtctcccctgctggatttttctggtctcctggcttgctgctgtgtcccctgtttcttccatagctgggaggttctgcagcccaaggctccagatgactccacccttccccatggcccaggctgttctgacctacggctcaacacctccttgaatggcaagaggatgctggtgaggaccacccccagggatcagagggaaatttctccgcccccaacctgctgagtcacctactgtggagattcttcctgatttcagaagaaaaaaggaaagtgctcacgactgaacttcatcacctatgccttggcttctgtaccaggctccactctgtcctcccttctccctggccaatcccttccaaagcattctgtagtttgtttagttacattggacaaactgtatgagctccccccaatgtgccaggcatggaactaggggacagggttgcaaagttttacaggaatgagttccaagtcccagtctttcagcccacaggctggtggggaaggtgtggctgtcatcaggtaacagcatcacagtgcagtgtatgggtctttatatggggtgcactgaggacacctaggatggacgcttagtccagtctggggccagaaaccttcccagaggagatgctccctgagattgtcttgaggggccgatgagattcatgcagccatagtgcagggagggaaaagcattccaggcagaggtaacagcccagctgcaggcatcagggcagggagcagcatgggtcttagggctctacaggcatgggttcctccagcccggagtgtgactcaggaatgggctgtgcccttcctgaaagcagatatgttccactgaggaactgtaactttactgtgtgagtgatggggctcactgagaggtgtcaagaaggggaaggtggggtgaagagaggtgggcacccaggtgggagctagtgcagggctggggaggggtgccaaggccttggcccacgttggggcagtggaagaggaggggcaaagatggatggggtagatctgagggcacctgcgattggtaggggtggggatgagggagggagaaagggctgcttccaggtttctggcctggttgtcactgcccattaacacagagaggggaaactgtctaaggaagaaccatggtgctggaggattagcaaagatgactttgttctgggaagtgttggaggtaaggtgtctggaatgcctggatcgtgttccactcattaggaggtggtctgacccaggtggcgatgctaagcaggtgttctggcttgctcgtctgagccctgaggagaggcctgggtggtgggcatggtgttgtcagcagacccacagcagctggcatggtgagaatggatgataccacccaggtcatatacagaaaagtgcagtggactgaggtggctgaatggtcagagaagggggaggagaaacgaggagcatgtggacaatgccacaggagggtttgaagaacaaaagagaaatgtatagcgttccacactccaggtccagagagacaaaggctggaaggagtgccatgcgctgggaaacagggtggacatggtgtccctcgccagtgcagtttcagtggagtaggaggaggaaaggaacaacacagtggggtaaactccataaatggatacagggaatttgtaccccaggaggcagcaggaggggggatgagataaaaatgacagagtcaaaatactggagtcaaataggtgaggtccgcatcacctctgttcaaacccagccacatgttcatcctggactgaaccctaagctcctcaatccaggcctcagtggtcccaggaactggtccaagcaggcagttggaactttctggagagagatcgccctctacttccccataagcctccatcccggcagattagcctgagcacggaccactcccctgcctctccacctctgctgctcatcctggaacccccttcccagccttctttgtccctccaagtcctgtgaacccttcaaggttgagaccctgcctcatttcctttgggaggtcctgtctgtctactccagctaaaaccatctcaacccctcgcaccctcagtaatggtgggcccatcccacttttttcttccccacacaattgagatgtctccccagtcagaccagcctcttcaatgctggatactgaatcttgtgttttcttttttttacagtccccagactgcctagcctctgtcccagcatgggacttcgttggccatggaggggaatctcaaagttaggcagtaaggccctgggactgctttccagggcctcacacacaaagttcggtctcctgaactcaccacatctccactgtcttccccagcaccaagttcagagagcaggagagaaggggcaggtccaggccttgcccccagtggctggagagcctgacacatacagtccaggttttgctgcaacggaggaaagggcaggtgcttcccgtcttcaaggggcaatgccagagcttgtttgtgggaagcagcagacactacgatggatgttttgtgcacataatctcatttaaccttcacaatctgaattgttcttattcttaaatgcctgctgtgagagtgaattctcagggcttggccggctcttagttgcagaccgcagaagcagcattagctggtagttaagacaggaaagactttatgagagacgtgagcgagctccaggctctatgaaagatgggggcacaggctctggggtcatcttgcaggaatgactttttgagcctgatggaactggcctggtcaggagcctggctgcgagaccctggccccacgtagcctccgctgcaatccaagtcctgtgcctgtgtgccctgcagcctcggaggctgggaaacagctttttttgtgtgttttgctttttttgttttgttttaaattctacattgggaaagtggatttacaatagagaaaccataaaaatgtggagagaacattcctaggggtttgggtagccttgcacgactgtcctatctgtgctgtacctcaggcaaacacaaaacgttttcagatttgccagcgaaggaaactaaagctcagagaggcaaacttacagctgggttgggggcagctgggatccaggactatgaagtgaaggttccactcttttcacgtggctttgaggattaggctctcaaagcggaaaagtgtcggtggctttgacagaaacagggaagcggggggcggctcctgtggggatggagatggttcacatttaaagatatcaaaggcgctgttgggattccggtggccacatccgacaagcagttggacgttgagatttggagccattcagcctgtcttcctggccttggagagaagttctgaacaaaatgcctctatgaatttagtctcaagatctctacatgtttctcaacacacatgcacacacacgtacacatgcaggcacacacattagcacacaaaggtacacagacacacggtgacacatgcatacacagggacacacatggacacatgcacatacatgcacacacattgacatgcactgacacacacacctgacacacatgtgcacccacacgcacaaacacacacacacaagtaacatcgacagcctgtggctgtagaagtgcttccaagggcctttctttcttgtccttgcctggagtttacagcacttgaaaaatgtcagtcgtgggaggccttttggtcttgggttagggtaaactccctccacatatttggaaagcatccaggccctgcaagccgctcacaaagcagataacagtgaccttgctgctgagggaggacggccccgcggaagccaaggagctgcgctggcagagctgaggttacccctcctccctgctgcagaacctgggtcaactctgatgtcaaagaccacaaccccctccccaccgcccccttcccgttggactcccggccttctttgtgccagaaacacaatgctcagctctcagggaggaggtgagggcagagcactgctctgcaggcccaggtggagaacagcccagctctcccttaggggctgcaggctgagggtccgactccaacccccttgcctttttgcaggcccgaaggagcttctccaggatgatgacagattttccaagactcatcccaggctggaggagccccggctgcaattggactggtgtgtgtatgtgtgggtgtccacaggttgagctgaccctgaaagtcctggtgctagagggctgtggaggtcatgtcatcccaatggaacgccctctgttggcattcccttcaagaggtcatcctgacccattcagggagatcactactgccaggggcactactccaggttttcgcctctctgttgcttccacttgctggccctaattgcacctcttgagctactcagattaggagtaacccttccacatgacagcctttcacatatgtgaaaacagctgcaatcatacattcagctacatctagctttgaagccctccccggtcagccagctccctctctttggcccccatttgcaagttagggaaagttcaagtctgattgggtgccaggcctggtgctggcagctggggacagacacatggtttgctacaagtagttggtggcctagtggaggaggcagacagcaggtcctggtcagcatgctgagcctgggggaggggacagcaagcctgcaggaagacatgcaggagttactcagctggggacctgggggccttaaggtgctccggacagaagggacaggatgcgcagaggctgggggtgcagcacagtggccctgacctgcaggtggttcagaatgtgtgggtctcaagcaagcctactggctatgcacccaaaggaaaatatttcattctaccaaaaagacacctgcacttgtacgttcattgcagcatgattcacaattgcaaagatatggaatcaacttaggtgcccattagcagtggactgaataaagaaaatgtggtatatgtacaccatggaatactatggagccataaaaaggaaggaaatcacatcctttgcagcaacatggggatgcagctggaggccattatcctaagccaattaatgcaggaacagaaagccaaatactacatgttctcacttgtaagtgagataaaccttgggtacacatggatataaagatgagaacaacagatactggagacttcaaaagaaacgagagggtgagaggggcaagggctgaaagctttctatatgctactatgttcactgtctgggtgatgggatccatagaagcccaaacctcagcatcgtccaatatacctttgtaacaaacctgcacatgtatccccaaacctaaaattataattaagtgaaaaagaaaatatgggttgcaaacagatgcagggcatgcagggcatcaggacattgccttatcctgaggactatggcaggggtgggagagtggcagcattctgaagagttttcagcaggaggtgcaggattaggtgcgagtttacctggagaacgggtttcgtggctatccagtgctgtgggcagagagtctggcatggggggctgcagatgctcaggcgagaggtggtggtgcctaagttgtgagttgtggcagtggccacgagggtagggagctgtaggtggagatgggcagaccgagacctctctcctgtggccgtggagctccagagtccacacagatgtctacagatctagctcaaagccctccccagtcagtcagctccctctctttggcccccatttgcaaggaagagaaagttcaagtgtggtgctcaggatggaagcagacttctaggtgatatctgacagtgtggactatttcggcactttgttttcctccttctggtctctatcttctctgccaccaaggttgacactagaggcctggtagccacagagcacagtccagttggctcctacagaatttgcagtgtctcctgaagaccccaaacctcctccatgctggctgtttcaagcccacactccctctgccccgattgtggaactcagcagttggtgtctagtgcttactaacaggaacccacatttattattactattatattatccacatgagattcaattttcttagattcaaggtctcccacctgcaccgctttctcctttaaagcaggagacatggctcagaagcctcaaggcttggcctctggattgatttgtgactttcaatcttagctccatctgcttataaaaacataaatcatgccctttttcactccaaaaagtttgaaaaaaggattttatattttgcaaaagttttccctagaagttgctgcctgggatatttttcattccatcttaaagggataacactgctagttgtgtggagcagtgagacagctggggccggctctgtccaccttccggcagcccccaggggtacctcgggctgcctcttggggcccactgggcaaactcagggaaagacagaggctgcctggcccattctcctgaagtacatccacctgggcctgcgcagctgccagctggcttgaggcatggtggacctgctcttttctgggacctctaaaagaccatgtgagtgcgataggagtgtgtatgtgaagtgggggtcaggttattaggggtggagggaagggagctctttgattaatgggtgtcctgtgaacctgcaaatttgcccaaggctgcattcctgggctttcaaacccgagcagtttgataagctgggaccaaagtcttctttctgcccagcaagtaaagcaaacagggccactcactaaccccagccctggcctctggtgccatctctcggccaccagctagccaagtggcctttcacaggctaatcagtgagcatccctgggacctctgggaggcctaatcagcttgcctcagcgaggcaggagggaggccaggctcacccgaactccagcatgcagtctgaaggcctgtgcttagccaactaggccctccctgatggcagcacctgcagtctttcccactccttcctgcaatcattcccaccagggcagcttatcagctgggccttctccattcctccagtgcctgcctagaatgctctttccaacttccacagccttcaggctccttccctaatctccctcccccaggaagccttccctgaccagcctccatgggatgcccccttccctgcatccctactaccccagagccctggattatggtttagcaccagatacttcttcagtctgttcctgtgtgttggtttggtatcgccaactagattgtaagcaccttgagggtagggcttcaactttgagattatccccagtggggagtggtaactttgggagtataatgttggcgaggggtgggcttgtaggaacaggggacagatccaggggtagaggcaggcagctctgaggctggggacctcaatcccaataagatgtggaggggaggctctgggagatgaaaggcagccatagagtcaggactggggaaatgtttatttctggggagtcgtagtaggtacctgtggggcatgggggtgtgggcccagcctgtctccatcctccactctagtctctgagaacttcttctctccttggtggggcccaagcgatggaactgcatctgtgtctgcaccactggctccttgttcttgactacagaagatttgggttgggatggaccctggagggccctccagatgcccttctctggagacttgggcttaggactgagacacacatctccatctccgggtgtttgcctctgacaagatgcaaccagctatgggctgtctgcagcggggagcagtgggaaccagactgcgagacagaaggaggaggcagaggtgcacagaggagctgagaccaggagctcatagcccagctcgcagatgcttttgcttcatatatcatctaaaccagccctcactgccctcctgagaggtaggtactgttaagatcctttttttataaatggggagaatcgggcttagagaagttaagtaatttgccaaaacacgcacagcaggtaagaggcagacttgaaccccgtcctgctgagttacagagtccaagtgtaacctttctcctacctttgctcccagcagctttgtagatccaggccctggtctctcatgagaactttctctacatctcacacttcagttccacaagataccagaagaactgtgaccaacactactgtaacaaggttttatttgtctatctatctatctatctatctatcatctatccattcatttattcacccattaatcgatctatacatctaatctatttatccatccatccatccatccatttatccatccatctatccatccatttatccatccatccatctatccatccatttatccatccacccatccatccatttatccatccattcatccatccatccatcatctatccatccacctatccatccatccattcattcatccatccatcatctatcaatccttccatccatccatcatccattcatccatccatccatccatccatccatccatatctacctatatagctagctagcgagcaacaatcacttattgagccctgctgtgcacaaaacactgcaacaggtgctgtgatgttctcaatcctgcctactggcacagatgatgagggatggcagatgactgcttgtcaaactatgtggtatagacagacaagccagtgtatcaaagttcccatgtagaaattattgcaattgtagattccttgacccttcccaaggattctaattcagaacaggagaggagctcaggaatccacttttccaacaaattcttcaaaagagtctgatgtaggtgatccacagagcacaccttgtaaaacagctgtctggagagtgttattcaaagggatagaaggtcagtgagacctgagacagtcagggaaggccacctagggtcaaggccaggcactctcatgtcccctagcaggacctggaaaaccctgggaaagagtggtggggtgaggggagagagacccaggtcgtgggcagcctgggcaagggccccagggtcttctcatggtggtgaggggcagccgccagggcagagggcaatctgtaggaagctaggtgagcagaaaaaggccatggtcagcttttgctcagtaaccaggatgtcacaaatgcaacagccaaaaagtgctctgcccacttagcctctgtggaattggatgcccttccacacgcatttctagggactaaagggaccttccatggcgaagaggaaggaacttgtgtctaatgcctggtccagaactaaaaaataaaaaaaaacttagtgcaattagggtttcagtggggatgagaatggttggaaaccctagaaagcttgggctgaacgaggactgatggatcatcacctcatcatcatcagcagcagcatcatcatcattatcgattatcaatgtcatcatcattgtcaatgattattaatatcattatcattgtcaatgattgtcaatgtcatcatcattatcaatgattatcaatgtcatcattatcaatgtcatcattatcaataatgatcaatgtcatcatcatttgctgtggcccacaggccacgtgctttccagccatgctcttttgcctcctcacagcagtgccattctgcatatgggaagctagaagagcgaggcatcccacggctgtccagacagtaaggaatgagtgtcacccgctctcaggctgtctcctggcacagcccccaaaccgctccaagggatagagatttacctgcttattaccgaggagattccccagcttcctcacaacacattgctctgttcaactcaccccaggactctctaggcctggatgtgatgccagggggtgcccagtgcaagggcacccatgcttggatggttctggggtcaattttccttcagagcagcccttacccagtgacgtctctgaatcaactcccacctcaccccagccagccccacctcatctggccttccccaacctccctcaccatcttcagcaaaaccctacctcctgcctcacctccccagcctgccctgggaggccactctttcccactccttccttactagtgtgcatgaaaagaaaaggaatttcttttgcagtttatcctctgaacagcctctgaaaaaagttgaaggacacgctgcaaagtgtgaaaaaaacagggcctgagcttgccaagagggtccaagtggttactttaatcatgtggaacagcccccttttcatggaaaattttctactccaacacctgtggccattaaaggtgccctcggctctttcctacccgggatcccaggggtcactctccaactgaggctggctgccagctctggtcattactctgtgcccctcctctgtgccttcctcagcccttcccagcccagccctgctttgccccaggcctgctgggtgcaggcatgcagtccttcctggcttcccttgcctctctgcagtttctgaaatgaacacttcagtgagacgaggttccctcctgttgcactggttgctctctgaggcttcttgggacaggcctgtctctgtccccctgccacctctgactctctgcttcctccagagtcttccttaggcaggctcacttccccggaccctggagatgctccagtgccttccatcccccaggctgaagtgccctgtgcctcctctcaactcagagacagggaagccctggagaaacagccccaccagcccttttttgatctgctgttcctctgcatgcccagttttcgttttcagattgtgtatgctgctttgggtttgcaattgatcatcagtgtgcttgggatagtgtgcagccccctccccaccattctttggtgaaaaactgggatgcagaggagtgaagagatttccctaaagttccgcagtgtctgccaagacagggaaggactgggcatagactgtgtaagccagacctcctgaaggacttgccccagctttctctccccatctccttacttgctccatggtccacccaaccttgcctcctccatcacactgcagacacagctcttactcaggccactagtgacctgtgtctctaaatcccatagacattttctctcctcatcttgccttcttgacagcattggacacttgcttccctccgctgctcaggacattctcttcgtctgcttctgtgcatcctcctgctccttgttttcctgaccacacaggccagttctttgtgggaggcctgttctccagcacttgaaagctggcgctcctctgggatcaggtctgggttctcttcccattctcaactttcttcctttgcaagctcaccctgacccactgcttctaccaccatccacatgtctccagccctgcgctctcctgggtgctccatctgcctcctttctgatatcatttggatgccacaaagacgcctcaaaaataatttgcctagaactgaatccatgatctttctcaagactccaatgttgcacaaggccacaatcatcattgaacaaagtggggccctactctttaccccaaacttggtccccttggtacttctgaacccactgaataggaccaaccaaacagggctgcaggctggaaatcacagagtcattctcaatgcctccttctctctgtccccctgccagatgcaatccgtcccctggtcccctgtcctgtgcgagctgctatcacctccacacttcaatgttaccacatgatatagcaggtggtgaaagtggaaatgaggaccagggacagatggagactgactactgagatggtgattttctagttcccaatctagaatttggactacatccctgtaggaaagtgtgtctaggaaattgcatccagttaggaaaataaacatggtagtcagtgcatccatacccaagccaggtgacacagactataccacattgcttggtatggaaggtggcatccagccatggatggtgttgaccttttgtgtccagagctttgttttcctgtaaggccatttaaatatgcaggagcaattcaaaatattgaaagccattcctaagtcaaggggaaaaaaacaggcactttcaaaataatatgattcccctgatattattcaagtgtgaagcagactaccagagggtggcccacacagctcatttgtttctatactgcccacagtacccaacagaatgcttagcacgcagcagcttcctacaagtatcttgagtaagtgaacgtgtgccttctaaaatatacgggactcactggtcaagtgctggaaaacatcaagcatgattcaatgataatcagaagaggcactaaaggtgacccaatctctaaatgtctccttggcccagacttttctttctgccaatttagttcttgctaaaacaatacttttactaatgacccaggaaggagtgggcagagctgggcagctaaagaggtggtgacagtgggaggggagctccctacagccatgtcactggtacctgggccctccatctgggcatcccaagtttcaaggtgagcttactaaaaagcctcaggtctcattccaagtaggaaatggaatttggaacgctcttgactccattttgcagaagagtaaagcaagacctaaagggaagatgtggccaggcatggtggctcatgcctgtaatcctagtatttttggaggctgaggtgggtggatcacctgagatcaggagttcaagaccagcctggtcaacatggtgaaaccccatctctactaaaaatacaaaaatcagctgagtgtggtggcaggcacctgtaatcccagctactcagggggctaaggcaggagaatcacttgaacactggaggcagaggttgcagtgagctgagattgtgtcattgcactccagtctgggcaaaaagagtggaactctgtctcaaaaaaaaagaaagaaaagaagaagaagaagaagaaggaaggaaattctgacccatgctataacatggatgaacttgaggacattatgctaagtaaaataagccagccacaaaaggacaaatactgcatgcttccacttataggaagtccctagaggagtcaaatccaaaaacagagtcgaggttgccagggtctgggggaaggggaatgtggctgctgttgccaaaggaccataggttcctttctcctcccgtggcctcaccaagactacagcagtctctcccctaatcccctttgtcttcttctcctcccagtccagcccccatgttgctgtcagaaaggtttttctaaaatgtagctctgggcacattaatctgcagtgaaaatctgtcagtggcacagtaatgcctgtaagatgaagccaaactctttgacctggcctgaaaggacccctcatcttctcccaccactcccctcacactcatctgtacacatacagtcactcccctcacagaccccacaggcgctcactccaactcaaacacacaagcacatattcactctcctatattaacagtcttttcttttttttgagacagtctcactctgtcccccagggtgaagtgcagtggcgtgatctccattcactgtaacctccacctcccaggttcaagtgattttcctgcctcagcctagtgagtagctaggattacaagcatgtgacatcatgcccagctaattttttttttgtatttttagtagagacggggtttcaccattttggtcaggctggtctcgaactgctgacctcagatgatccgcccgcctcggcctcccaaagtgctgggattacaggtgtgagccacaaaacccctacctccctacctcccttctttctttctttctttccttccttccttccctctttccttcctctcactctgttgcccctccctccctttcttccttccttcctctcactttattgcccctccctccctctctccctccctcccttccttccttccttcctctcactctatttccctccctccctccctctctctcactctattgcccaggctaaacagcagtggaaagaacatgggtcccctacagcctctacatcctgggctcaagcaattgtcccacatgagcctccagagtggctgggataacaggtgggtgccaccatgcccggataattaaattttttttcttttttttttttgtagactcagggtctcactatgttgcccagcctggtctcaaagtcctaggctgaagcaacccttctgcctcagactcccaaagtgctgggattactggcatgggctgctgtacctggaccacataatctcactcacatacacactggctctactcactcgagccatgctgagctactgagttccctgtgactaaactattctagcttctgtgactttcctgtgttcttgtgacatctctcatctaaagaaagtagccttatcttaaccgcatgctagcacaggcatggcacacactggtccgttcagtatggaatacaaaatggttatgtgcagggacaacaactagaatgccatgaccagtcatctcattctaaccttttttttttttttttttgaggtggagtctcgctcttgtttgtccaggctggagtgcaacgcgcgatctcagctcaccgcaacctacgcctcccaggttcaagcgattctcctcagcctcctgagtagttgggattacaggcatgcaccaccacgcctggctaattatgtgtatttagtagagatggagtttcaccatgttggtcaggctagtctcggactcccggcctcaggtgatctgcctgtctcagcctcccaaagtgctgggattataggcttgagcccctgcacccggccaaggagttgttttcggtcacacagaggatcaaagtcagcctggggactcgtggctagctgtctcaccatctcacacggagctgtttgtccatctcaattatatgagtaacacacactgctttttttttttttttttgagacaaggtctcactctgctgcccaggctggagtgcagcaatgctatcatagctcaccgcagcctcaatctgtagggctcaagtgatcctccctcctcagcctcctgagtagctgggactacaggtgtgcaccaccacgcccagctaatttttgtattgtagagatggggtttcccagtgttgcccaggctggtcttgaatgccttagctcaagcgatcccacctcagcctcccaaagtgctggcagccattagccactgtccctagcctaagatttctacaggttttttttttgtttgtttgtttttgagatggagtctccctctgtcaaccaggctggagtgcagtggctcgatatcggctcacctgggacctccgcctcccaggttcatgccattctcctgtctcagcctcctcagtagctgggactacaggtgcccaccaccacgcccagctaattttcttgttgttgttgtatttttagtagagacggggtttcaccgtgttagccaggattgtcttgatctcctgatctcgtgatccacctgcctcggactcccaaagtgctgggattacaggcttgagccaccgtacccagcctgttttgttgttgttgtttttgtttgttttttctttgtttttgtttttttttaagacagagtttcataattgttgcccaggctggagtgcaatggtgtgatatcttggctcactgcaacctccacctcccggattcaagcgattctcctgcctcagcctcccgagtagctgggactataggcatgagccaccatacccagctaatttttgtatttttactagagatgggatttcgccatgttagtcaggctggtctcgaactcctgacctcacatgatccagcagccttggcctccaaagtgctgggattacaggcgtgagctgccgcacctgggcctttttttttttttttaacacatttagctttagtccatctgagctttatttctgtggatgatgtgaagtatacatgtagatgggactccccactatcaccccgacaacacacacattaatagccaatggttccaggaccatatattaaaaagcccagacctcgagcaatggctcatcctgtaatcccagaactctgggaggctgaggccggaggaatgtctgagcccaggagttggagatcagcctacgtactaggcaacatagcaagatcctgtctctacaaataattaaaaaatttaggccaggtatggtggctcatccctgtaatcccagcagtttgggaggctgaggtgggcggatcatttggggtcaggagttagagaccagtctggccaatatggtgaaaacccatctctacaaaaaatacaaaaagtagccaggagtggtggtgtgggcctgtaatcccaggtaatctcaggaggctgaggcaggagaatcgcttgaacccaggaggcggaggctgcagtgggccaagatcatgccactgcactccagcctgggtgacagagcgagactctgtctcaaacaaaacaaaacaaaaacaacaaatttagtcaggcatggtggtgcacacctgtagtcccaggtactcaggcggctgaggcagaggaatgcttgagcccagggaagtcgaggctgctgtgagctatgatcacaccactgcactccagcctggacgacagggcgagaccctgtctcaaacaaacgtaagtccagacccacagacgcattcatcagggggatcctgggggcaatggaaagagtcacgagacctaggctgtgcttccaacgacgccactcagtaccttgggccttgggggctcattaacaccgggctcgcctccattacctcctccgggaagtggttggaatcgaggtctgaaagcacggagttcacggaaaggccaggggcgccaaccgggatgggcgcggtgggcccgggttcacgcctccaggagcaaggcacagaccagagtggtggggacctgcgctcgcccaggccccgaggcccgctccccgctccctctgccgcgccgggcaaggcctcacctcgcaaagccccacgaagaggatcttggccttcagcatctttgtccgccgcggcgcagccgccggagcccaccggagccggcgcgttagggcggagccctccttggccgctttcgtttccatggcgacggcgagcggcccgcaggggcagatgggactcggccactttcggcacgctgggctgaaagtgggcgcgtctgcgactgggagggggtcggagagaagccacaaagcccgggctgcagaggcggttctgcagggttggcctccatttcttttagagacagggtctcactctgtcacccaggctggagtgcagtggcgcgatctcggctcactgcagccccaacttctgggctcaaacgatccttctgcctcagcctcccgaatagctggcactacaggcacgcgccatcacgcccgactaattttttaaaatttgttatttgtaagactgggttttgctatgttgcacaggctgttttccaactcctgggctgaaacgatcctcccacctccacctcccaaaattctgggactgcaggcactctccatcagtctcggtagagacgtggaaagcaagactccaggagggggcagaatggccatttccaaatctttgttcctcccaataatcccgagagttcagacaggccatacaggtgtcaagctggccttggaaccaggccttgactcctttatcactgtggcatgataccactgtggccgtccacttgggagccgatgacccagtttagaaaaagtcaggtaaaagtctggtttctgtaaaaggattcaccactcactatcattcctatcatctaggagaaaccaaagagatgatgactggaatcgtttagtcagtgcaggtgtctagaaacattgctgctaaattccatcagttaggtcagtctgaaaatacagagtgaagccagagttttgcataaggccatgatattaaatgtctacatgctgagagtgccggtacaaaatatgctagcccacaaaagggctggcatgataaaaattcctcgtcaacccactaccaaaactttaacctttggtaacgtagttatatagtctttgtattgaaaagaactgcttggctggccacggcgtcccacacctgtaatcccagcactttgggaggctgaggcaggtgggaagcttgaggtcaggagttcaaggccagcctggccaacatggtgaaaccccatctctactaaaaatacaaaaattagtcgggtgcagtggcatgcacctgtaattccagttactcaggagactgtggcaggagaattgcttgaacctgggaggcagagattgcagtgagccgagatggcgccactgcactccagcttgggtgacagagcaagactccatctcaaaataaataaataaataaataaaaataaataactgctgagtgaacagtaaggaagcattctcaatttcaagatgtcattgtggattgattaaataaatattttttgtttttgtttgtttagagagagagtctcactctatcacccaggctggagtgcagtgatgcaaatctcagctcactgcaacctccgcctcctgggttcaagcgattctcatgctttagcctcctgagtagctgggatcagcctcctgagtagctgggatcacagttgtgcctggcttatttatttatttatttatttatttatttatttatttatttggtacagcagtttcaccatgttgcccaggctggtctctaactcctggtcttaaataatccacctgcctcagtctcccaaagtgctgggattcatgagcaactgctcccgtgctaaatggagtaattttttaaatttttttttttgagactgagtttcactctgtcacctaggctggagtgcaatggcatggtctcagctcactgcagccttgaccttctgggctcaggcgatcctcctacctcagtctcccaagtgactgggactacaggcacacaccaccatccctggataatttttgtatttttgttagagatggggttttgccatgttggcaaggctgctcttgaactcctgggctcaagtgatctgcgcgcctctgcctcccaaagtgctgggattacaggcgtgagccaccacgcccagcctactgtgctctttgcctggcctactgtgttttttttgttttgttttgttttgttttgtttttgagagggagtctcactctgtcacccaggcatgagtgcaatggcgccatctcggctcactgcaacctccccctctctgcttcatgtgattctcctgcctctgcctcccgagtagctgggactacaggcatgcaccaacacaccaagctaacttttgtattttcagtagagatggggtttcaacatattggccaggacggtctggatctcctgacctcgtgatctgcccaccttggcctcctaaagtgctgggattacaggcatgagtcaccgcacccagccactatttcattttcaactgcctttcgtggaagaacatttagccttaggtctttttcttgatttatgacagctcatggctttcaagaaaactacctgtagataggctgtgtgactttttttttttgagatggagtctcactctgtcatccaggctggggtgcagtggcgcaatctcggttcactgcaacctccacttcccgggttccagcaattttcctgcctcagcctctgaagtagctgggattacaagtgcccatcgccacacctggctaatttttgccttttctttttagtagagatgggatttcaccatgttggccatggtggtcctgaactcttggcttcaggtgatctgctcacctcagcttcccaaagttttgggattatgggcatgagtcactgcacctggcctgttaatgttactttcaagcaaaccttcaaaagtttattccaaggccttgctctcatagcagcaaagcctgtctgttgcacagtggggctcttggtagcatcttccttttggtggatgctgtgcagagccagggcactaaggcatgttaaccttgaggacatcggacctggctggcctgactgtggggtctccctcccaggacatggtgagccatagccggggcagtgcctttcaaagctgctctcatggagcacttagccctaatccagcccttcagggaggaggtgcagagactcatggcagagcaccccctacacctgatgcccggcataaggtaagagaagccccggctccaggtgtatttcagcaccagtgttggggggcgcatccttgtgagagcatctaactattcctttagagcgccctctgggtggttcatttattttcatttttattctttaattttattattttaaaaatatttatttatttgtttatttatttatttattttttgaggcagagtctcactgtgtcacccagactggagtgaaattgtgcgatctcggctcactgcagcttccacctcctgggttcaagtgattctcctgattcagcctcccaagtagtcgggatttcaggcgcccaccaccatgccaggctagtttttgtatttttagtagagacagggtttcaccatgtgggtcaggctggtcttgaactcctgacctcaggtgatctgcccgccttggcctcccaaagtgccgggatcacaggcatgagccactgtgcctggcaaaattttatttattttattgagatgaagtctcaggctggagtgcagtggtgcaatctcagctcactgcaacttctgcctcccaggtttgcatgattctcctgcctcagcctctggagtagctgggattacaggtgcccaccaccacacacagctaatttttgtatttttagtagagatgggttttgccatgttggccaggctggtctcgaactcttgaccttaagtgatccgcctgcctcagcctcccaaagtgctgagattgcaggtgtgagccactgcacctggcttattaattttttttttagcatcagagtctcattctgttgcccagattggagtacagtggtataatcatggctcactgcagcctcaaactcctggggtcaagtgaccctcctaccttatcctcctttgtagtggggactacaggtgcatgccaccatgcccagctaattaaaaacattttttgagagacaggatctcgctttgtcacccaggctggagtgcagaggcgtgaacacagctcactgcagtgtcaactttctgggttcaagggatcctcctgtctcagcttcctaagtagctaggactacagatgtaggccaccatgcctaatttaaaaaaaaaaattttatagacacagggtctcactatgttgcccaggctggtcttgaacttgcaggctcaagtgatcaattttcccacctctgcctcccaaagtgttggaattataggtttgagtcactatacccagcgtttaaaaacttttttgcagagatgaggtcttcctatgttgcccaggctattctcaagctactggccccaagtgattttctaccttggcctcccaaagtgctggaattaaaggcatggccttatggttcttttggcacttacacatcatcttgtctggccggttttctggtcctgtctgtttctgcctttcctctttctccagcgaaaacctaaactttccttgtttgtcctcatcttatgtttttctgggtccatgggcagagtagggttctggaatggtttcctaaaggagccaaccctacccattgatttctaagtgcatttagaaaaacacatataaggcccggcgtggtggctcatgcctgtaatcctagcactctgggaggtcgaggtgggtggatcacgaggtcaggagtttgagactagcctgaccaacatggtgaaacactgcctctatgcaaaatacaaaaatcaggccaggcacagtggttcatgcctgtaatcacagcactttgggaggccgaggcgggtggatcacctgaggtcaggagtttgagaccaggctggccaacacagtgaaaccctgtctctactaaaaatacaaaaacagtagccaggcatggtggcgggcacctgtagtctgagctacctggaaggctaagggagaagaatcgttggaacccgggaggcagaggttgcggtcagcaaagatcataccactgcactccagcctgggtgacacagcgagactccatctctaaaacaaaaaacaaaaattagccgggcattgtggtgcatgcctgtaatccaagctactcaggaggctgaggcagaagaatcacttgaacctgggaggcggaggttgcagtgagccaagattgcgccattgcacttcagcctgggtgacagagggagactttatctaaaaaaaaaaaaaaaaagaaaagaaaagaaaagaaagaaagaaaaagaaaaacatatataaaacattaactgcccaggcaatataccttgtcaaatatacctcaggcaaatgcattcaggagaagaaaatatatcctaatttcctcttcgtgtttctttttttttccttttgtattactcaatgtttgatattttgtattttattttttcagggagctggtaagtctcctacaggagctaaatgttctggttttcctaacacctggttgctttaggagtattgtagagcatgttgcttcaaagctcaatatcccagcaaccaatgtatttgccaataagcagaaattctactttaacggtaagatgttaatggtaacacattccctttcttagcagttctgttattcagtattctgggtagtgtctgttgttatgaaacttaaacagtcacatcacagttaaatattgagataaatggttatcttaattgatgtcctttgccctgtggtaccctttgctcagcaaaatagacttaggtcatcatctgtcctagctttattatctataacatcacctgtctgtacataaatgtctgcatttagtgaaacattaattcctacgtagcccctatgacttactttcctatatgttatatttcaactttatgggagcttctatgcatttgaagcaatttagactcaaggaggagacttttggctgggcatggtggctcatgcctataatcccagcactttgggagcgtgaggcaggaggattacttgaggtcaggagtttgaaaccagcatggccaacatggtgaaatcggaactctgccaaaaaaaaaaaaaatacaaaaattagctgggtgtggtgatgcatgcctgtagtaccagctacctgggaggctgaggcaggagaatcacttgaagctggaaggcggaggctgcagttagccgaaattgagccactgcacttccagccttggtgccagagtgagaatctgtcttaaaaaagaaaaaaagggaggagccaagatggccgaataggaagagttccagtctacagctcccagcgtgagcgacgcagaagacgggtgatttctgcatttccatctgagctttgaagagagcagtggttctcccagcacgcagctggagatctgagaacgggcagactgcctcctcaagtgggtccctgacccctgacccctggcccccgagtagcctaactgggaggcaccccccagcaggggcagactgacacctcacacggccaggtactccaacagacctgcagctgagggttctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaacgctaaaaagcagagcgcctctcctcctccaaaggaatgcagttcctcaccagcaatggaacaaagctggacggagaatgactttgacaagctgagagaagaaggcttcagatgatcaaattactccgagctatgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcagaagccgatgcgatcaactggaagaaagggtatcagcgatggaagatgaaatgaatgaaatgaagtgagaagggaagtttagacaaaaaagaataaaaagaaatgaacaaagcctccaagaaatatgggactatgtgaaaagaccaaatctacgtctgactggtgtacctgaaagtgacggggagaatggaaccaagttggaaaacactctgcaggatattatccaggagaacttccccaatctagcaaggcaggccaacattcagattcaggaaatacagagaatgccacaaagatactcctcgagaagagcaactccaagacacataattgtcagattcatcaaagttaaaatgaaggaaaaaatgttaagggcagccagagagaaaggtcgggttacccacaaagggaagcccatcagactaacagcagatctctcagcagaaactctacaagccagaagagagtgggggccaatattcaacattcttaaagaaaagaattttcaacccagaatttcatatccagtcaaactaagcttcataagtgaaggagaaataaaatactttacagacaagccaatgctgagagattttgtcaccaccaggcctgccctaaaagagctcctgaaggaagtgctaaacatggaaaggaacaactggtaccagccgctgcaaaatcatgccaaaatgtaaagaccatcaagactaagaagaaactgcatcaactaacgagcaaaataaccagctaacatcataatgacaggatcaaattcacacataaaaatattaactttaaatgtaaatggactaaatgctccaattaaaagacacagactggcaaattggataaagattcaagacccatcagtgtgctgtattcaggaaacccatctcacgtgcagagacacacataggctcaagataaaaggatggaggaagatctaccaagcaaatggaaaacgaaaaaaggcaggggttgcaatcctagtctctgataaaacagactttaaaccaacaaagatcaagagacaaagaaggccattacataatggtaaagggatcaattcaacaagaagagctaactatcctaaatatatatgcacccaatacaggagcacccagattcataaagcaagtcctgagagacctacaaagagacttagactcccacacattaataatgggagactttaacaccccactatcaacattagacacatcaacgagacagaaattcaacaaggatacccaggaattgaactcagctctgcaccaagcggacctaacagacatctacagaactctccaccacaaatcaacagaatatacatttttttcagcaccacaccacacctattccaaaactgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactggatacacaacgaaatgaaggcagaaataaagatgttctttgaaaccaaggagaacaaagacacaacataccagaatctctgggacgcattcaaagcagtgtatagaggaaatttatagcactaaatgcccacaagagaaagcaggaaagatccaaaattgacaacctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagagagaggaatcaaatagatgcaataaaaaatgataaagaggatatcaccaccgtcccacagaaatacaaactaccatcagagaatactacaaacacctctatgcaaataaactagaaaatctagaagaaatggataaattcctcgacacatacactctcccaagactaaaccaggaagaagttgaatctctgaatagaccaataacaggatctgaaattgtcacaataatcaatagcttaccaacacaaaagagcccaggaccagatggattcacagccgaattctaccagaggtacaagcaggaactggtaccattccttctgaaactattccaaccaatagaaaaagagggaatcctccctaactcattttatgaggccatcatcatcctgataccaaagccaggcagagacacaaccaaaaaagagaattttagaccaatatccttgatgaacattgatgcaaaaatcctcaataaaatactggcaaactgaatccagcagcacatcaaaaagcttatccaccatgatcaagtgggcttcatccccgggatgcaaggctggttcaatatacgcgaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggacgtatttcaaaataataagagctatctacgacaaacccacagccaaatcatactgagtgggcaaaaactggaagcattccctttgaaaactggcacaagacagggatgccctctctcactactcttattcaacatagtgttagaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaggatacaaaatcaatgtacagaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacagacctggtctaattctatgatctttatcacatgctgccagatgctgaagagaaatagaagcaacagcaatatgggagttaccctctctaaagcccaactgaaaatccctggagtcagaagtttcacaaacagaagaacaacatacttatcctgaatcagggaaggagaaacaattcaaacatctaaatttaaattgctatgagaatactgacttgttagaaactgaaggagcgagcaatgcttctaaattccacgcttttccatcagaatacagagatagacaacctcgaaatgcagtttcttcacaattgtcttatccagtcataatattaattaccctatgaatcaaatcataaaataaatattaaactcatgacatattctctgactaaaagaaggcaagataaactgaacggttagttgtcagtgcagtaaattatgtacaagaatcttatcgctgcattttataataatgatggaattagaaataatctaagtttctatcaaagaacaaacagtgaaataaatcttgtatatccattctttggaatacatttaagacattaaaaatagagagttagaatctcatgcattgatatggaataatgtaaatgatatattgcttatgaaatagcaaaataaaaaaaatagtatgatacaatttgtgttcaaaaactgtacatgtatttatcttcttttttttcttctttttggaggcagggtctcactctgttgcccagacgggagtgcaatggcatgatcacagctcactgcagcctcgacctcctgagctcaagggatcctccctgcttggcctcccaaagtgttgggattacagacatgagccaccgcacctggccaactttatttgtatttataaattcatagaaaacatccagaagaatcaacaccaagctataataattccttctaagaagggagtgagtttggaacgaagaggaagacatgggagaattttgttacataaagatctctatgatctgccattattcaaacagcatgcatttcttttataattagaaaaagaaaattacacgcattgttaccatttggtaggagggcaatagttttgttttcatcagtatttgaattacaggttcgtgcaagcacaaacctggaagagaaatcccagggaataattagaacaaaaaaatcacactgcaaaaagtgagtgggtgttatcttcacataacaacaagcattccaggtgagtgctggtcaggagctactgctgatccagctccctcaaatcacctaagccctgccaaggggaaggtggaggacagggaaggccaagtgccagcaagtgctctccccaaccgaagccctctttctgcaagtttcctgtcattaagaagaaaacggagtccagatgggatgtggacccctttgggacactggcagagaaacacaaagaatatgccacagtcataccttagaggaagacttctaggttgagacttgatttcatcaaaagcttgtgtgaagtaaataaagctactctacctctccaagtgtcagtttcctcacctataaaatgagaaccacgtgtcaacttcatcaaattgttgccagagttaaattcacaaagatattgaaaagtgactgtcactgttactgcaagggtccacattattaaaaaaaaaaaaggaaaaaaaacagcaacggacttcaaaatacacaaaaggaataatgtccatatgtccaaagacaagatgatcagcttttgaagcagcctgaggcacgtgagaatgagatctatccctaactagagctcttcacagctccactgaagacgacacacacggggtcccaagaagctaagtgcatggccagtgtagagtgactggtgtagtgagggtggaatccctaaagaccctctgaaatgcagtcacacaacaggctcccaggaaacactggaccaaaccaggcagctgagcagatactaccaggaatggggtgagcagaggagggtcagagccacaaatctcagcagaatacaccaaactgcaaggagctcctggctctgtgtacagcagctgtggctgcatcaggaccaatcttgtgaggcagctgctggggacagctgagatcacgtgtttttgcagccacacacccaacagcagtgcctcttgaacacagatcacaaaatcctcttcattcatctttaaggtgacggatgatggatgacctcacgttacaacatccccagcaacacttgcagacaagtgtatttagaaactcccacctgaagagggaacagtcaggagtagaatgaaaatagtgagggatgggggaggaaggcaggtacttgaccccacagactactgaaaacaagggaagagctgttatgctgtggtctccctatacttcacctcaccacatccatagatgccacatggttcttgttcctttatttacaaaggtactgatgagcccgtgtgtaattgatcctgaaggagtaaattcttcacaaagtacaataacagtgtctaatatccatgaccagaatttttaggcttttttaaaatagtaatccacattcaggaatcagaaatgaagcctgttggaatgtgtgatatgaacaaggtcttacttttatgtagattaacaccttgttttttacggattaaacataaaagctggcgccattccagaatcaaaggaactgtccctgaggacacatggaattaagggacatcaattattaggaagctacacgaaaccagaagtgctcccagaagtttctattgtctagacataaaaattaaacagatcagcccaagagagtaaaggtacctccgtgagtgccgggggtgatgaacattccattcaaagcaaagttgtgaagcctgaggagtttcaaagactccccaagttctccataccttgaaagtcgctcccacaaagctggagcaccaccggtttctgaggatcaggttgccatctgtgcctttgagacactggccagtcaggcctcagttgagatgaggccaatgatgtcacgtgtaaaatgcctaaactatcttcatctttgggtagctatttaggcgactttccaccaaatgggttggtggaaaatggcgcaccagagacacacgcctgggatgtgagattttctcctctactcttagcatctcctgggtaaaccaataatgaacctctctgccgcctcaacatccacatccaagaaaaaggcgctggtgagggtgacattttcacgaaaccacagtccatgttaccccctgcaaagctctgaacttgtgcactggcgggccaggcggcggatttctccccatagcggctgcactgcgctctggctggagagaaaagagggcagcggcacaatggacagcgcctggacctcaggccagttcccacagcagcttaggaaagcaggtgggtccctgagctggaggaggcgtgatgtccaggaaagaccccgggtgcaggtggaagagggaacccagcctagcagcgggaagtggggtgaggacaacacccatccgagttggacaagggcgaggagcacttcgcggcgtcacgccctcctcactgcccagcctggacctgcccctcctgtccctctccggactcacatcccatggcaaggaggtgcccgcgatcagtagccagcatcgctgtggaagcggcgaggtccacactgccctgcccaaccctcttgggctgcccgcctcctctcatgtttcctgctgggattctagtccagccgcctcgtcatcaacgggcggggaacagttaagagctaccgtttccagcctgcctggccaggcgcgccccgccccgccccactcctcccacaagaactgcaccccgcccccgagcccggagcatgctgggattgtagtcccgaagcgcttgaaacaacgggcgggagcggtgaaaagactacagctcccagcatgtacagcaagcccggcgcagccctgcttcgcccttcaagactgcgcgccgtcccgtgttcatgctggctggaattgtaatccggtcgccctgcaattaaaaaactggaagctaatcaaagatgataagtcctagtatgccaggcttagctcccgccctccaatccacacctccccgagtccagagcagttctgccatgccaaggggagcctggctgttcccaaacctctcctacctgccaagtttcagcgggaccagggcggctggtctaatttttctgtccgctctccacctagaactcaatcactccataggtctctaagactcttcagtttctttaagctttttcactcttatattcagaatgggcaatttctattgctctatcttctgtttctaatctttgaataagctcaaaagtattttttaaatttccttatcttcctattgtttcataatttccatttctttgctgaggttccacatctcttcattcattgttagaatattttcctttacccccatgaacagatttataatagctgcctttaaacatcttgaattacaacaccttgaatatcttaggatcacttctactatcttcttgttaaattatgtatggatcccattttcatgtttcttcacacatctcatgaattttaaagttgtgtactaaaactgtaaggaattataaagatgctcaattctgttgtgtaactttgaagagcagtgttatgttttataaaagatgttaattgggctggattcaaacatcaatacctatctcccctatagtgggcatagctgaaatcctcattcagttcttactcacacataggtcatatttgtattatatagatgtgtttctataacaatatatattattcggatgtcatcattataatctgtgttaattcaacaagctactccagtattactgaaagccaggacctcagttttgtctgcttattggattttgtataaatcacattatacagtatgtatactttcatatctacttacttttaaggaacattgtatttgtgatattcattcatgctgttgcaaatagctatagtctgttcttttttttttctttgagacggagtctcaatctgttgctcaggctagagtgcagtggtacaatcttggttcactgcaacctccacctcccgggttcaagcagttctcttgcctcagcctcctgagtagctgggattagaggcatgcaccaccacacctggcttttttttttttttttttttgagatggagtctcactctgtcatccaggctggaatgcagtggtacaatctctgctcactgcaagctctgcctcccaggttcacaccattctcctgcctcagcctcccaagtagctgggactacaggcacccgccaccacgcccagctatttttagtagagacggggtttcaccatgttagataggatggtctcgatctcctgacctcatgatctgcccgccttggcctcccaaagtgcggggattacaggtgtgagccaccgcacccggcctatttttttgtatttttagtggagatggggcttcaccattttggctaggctggtctcgaactcctgacctcaggagatccacccacctctgcctcccaaagtgctgggattacagtcgtgagacactgtacccagccaacaattttttttttcattttaacaatttttaagtgtgcaggtcagaggaattaagcacattcacactgttttacaagcatcctccacatttatagggagtgtttttcatcttgcaaaactgaaactctgtacccactaaacacctcacctaccttcctctagccccgggaaccactcttctactttgtgtctctgtaaacttagctactctagtagttaagttcatatgagtggaattatacagtatagtgaagaaatcatgaggaagtataatacacactatataacatatgtttattcatttgaacaaaaacactaacagagatcagtagtacatgtgattatagaggaagaaagataaagagaaaaggattggacggacacattcaatttatgacagtgatgctcaagtaccacagcagtgagtcccctgccccagtcacagggctggtcacagtggagctgatagcccagtgtagctgtctgacttccagagcccatgctcagcccaaacttcaccgagccctgaggcactctgcccttgctacctgggcactcagtgggccttagattcttcatggcctggtcttcttggccttgagggcgtggctggcctactgggatggggctcagcggcaggacaggttgtagctgtaggacagagcagcagctgtgaggttccaggagccacacctcaggcctacctcccagtgcctgcccagggctcccattcaacagggcctgcttctgaccagagagccgtggccacaggctgtctgaaacaagcagcctgtgtttcagactgagcctctgcccaccctctgtcaatccgctaggctctcacctctcaatcgattgtgctgctccatgggcttgaaaccaaccccatattcctcctgagtctgaagattataattccctcttgtcactgaagcagctgcatttttggaggactttgatctcctggagccagagggaagaacaaaaggctgacagggcctgggtggaagatgctgaagggcccttggggagggggtaaaccaaggctgatctctagggcttttctcttaatggactccctcttctccaatcccatgcagccccacccttttctcaaagatggatataaacagataaatagcctccccaggaatttgtccatgattcctgtcccctatgcacatgctccattgggatgggtctcctctgtgtatcaaaccctcccaataaatccaggatgcagaggatggagccggggagtgttctacccagggtaagtgggtgggatggtctctgatttccacatccccaccctcccccaaagtgagggcctcagctgctccctttttcctttctgggtgttgatcacatttccctgaaaggcagccagccaaagaccctcagaaaggcccctggcccatgacttacccccatccccacaccctcccatgctgcacttctgccaggccagcaggggtgagaaatatgcatagaacagcactgggacctgcatcaagctctgggctctagatgaggaggtgtgggagctgtggctcagggaccttttgccccaacactctctgacaacagacaaacaaacagaggccctgtatagaaagaaaatgctcggacatttaggagctgcctgacctgggaagggcccaatttccctctccttccatgggcactacctgagggagaggctgagtccagctcctgcagctcctgcagctttgcagtcggacagctcttcagattcaccactcagggaacagggactggaagctgctctggagcctccaccactcagaggtaagatgggcctgacgccccagctcagggggcatggggaggacggtggggctcacacaggagggggcttgctgtgatcaaaggtctgtgtccagggctctctcctcccaagcctgaggatcctggtccccaacctgcctgccccaggctcactcccacccacacagtccttcatggcagtgcccagcttcaccaggttaatgaggaacccccaccccccaccggcccagagaaggcacgtcaccctggccattggggtggtagtggtggtgagctcccattatcaggtgcccacccaagatctgtcccctgaaatctcaccacccacttctgcctggacactggttcccaaggtctccaacctggaacagcccaggaccctcagctgcctcccccagccctcccctcctctcccccatctccccggctggcccccaaggccactagacacccccagttacttctatgctgggattttaacaagtcatgagggcatggggtcccctgtctcactgttccccaaatctacactgagcccagcttgcccaggcggttggtttctctgctccctctaatggaggcatttcaggccctgtggccacaggagggcagggctgggggaggaagaccccctgctctcttgatgtggaggcctccagctggtggggaagaagactgcccttcggctccctggagcccctcccaccacagatccactcacctgctgccccacagcctcatctgtgctgtgtgaggaatcatctcctgcatggccagtttggaggtctccacctgccagggtcaggaacaaggtcagggagactattctctcctccctcagttatacctaagcccccttgacctcaggtcctagataaccagcctgagtgagctgttgcaatgctcccaccaactccactctgccctgattctagattcactcccagctccaacacttactgcttgtgtcaccttgggcaggtggccggacctccctgagactattttttcatcaaggaagtgtgatgggaaccacgccttcctcacagggcctcctgatgactcagtttcatgtggctctcagcagtgctctcaccatcatccttcgtgggaagagcaaggtacaagcacccataaattcccttccttactgaaccccatcaggacgctgtgaggcctgctcaacaggctcatcgtttgttcatctgccagatgaggaaacagaggcccacagagggcagtgatgtgcccagggcctcacaagagaggctggatcctcccacacctggaggccctgtcccagctgccttcaccccacaccccagaaccaccactgctcaaggtctcatcctctggtgtctatgggtgtccacagtctcatccaggctcagctgtggtgggagggggacaaagtgtcctgggaggcctggttgagcagcagctgcttgtcacagccccactggagtctctgctccacacaggctttatgccagaccaaaggcctcacttaccccatcatccaccaaggaagtcccctgcacggaaccctctcttcctccactcagggaatggtcacccgggatgccatctctgacagtacaggtactgggtggtgacatgccacttcctcatttccagggaaggttctgagatctggtcaggaaggatccacagggaatacaagagtctccagatgcttataagccatctggagcttttggtagtgctcactgggcactggggtgagaatcctgtgactgactaattagcagtgtctgcaaaggacagagtggtgagccacagcaaacacacatatgtccaccctgcatttaccaattgagacccacctggcctgtgagattcttctgctgtccccatccttggtacagacagggtgacactccctttagagatgcagtgcagtcagaagcagtagcagtggcctgacttcctggggaattgctgggctagtttggggaaggagggaagccccacctaccatgcacaccccacagcctggaggaagctccacaccagcacgatggaccagcatgggaaccagagccctgctccttctgcagctcatcatgcctgctcagcagcccagctgccatcactgcatcccattaccagggttgcctgcccacaaaccccccaactgcccacacacatctttctgttaatccagtctagacagtgctggagttgttcaagtaaacgttcagtgagaaagttacacacacaccacacacacacacacacacacacacacacacacacacacacacacacgggtgtacacgccccgacaactggcccagtaccccttccagcctaatctttttctctatccccctccaaaacacttgactcccagctcccatttctactttttcttgatgtgcaaatcctactcagtgtactgtcttttctgaaaatacttttaaattttctgtagctttttctgtggagagggaaaaaaaggaaagatttgagaaataataacgtgaaagaagaaattatttgagaataataagcagatatgtacattcaattcccttttgagaaccaaaaggatcaaactgcctggatgagaatttctacgctggtcctctaaaccctaagggctccacgggtctggggaaggagctctgtggaggctaaagcagctccatcttggatgcgaatccaccatgttgactttgaattaaccccagttctgggaatgcccttaagatttctacttcatctactgtttcttgtgtaagagcacatacttactgtaaatcttctccttaggtcaaagcaacctatatgtcatcatacaaactacaggctacgatgtgcacctcattctctttctggaaggctgaccttaattgtcctgcacattccttatagagcatatttacccttttcctatactaagtaagccctaaatcttgggggtaacagcctggggaactacctgtcttgctaccactcaagaccatgcttctgcccacaagttccccccaatagattaccttttactgacaaactggatttgtctgtttcattctttggtttcttgactccttctgtgttggggatccctttgcagatacagccctttcataaaacaaggtatatcagtccacgcttacactgctgtaaataaatacctggaactgggtttaattggctcacagttccacaggctgtacaggaagctaagtggcttctgttcagcttctggagaggcctcagggagcttaaaaacatggtggaaggggaagaggaagcaggcaggcacatcttacatgactggagcaggaacaagagagagaggggagaggtgctacacacccttttttttttttttttttgagatggagtctcactctgtcacccaggctggagtgcattggtgcgatctcggctcactgcaaccttcgcctcctgggtttaagcaattctcctgcctcagcctcccaagtagctgggactacaggcacgtgccaccatgcccggctaatttttgtatctttagtaaagatggggtttcaccatgttagccaagatggtctcgatctcctgacctcatgatccacctgccttggcctcccaaagcgctgggattacaggcgtgagccaccgcacccggcctacacacttttaaacaactagatcttgtgagaacttttacaatcacaagaacagcacaggagggatggtgctaagccattcatgagggaccacacctatgatccaatcacctcccaccaggcctcacctccaacacagcagattacaattagagttgagattcaggtggggacacagatccaaactatacagaggcctgtgggtatgtctggattttgatgatcacagctgttggcaaaacttgggtcttacttaacctgaccatgcccaggaatgtcatggtgccccctgttccctggactttctgggcatgactggcccatcctctggattgtaaatgctttaggagtttctaggtaggtttctgcaaaagacttcaatctctagagattagaagaatattatccatatagtgttcccagagaatgtcgggcacatcactccaaaatgtctcacatcactctaaaccatgttggataattgggctgtgtaagtttcactgggagcaaccagaaggtacattgttggtcctctcagctgaaggcaaaaggtcccgggactttggaagggtatgctgcggaaagcatttactacattcagtatgccatggacctgagcaagtatttagtttttccaggatttgagccatttgggggacagcagcatgcatgcccagagtcaccttattcgattctcaataatcaatgatcaactgtcataatatcccagtaatcacctgtcatactccaggtgccatcaggctttggcaccaaccacacaaagctgttttatggactctgtgcagacatgcagtccccatcctctccaagtcctgaagagaagctatgatctcaggccaagcatattggctcatacctgtaatcccagcattttgggaggctgagacaggtggatcacttgaggtcaggagctcgagaccagcctggtctctactaaaaatacaaaaattagccggcatcatgatgcatgcctgtaatcccagctacttgggagtctgaggcaagagaatctcttgaacctgagaagtggaggttgcagtgagccaagatcgtgccactacactccagcctgggtgacagagcgagactctgtcaaaaaaaaaaaagaaagaaagaaaagcaaaaaaaaagtgtgtgatcttccgtgccctcctgggaggcgacattgtttgatgcacaccagtcctcttgtgtgggataatgtcacctggcttccatgtggcttcccctcagagcatggcttttgccaccctcacctagaaacagaacttgtctaaggttgcctcaaggacagttcccaggacagtgtttgtccccaacatgtcctgggggattgggaagatgtagacccctcagagccaaaactcgttgtttgctctgaagggacctgtgactctttctagccacatggctacaattcaatagctctgggcttcagagcttctttttttggaattccaactgccccatttcaggacagtttggctcaacattgagggtctcaacattgaggggaacattcgccttcctgtcatggtaggggctgtggtgcttgttccactcctgggaaagggaagaagcagcaggaccagcctgctcctcacactggaacccacactccactcccggcccccaaaattccactcctggcctgcatgggtcccagtatctgccaggcctgctgttgacaccaaaacagccattgctgtggccctcagccctgcctctcaaggccttacctggcccagctactgccacagaccacctagagccccagtgagcttgaggtgagtgtgggacaggtggggcagcctctctttcttttttttttttttttttgagacagagtctcgctctgtcgcccaggttggagtgcagtggtgtgatctccactcactgccagctccgcctctggggttcaccccattctccttcctcagcctcctgagtaactgggactacaggcgcctgccaccatgcccggctaattttttgtatttttagtagagacggggtttcactgtgttagccaggatggtctcgatctcctgacctcgtgatccacccgtctcagcctcccaaagtgctgggattacaggcttgagccaccatgcccagcctttctctttccttacttgactctgcctgtcacagaaaatggaacccagagcccctgccaccactaccattcaaagccaccctgagaagcaggcctgaggctgcaggctcccctggcacctctccacagagcctttcttctatttaaccttcacaggggcaactaacagagtgggcagcagcgggcaggcctttctctaggtgcaattcctcctcctctaactcggggaccttgctctcggcccccaacagagcctctgttcccaggaggactggccatggtagaggccagcctaccccctctctgcctgccgagctctgggctccttggtaatttcaaaccccctcatcagcctcctttagcctgctggagctttcacagcatcctggcactcacagggcagcctgcaggaatcaggcagtgggtgatagagcctcacataggcacttgcaggcatcctgggatctccccagtagggtcctgttttcccaagcccattcttttttttttttttttttttggagacagagtctcactctgtcacccaggctgcagtgtagtggcctctgctcactgccacctcctccttccgagttcaagcaattctcctgccacagcctcctccatagctgggattacaggcacccatgatcatgcccagctaatttttgcatttttagtacacatggggtttcaccatgtgggccaggctggtctcgaactcctgacttcatggtccacccacctcagcctcctaaagtgctcagattacaagcatgagccaccacacccggtctcccagcccattctttggagtaatgccaactataccaggtcttccctcaggctgaaccagtggctggagttgccccaaaagtgacagcaagggagtttccacaagagactgccccaaatcatcctgaaatgggacagttggaattccaaagaaagaagctctgaagcccagagtggtctatccaaagcatgcattagaggaaccgacacacagagggagctgtggtggatccttgcaagggacaaaacagagatgttctgccccagtatgtctgccatgagtgggtctggttatggagtttatatgaaggtttaaggaatttggcttagggccagggctagtttctttcaatgctgtgggcaacatcctaaacatttttatcagtgcgtgggaatgttcaagaccccagcttaggtttaagcctgtagaaaaaaacctgcagctggctgtatcacagagtggtcaagatactctgtagttctcagtcagagaaaaaaatagggagaaagtgagataatagacattacgctttgaagtcagtttttctttttttttaagaaggagtcccactctgtcacccaggctggaatgcactggtgtgatctcagctcactgcaacctccacctcccaggttcaagcagttcttctgcctcagcttcccaagtagctgggattacaggcgcccaccaccacacccagctaatttttgtatttttagtagagatggagtttcatcatgttgtccaggctgatttggaactcctgacctcaagtgatccactcgcctcggcctcccaaagtgctgggattacaggggtaagccaccatgcctggcctgcagtgagaattcatactgggaagtggaagtcagttgttcttcaagatcgtttcatgtatttggtttcctatgcttatctgtatcagttttggtgtggggacagttgtcaatttctacaaaaacacagctgggaatttgaagggattatattgaatctctcggttcacttgtaggatattgttatcttgaaaacattaagtatttttatccttgaaaatcagatatctttcaattattttagatcttgatttctttcagcattaaaaaaaaataagtgtagaccaggcacggtggctcccatctgtaatcccaacactttagtaggcagaagcaggcagattgcttgagcccagttggagaccagcctgggcaacatggagaaaccccatctctacaagaaatacaaaaattagtcagtcatggtggcacacacctgtagtcccagctactgagaaggctgagacatgtggatcaattgagcccaggaggtcgaggttgcaatgagctatgatcacaccactgcactccagcctgggtgaaagagcaagaccttgtctcaaaaaaaaaattaactataaaatctttgcacttctattactttttatagatacttttgaagctagtataaatcaaatttatgcattttattttcattgtcagttgctttaagtataatttttgtatgtgtatcttgtatcttgtgacactgatcaacttattaattctagtagtattttagtgaaactcttacacgtttttatataaaggattatgtcatgtgcgattaagactgttctagaagttgacacagggaaggaggtgggcagtcaggactccagcagggcctgcggggaggtcgcactgaaggaaggggcccaggtcatggaaccttcaagtaacctcactttgttggtgacagacccacaagaacttaaaactctggtaatcagaaacccttattctagacacagccctgtatcaagctaatttcatgggagatgctcaagataaagatgttctattgctatatcctgagttcctgaggctctcatctgtggaaggtttgaagtgagggcatcttccaatgatgcagacgttggctcagctgtcatccacaaatcctcaggtcacttggcaaggggcacccagaggcaacacagggcagacccatcccggccagacctcacctgtgatcacatcttggccaccccacatccctgcccaccaccattttgtctggggagcaagagatgagggttccctccctggacagaagcaggttgtcaggtgttgggagcctgataggtatgccaagatcatatcccaggtcatgcctggcaggataagaagttgagtgttggagaataagtttgtctactcagatgttaatcccaagacttcacattgtaatctcattttctctctggctgaaagtctgtgcagatgctcttgtgtgcctgatatagggaacagatttctaactgggctttctccctgcagagatagccaggcaggtcactgacacctcctggcccagccgctgggcactcttcttgcagaacttcatgcaaatcagtagaaatgagtgataagttcaaccactccatctccttggacaaagggcaggagcaccaccctaccaactacagccagccctggtctggggtgatagtagaaacagaggggtcacctcagacagaaatccaaaacgttcagggcaggcccaggatctcgactcaaatatggagactccattgcccctgtcccagggctttcacacgtaagtgacctgcagtcacttggacctccattcatcaccaacagaaacttggtttggtgctaagttcttgctcacatagttgtagaaagaggagagaaaatagttttgtattgtttgcactaggccatgagtatctttccatgttgctactatttatatatatatatatatatatatatatatatttttttttttgagacagagtctcactctgtcacccaggctggagtgcagttatatatatatatatatatatatatatatatatattttttttttttttttgagacagagtctcactctgtcacccaggctggagtgcagtggcccgatctcatctcactgcaacctctgcctctgggtttcagtgattttactgcctcagcctcccaggtagctgagattctaggcaagtgccaacacatccggctaatttttgtatttttagtagagacggggtttcaccatgttagccaggctggtcttgaactcctgacctcaggtgatccaccagcctcagcctcccaaagtgctgggattacaggcatgagccacaatgcccagcctatgtatattgttttaaacacccaccccaggtatttcctgtagcaggcaactgcactgccctgccagacctttaagatttaaaagctcacacccctactagggatgtttttacacaaaaaggggggctcaaaggggagggaggatggtgaagttgctctatgtattggttatcccacataactcattcctatagccccactcagggctggagctgcaacctcacatgtcttcataatattccataaaggaggcaatttccctcagcagttcagccttgcaattcaggtggagcctggacatgatcatcttctgtttccatttcagccattcctcaggaaacatcctatgtgtgccctaacagcctgtaaccatctgctagagcttccatacacagcactgcagcctgagggacattgacagcagaaacttagtttcccacaattctggaggctagaaatccaacaacaagttgttagctaggatggtttctctaagaactctctccttggcttgtagatggcttgtagatttctatctctgtgtccttactgccccttctaataaggactccagtcatattggatttggatccactccaatggactcaaaacttataacctctttggaggccatatgtccaaatacagtcaattctgaggcactcagtgttagaacatgagctttggggaggggacaccactcagtccatcggatatattattcccttgtagatgacaaactcccgggagactgactgctcggtgaaaggatatgcatatgtaaaattctaatatctatagccagatcactttacaaaagggctttggaaggtacactgccaccagcaatttctgaatatagatgcttccctgaatccagattctcctggatgttaactttcttttaattttttggcaatctggtatccatgtggtgaataatatcatgttgatttgtgttgatttccagttttctgactgacatttttgagtcatctttcaattgcttaatacagatgtgttttccctgagtcatctggtcagattcttggccctttaaatgggctttctcccatcctggactctcccagcatttgcccgcttgtcatgtctggaattgtagctgtttggcaagattacttttaatgttaaaaaattgtgtcgcttaaagacaaaaaggtattcctaggctgtcctgcccagtgcactgtctctaaaatagaacatgaggcttcttgaggaccattccatccatgtgaaatgcagacagagcctccagtagcttgaaggaaattacttgcagccctcgctgtttatggttctcagttctgacccatgtgctgttgaacagacatttgacattgcaaagcctgtgttttcccaactctacaagaaggacattttttaaagactcactgggataattctgttcatacaggatattaataaagatgagtgctgttgattcacagatggcaaagtatcatgaaggtgccttgaaggtgttaatggcttaattattctccacgtccacataaaaccttgtcgtcattacttgtttgtttttcagatggagtttcactcttgtcacctaagctggagttcaatggcatgatcttggctcactgcaacctctgcctcctgggttgaagtgattctcctgcttcagcctcctaagtagctgggattacaggcacctgccaacacgcctggctaattttctgtattattagtagagatggggtttcaccttgttggccaggctgatcttgatctcttgacttcaggtgatccacccacctcagccccccaaggtgctgggattacaggtgtgagccaccatgcctggcccatataaaactttagaagcctagaaccttcttcaccagggacacctgtgtcctccacatgcataagtctctgaagaataggagcttcctggggccaggcacggtggctcacacatgtaatcccagcactttgggaggccgaggcgagcagatcatgaggtcaggagattgagaccatcttggctaacacggtgaaacctcatctctactaaaaatacaaaaaattagccaggcttggtggcaggcacctgtagtcccagctactcgggaggctgaggcaggagaatggcgtgaacccaggaggcggagcttgcagtgagccaagatcatgccactgcactccagcctgggcgacacagtgagactccgtctcaaaaaaaaaaaaaaaaaagaatagacgcttcctggaataagctccagcccctaatctgccagtgattcacagtactgtcattgaccatatatgtctcttcttgttcccctccatatgaaaataagtctaccctaaaccttgaggtgggaattatgcagatactcccagtcaggtacaaaggagaagccgaatgagcctctggtactactcaacttggtactccaagttgaaccatcttctttaccatcttcctgggctcttaccaggacttcaccattactccacagttcctgggccagctatttagtgggtagtctgtctcctccaagacacaattgtgactctgcaagctactaggtgggtaataaggatatcactgaagctctctaagcctgtctatgcctttgaaaaatgggaagatgaacctcatagagttattgtagggactaaattccataagacacagcaagcagttgcccagtgcctggctctgtacaaaggctgcttaggatgctctcgttgcttatatttttttctgtctttttgcccaagaagttctctgcctcattggcctgtgtccctctacattttgaacagcacctagaaagcaaaaacatttttgcattggtaaaccacatttgagattccttctagctggattttgtccttgacacagaatgaacaaacttcccagggagctgaaagaggagtccctacccaactcagatatctgaggaggttctttttgaggtttgtttattcaataaatctattttcagcacaatgtgtaaagtcagttttctagatgcttgacatcattcagtgaacaaagatgacagtccctggacctctgcatgtttactgctaattatgaagcttctgttacacagctagcactgtcctgtgtgtgttcatttatgtaccaaaacaacctcataatgtatgaagccttctattgtttacataaacaaattggctcaataaacttgattatttccatcacaaaaataacaaacatcaaacaaaaagtggcttaaatggagttcttcaattaaaagaaaaacaatggaatgtgacttaaaacactcactgtagaaacactaacatttaaagttattttctgagcacgattaactttcataaaagtcattcttataatcccagagaacatcatataaagaatacttcatgaaccttggaatgagaaaattttatactaggtccagcaaaagaaacatgcaagaaaaaaaatcagaggatttccatggagattctgagccaaggggccataagattttagataaatgagttcgacacaaagcagagaaaatagatttgctttcagaatcttagaggttttgatctgcttagtaaattatcaacactttttaaaattatctgtactgatctaatgtttgtcttttcttctcaaaataggtacacactcacacacatagttacattcaccacaaatctcctacacctgaagtttatctataaagtaatatatttgtatatgtaaagccaggtaaatcaaaactaaaaatctatgttttgcagactagagtgagcacattcagaaaaatgtagaataaaaattttaaaatagtcattcagaattcagaaatatgtgactatattttattatagtcctatgtaatcttcattataaccatcataatgatcctgtagttgcaaaaagaagaaaaaaataaaaattttacctctggtaacaatattccactgggaagaaggattacaaaagatatagtatatatctttctatatagtatacatctatagtatatagtagattgtgactatcagttacctacaacatggggtaaggtgggataggttaatgttggtggtaagatgcatttcattcaatggaaaacagtcttaacacattaaaaacaattttattccattaaaataaattaagttcaaacattatctcaaaaagcattttaaactccactgcatttcattattttaatgtataactggtagaacaatttacttctatggttcaaaattcttctcttctcctacaatgcagaataatattaccctaaacacctacctcatgaatcacttgcaacactgttataaagggcctctccacttagattttcttcatgcatcttacattcaagtgtttttagtgttacatggaaaagtgtattaatggtgcccacctaatagagaaagatgtctcagagctctgatgcagaaatcattaaccatgtgctttcacataagcactaggaatgaagatataatatcaagaaatttttgaatttaatttacataaatatttgcttttcaaaataactataataatttcaattccaaaaagtataattagaatgtaattgtaactgtccaaaaaagagaaaaatcaatctccttctccatttaaacttatgtacaagtaagcaacctattttaaattattctctgtaatcaacactgattacagtaatgtctcaaactgttactgccttggtgttttctactgtcaatctgtgacgtttacttaggcttggcttctaatgtatttttcacatttcctatatctgtataaagtattctagtagaaactctccagtgttttctaaggtatatgtatggaacaaaagtttttccacattgattacatccataaggtttttcctcaatatcaagtttgaggaactccaggagtttcccttcagtataaatttttcactgtacaataaaatctgtggtgtaaggtattgtgactttctttatatttgtaatgcttttcttcactaacgtaatcttgtgcacgttaagggttacattttgtgaacgatccttcaacagtcattacattaatatcacttttttttaggatgaaatcactgatgtagattgtgatgtcagcattcattaatgattttgccacattttttaccttggtagtgtttctctccagaatgaattcacttaagtaaaagttgagcacaaattaaaacctttgctacatccttacaattgtaggggctctctatcatgtggattatcttatattcactaaggattgagcactgatcaaagacttaccacattcttcatatttctagggtttctctccagtgtgaattctcttatgtttagtaaggttggagaaccagttaaaggctttgccacatttttctcatttgtagggttattctccagtattaattacgttgtgtccaataagatatgagctctggttaaaggttttgccacacattcttcacatttgtagcattttttttttgagacggagtctcgctctgtcacccaggctggagtgcagtgtcgcgatcttggcttactgcaagctccgcctcccaggttcacgccattctccttcctcagcctcccgagtagctgggactacaggcacctgtgaccacgccttgctaattttttgtatttttagtagagacggcgtctcactgtgttagccaggatggtctcgaactcctgacctcatgatccacccacctcaacctcctaaagtgctgggattccaggtgtgagccaccacgcccagcctcatatttgcagcatttctttccagtatgaattatcttatgtttagtaaggactgacccatgcataaaagcttttccacatttttcacaattgtagggtttctctccagcatgaattctcttatgttgagaaaagtatgagaaccagttcaaacttttgccacattcttcatatgtgcagggtttctttccagtatgagttctcttgtgtccagtgagatgtgagcccaggttgaaggctttgtcacattcttcacatttttaaggttgctctccagtatgaattctcttatgtccaataaaagtgtgagcactggttaaaggcttttccacattcttcacatttgtagggtttctctatagtacgaattctcttattttgaataagagaataactgatttgagaacccattaaaggcgttgccacattccttacatttgtatggtttctctcctgtatgaattctcttatgttgagtaaggattgaacactagttaaaagctttgtcacattcaacacattgaaagattttggtaagggtagttgataaatattggttaagtccattataactttttttctgtccgttacactcacccacaattttccagtcttttcttaagtttaaatttgcagtgccatagctttcatatcttctcagtatcacttttgggaataaatgttttatgctctgctcaggcaaatgtctggagtaaaatgaaaggacacagctaaaagaaataaaaataaattataccacttattagactcaggtgaatatactttacaaacacaaaatataaaattataccaagcacaataaaatggcataatgccacacacccaaattccttaatagacatgcaaacttaacaaaaatatattgaccaaaatgcctttgtaagagctctaaaaaccagttaagaggttgtagtgccacagatgagaataatgctcagagccacatagaagacaaaggagcatttgttacatttacccaccacagccatacctcctccccaatacaaaataatgcctttaagtgtaaactctcaactcttggcttctctctcaaaagtgaaaaaaaagaaatagtggcacatgtgtccatacttctggctttgaggtgtctttccaaagactggtttctctctaccatgacatagaatgctgaaagaaatggtgctatactttgaatgacaggttaatgtctgtgagacaaaaggtatttacagcagagagactgtaggaccacggaaaaacagcaggtgtaccaactaattacaggctcttcagcagaaactttggcgaacccacataactcaataaagggaacacaaatctagagaagacacatcttaagaacaggtttgagaaattctcagtatctagcctggtaaattggtgtcagacactgcagggaagaaagccgctttgtgcagagtgtgatgggtggctttttatttttaatgtacatatctcaaccaaacgttaaaatatataccaagtatcagtccaacatggcccaatcaaagaaacaagtatgcagaaatcaaccctaaagaaatgaagatgtataaattatctggaaaaaatcaaaataaccatctcagttatgctcaatgtgtaacatgggaacacaggcaactaagtgtaatcagaaaaataagaatatcaacaaagtgacaaaaagaaacaagtgttagagcagaggtatacaaaaaatgactgagaaattttccaatgtaagaaaaaatattaaaaactgaagctcaacaaactccaactcagataaaagacccataacaagacacaatataaggaaagttttgcaagtcgcagaagataatcttgaatgcagaaagacaaaagagatgcatcacctatatgcatgctcctgcaagattaccagtgaagttttgaacataaaaccttgcagatagataggaggagagttgggttatatagtccaagtgctgaaggaaaaaaaacttttagcaaaactgtcctacaaaatttttgaaaataaagattttccaagataactaaatgctcagaaagtgcatcaccagtacgactgtcctacaaaaaatgcaaaaagaagtctttcccattgaaaatttaaaatgatagaaaaccaaccacatcatataaaatacacaactctctgggaaagatctgcacatacacaaaactaaaactttgtagtattaaaattaggcagaaaacaatagtgctttaaaatttgaaagacatcataaaaattaaaacacccattcatatatgtcatacttagtgacattataagttgagggcagatgtaatgagcaagaatttttgtatgcaactgagtgcaagttgttactagtttaaaatatacagttgtaactttaagagattttatgtaatttacatggtaaccataaagaaaatgcagatatgcaatagaaaataaaaaagcaaagcatgtcactacaaatatcaacaagacacaaaggaatacaaagtaaatagggacaaaataggcacaagattcaaataaaacaataaaatagtaattgcaagttatttcctttcagaaaattattaaaatattcatggactaaacttcccaatcaaaacgcaaatattaaataaagggttttttttaatttaaaaaacaaaatccacctatgtcatgtcttcaagagactcacttcagatctaatgatgaaaatagacaaagtggcaggatggaaaaagacactccatgcaaatgttaaccaaacgagaggtggagagctaattatattaagtcaaaagctgtcatattttataaaatatagtttaagtcaaaactcacaagagacaaacaaggacattatagtataataaaatggttcattcactgggaacctatttatatctgctaccagggttcccaaatatttaaagcaagcattgacagaaatgaatataacaatgggagagtacttcaatactttcagtaatgaataataaagcatgacagaacattaataagggaacaaagaacttgaaagcagtgtaaagcaattacacctaaaagacgtatacaggacacaccacacaacagcagaatccacaaacttttcgaaagctcataagaaaattctcctggatacaacaccttttatctcacaagacaagtcttaatccatgtttaaactggaatcttacgcattattatttttggccaaattgtgtgaaactaaaaatcactaacaacaggaaaacaaaaaaaacacaaaatatgaaaattaaacaatacactcttaagcatgctcttgttcaaaggttggaagactgtgaagatggccatactgaccaaattgatctatctacacattcaatacgatccctttcaaattccaaatttcacttttccaaaaattaaaaaaccaaccctcaaatcatatggaatatcaagaaaccacaaagagcctggctatttgtaaaacaaaaacaatattggaggcatcgtgcttaatgatttcaaaatacaaaatgaaggtagggtaatcaaagcactttgatactggcataaaagtaaaatcctacaccaataaaacagaaaacagcacagaaaaaaacagtcacatgtatggtcaaatgagttattaacaccatgtattgtggcattattcacaaaagccaataggtgaaatcaacccaaacttccctcaccaaatgaatggataaatataatttggaatataaaaataatggaatatttttattctcattttaactcattttaactcgttttaactcagcttaaaaaaaaacaagaaatctaacatctaccataaacataaatcttaatgatattatgtaaaatttaatgagccagctgaaaaaagacaaatactttatgaatccacttatatgggatatctgaagtagttacactattgaaaagagaaaatagaataatgtttggaaagggccaggcaatgggaaataggattcacctagattgtgtattagtttcacaagataaaaacattctaggctgggtacggtggctcacacctgtaatcccagcacttcgggaggtcaaggaaggcagatcacatgaggtcaggagttgaagaccagcctgaccaacatggtaaaatcccatctctactaaaaatacaaaaattagccaggcatggtggcacatgcctgtaatcccagctactcaggaggctgagccaggagaattatctgaaaaaaaaatcaaaataaccatctcaattatgctcaatatgtaacatgggaacacagacaactaagtgtaatcaggaaaataagaacctgggagattgcagcaagccgagattgcaccactgcactccagcctgggcaacagaatgagactctgtctcaatgaaataatataaaaatagaaaacattctacagatatgttgctaacagtgtcaatatatgtaacataaactaaactacataatttgaagtagttaagattgtacattttgggttgtattttagacaagtaaaaataaataaacatgcaatagagttacaagtcttttcaacacttacctccaaatcacaaaatgtttctctcacatcaagataatacatattcaccaataaacaggtgtggaaattaagacaatttctatgactactcaccgacacaagagaaaataaccaactatcaccaaccaaaataacaattatatacaaattatttttaaaatgcgtgtaatagttatacaggccaacacaaagataattatagtggcaatagatgtatggctgatctatacttgacttctgctgtacactggcttaaagtgtatgaagttcaatattgtcatacagaattatataaatcaaaacaaaaacacaagtaaaatgagttaggataggtttagcctatcctaaaccatgagatatcgacaaataaaactgcaaaacaaaaatttaaaaccacattaacctggccgggcatggtggctcatgcctgtaataccagcactttgggaggccaaagcaggcagatcacctaatgtcaggagttcgaggccagcctggccaacatggtgaaaccctgtctctactaaaaaatacaaaaattaactgggcatggtggccagcaccttaatcccagcaacttgaggggcagatgcaggagaaatatttgaacccgggaggcagaggtttcagtgagccgagatcaagccactcaagcctgggggaaaagagcgagacttctctcaaatacaaacaaacaaacaaaaaaacctctaacctaaaaagtcttgaataaacatagttaactactgaatccttctagatacctacagtgttcaactatgactgggcatccataaagagcaaatatttgattttattaaaactcaacttttaggttcaagggttacatgtgcagatttgttacatgggtgtattgcgtgatgttgaggtttagggtaggattgatcccatcagccaggcagtgagcatagtacccagcgggtagtttttcaacccttggcccactccccgcccaacccagtggtctccagtgtctgctgtttccatcttcacgtggcacgatcacaggttactgcagcattgaccttcccagttcaagcgatcctcctgcctcagtctcctgagtagccaggactacaggcatgcactactacatacatctaatttttgtatttttagtagagacagggttttgatacattgtccagatttgcctcgaactcctgggttccagcaatcctttgcctcagcctcccaaagttctgggattacaggcgtgagccactgcacctggcagaaatttttaaatctgaggactgtgaactacctctaagttattaggcccacacaggcacaggaattaggcagcagttatgtctcactcccctcttaaactatgtaatcattctgtgaagctgcttgctctgtggaatctggactgactgatgcaacaggtggctagaaattaacctaaaattccacatgctggacaacaaaacccacaccgtgtagttcaacaatgtatattcaatcactatcagtgttatttcttgtgcagttcatgagcatcattcctcaaggtgtcacccaagagctgtgaatcatgggccaacccttttgtgtaccagtgcatagtaaaccagtgtgaattccagataacattgtatcagcccacttcctattattcttttgtctttataaaccttgtaacaaaggctgaatgtggttcctacttgaggttatttgagtctgagtctctcaagcagctgtcctcaccttggcctcaagcaaattctttaaaattctatttggtggctgagcgtggttggctcactcctgtaatctcaacactttgggaggtgtaggtgtgcagatcgcctgaggccaggagttcaagacaaacctggccaacatgatggaaccccgtctccactaaaaatacagaaattatctgggcatggtggcaggtgcctgtaatcccagctactcaggaggctgaggcaggagaatcacttgaacctgggaggcagaggttacagtgaactgagatcatgccactgcactccagcctgggcaacaagagtgaaactctgtctcaaaacaaaattatattttgtgccgtagcttttttcgttaggtcaatatttctggtgcggtgagcaagactgcaggattcagagactctcttcccatcccccaaccaaccaacactcctagacttggtgcctggccgaccagaacctcttgtgttcctctggctccaagtacactgtcaagggtaaggggtgagtcctcctgaatttgggcctccttatttgttggtgaggtctagacttcagttgagctgttcttttcaaccctccctttctagaaaatacgtttccatctccaaccacaggcaggagatttgggtttcagaatttaaaaaaagaaaaaagaaagaaagaaaaacttctttatctgcctcatgataggaggtctggggtgtgatgctggcagtctaacattgctggtttcactgtttttttgtttttttttttttgagatggagtctcactctgtcacccagactggagtgccacggtgcaatctcgtctcactgcaacctctgcctcccagttcaagtgattcttctgcctcagcctcccgagtagctgggattacaggcatatgacaccatgcctggcttatttttgtattttcagtagagatggagtttcaccatgttggccaggctgtggagtgcaacctctgcactgcacacatccaaacaacaaagcataatattctgcccattaagtcaatatctgttctgaatcttgggcagattgcttgaggccacgtgtttgagaccattttttgaggcatgagccactgcacctggttgtttcctcctgtgccattgcactctagcctgggcaacaagagcgaaactctgtccaaaaaaaaaaaaaaaaaaaaaaaaagaaaagaaaagaaatggcctaagtgactattcctctacccttcccccagatgtacattgtgtatttggtgaaagtctgattaaaggccaggcatggtggctcatgcctgtaatcccgctactttggaaggctgaggcaggtgggtcacctgaggtcaagagttcaagatcagcctggccaagatgtgaaaccccatctctactaaaaatacaaaaattagctgggtgtgatggcggttgcctgtaatcccagctactcgggagactattattgttattgctgttattattgatattgttattattaataccttgccaggctttgagtttttatattttgtattcttagtagagacagggtcttgctatgttgctcaggctggttttgaactcctggactcaagcgatgctcctgcctcagcctctcaaagtgctgggattacaggcgtgagcccccaggcctagccactggagaatttattaaaaatgcaaatttctggacagccacggtggctcatacctgtaatctcagcacttcaggaggctgaggtgggcggatcgcttgacggtgggagtttgagaccaccctgaccaacatggtgaaaccctgtctccactaaaaatacaaaattacccaggcatggtggcacattcttgtaatcccagctactcagtaggctgaggcaggagaatcacttgaactcgggaggcgaaggttgcagtgagccgagatcgcaccactgcactccagcctgggtaacaagagtgaaactccatctaaaaataaaaaataataataataaaataaatacaaattgctggggaccacccccagaatctctgattcagccatccagagtggggcctcacatcacatttctcaggaattctgaggtgaggctggtgctcctagttgggggactagcttcaagaaacactgctttttttcttttttttaagatgaagtcttgctctgtcacacaagctggagtgcaacggcgcaatctctgctcaccgtaatctccatctcccgggttcaagcgatcctcccacctcagcctcccaaagtgctaggattacaggcatgagccaccatgcctggcccatgtcctgaggtcttgcctgctgtctgccaatggcaaaataaacagcatgatgctgctaatgctcaaagtggccctgggcaaggtggagaggggaggccaggaaagcggtggggctccaggggtcgtactttcaggcagcactcattggctgtgtggatgccctcatcattggagttgagtttgaaggcaccctgggcccattcctcagccacctgtatcaggtagcagcaatgccaggggtcaggtgagcaggcatcagcagccaagggagcccctgcccaccctatccctgatgactgactgtccctgtccaggagctgagtcccggaagcacaccttgggagggggcatctggggcccagcacaccttcacccatgagccatgtgggccacaggagtcattaaaggatggagagaggcggtcatcaaggcacacagttaaacagcacatgagaatatacttagtttaacgtgaactaaggggttcacattgaacctattatgattcttagtcaccaaccaattcatactcacctgttttcccaagccgattctctttttttttttgaggggttacaggtgtgggccaccacaccccggccgcagccagtctgttttcagagatggtctttgggttaatgagaattctccccctgcttactcgccaggcagtgtggcgttctcaatccaagggggctgcgcatagggagatgggatttgtttgctcagtttggactcagcgttttttgcacttcgatttaatagacttataaaatgtcaaaggtttaagggagcttagagttcttctggcccacacctggctgatgagaatttctaggggaagtttttttgaaatgccagatctctgcattttgagatcctgatttagtaactccagggttggaacctgagttttctttttcttttgtagaggcaaggtcttcctctgttgccctggctggagtgcagtggtgcgatcacagctcattgcagccttgaattcctaggcccaagcgatcctcctgccgcagcctcccaagtagcaggtactccaggtgtgcaccactgtgcctggctaattttaaatttttttgtgagtgaagcttcccttaatcaatgatggcaccaaacggaaagcaggagagacggaagcacagctcctagacacttagaaaattgcatccgcctgagcggtatcagccctacaaatcagtgttaatttatcttcttctgtagagcttggcacagtggcctggatcacccagtgattcatctaatatccctgtgagtttgcccagcttgcagcttcacaaattacacttgcagcctccttatcaggcaagctaggaaattaaatgtaaatggctatggtgttgctaagaaacatggctgcatacacagacacctgaagctgagaccatcacacgcccattaaagcatcatttcccactgtggctaatgaggtttgaatccttcaaaggaaacctgctgttcttttttaaggtcagaaagtggggtaactcggttataagcaagagatagaatttcccttcctggatgctaggggagtgtgtgtttatgggtatatattggagctctgtggtctcatggctaagtggtgggggtggggactcatgggctggccactggtctgactgtatttcctacacccccacacaccatcctcacagggaggatgacacatgtcatgccatgaaacacctgaccaagcacaggtcaaagctaccaacacatcccattttgtagtaccttgcaaatcttgtatagctgtgagctatgatttatttcatgtaggtgtattgtggtacttgggtcctagtggttacttttcatatcattatttttaccaagcgttttctctcctaaattcaatcaaaagctgcacaatttctatcccctctaccactatttccattcaaggaaggaaatgctggccagatttagagagtgcccgtttcatttctttggagggccatcatttgcttggttgcatatgtacttttccttggttggttctttttaaattttttttttttttagcaatcttcctgcctcagcctccccagtaactgagactacagtcacatgccaccacacctggctaatttttaaaattttttgtagagacaaggtctctcattatgtcgcccaggccagtctccaactcctgggcataagttgtcctcctgccttggcttcccaaagcattggattacgggtgtgaaccaccatgcctggcttaaaattttttgttaaaaacaaacacacacactggcccaggcctacacagggtcaggatcatccgtatcactgtcttccatcgccacatcttgctctgctggaaagtcttcatgggcaataaaactcatggagctgtcatctcctatgacaataattctgtaatggaccctgatggaccagcctgaggctgttttacagttaacttttattttaagtagaggtacactctacaataatgataaaaaggatagtatagtatatatatatatatatatataatatatgtaaactagcaacatagtcatttattatcaagtattctgtactgtacatgctatacttttatacaactgtgaacataggctttttcttttttaacaacagcatcaccacaaacacactagtcatccattgcattgccacattatggtggctccagcatcactaggtgacaggaatttttcagctccattataatcttataggaccaccattctatgtacataaatacgtattgtatgatcccaatttttaaaaataggatcatacaattttgtaccctgtttttccatttaacattatattacaaacatttccccatgtcattattctacatcatcacttttattgcttataattcataatatggacacattctaatttatttaaccaatcctctgttatgtgacaattaggttaattccattttttttgccattatagtcattgctgtaatgaacatccttgaggtttcctctttgcagcaacatttttgaagcacatttttaagtctttgatattgctacattccttctgaaaggctgtacatatttctaaccagctgtgatggattcttctgattacaatttaaaatatatttgtcagtttgatatgcaaagaatgggcatctttatgttaattttaatatcttggatcatgggaggttaaacattctccttgggggtaactgctagaagggatatcttgtgctctcctgcttccagatgggggaggttaaatgttgttagttatcacttaggaagatgaaattgaagcatgctgccaggaagctgagggcagttaaagtagtggctattagccttcagagcccaaagccaatcttcctgagcatcagttttcaatctccgtgagtgggcctcctaatctgggggtatctggcttgtgcaggcctacagcagtgcagacctgggaggagtatgcagtgggacccaggaggcttggggtgtcatcaggaggcatgaggggcctggctacctcaaagattgactttctacacctccaggccttcccctttcccttctcctccatcacgaagataatcaggtatcagcagcttccactgggttctgttgcatctgctaccttccattaaggcacaactagagcacttggtgcaggtgggagattttgagtgtgaagtttgtggtgaatctgttgagtggatggtttagtactgtcagtgctgctgggctgctctcatttctaggtggggagagaggtcagagcagggaccttccagtgagaaggtccagggacggatctgatcacaggaggacaatatcacaaagtgttttgccagtttcaataactcggtttatgaggagaaaacggcgtgaggatggtctgggaagcagtgatgtcagaagtcagggaggcaacaggcagcgtgtgctcctccctggacggccccttcatcatccaaactggcaggtgctctgggaagagtggcctcattccctggaatgtgggaaagagagtggaggtttaatgtgtaatttgcagtccttagaatccattatgggcatgaataagcccagagaggctgcgggcaggagaattaaacacgaatgctcatcgagaccgaggcactggagactgagaagaagttcagttgccaacatctttcactttgggtattgactctgaagtcacttggccaaagccaaatgaagtcagtcaataaaaagggccctggaaggtaatataatgccacaaagatttctcacaatggaaaaagcaggtttggcacccgtgagctctaaattcgtctgagttggtaaacctggactctccacagctctttgagagctggaggctaagaaaatccgagaatggggtttatgtcagccctccttgctgtgaaggaacttgggtcttttggtgttgagtgcacagtggagtcagaggggaggatgtggtggcggcagcggcacacacaattgactgccgtggagaggagaactgcttttggaagaatctgcaggcatttggttgaatttagcggtgtgcctacatttattattaatcatggtgactctgctttgtgtttttcacagtgcattcttgtagatctaacttgaatttcataatataacatattttccacaagtttattgaattttaatttttgccagtcagtgtttgaacaactgctcagcctcatgggaggggtggttttataagcgtgtggaggaagctaagtatgtttacaagctgtggtagcaaatttgaggggtcaggcatggactcccccagtcctgacaggggcgctggggggcaatggtgggctgaatatggcccagtgaaagtctcacgtgagaccacagtagatgccattgtggaagcttagctcccactccaccttggaggtgtcaaggccttgttttctatcccaggatctgtgtgtagttagagcaggagacccttttacctgagaactgttttctttgctgtgtgatctttggcaggttatttaagctctccagccttcagttctcacttgtaagatgagataataataatagcatcaatctcaaggaattgtgtgaaggttaattgagttaatagatttttaaaaagagagaacactcagtgggtattaactattatgatgacaagagtagtaatgaccacgcattttggacttcatagatggaggaagcccaggctggttggagagcttccctgtctcccagcaaggttttaacaaatctaacaaatctccattctctacctgggtggccttgccagggacgtggtgacaagcataaaggggaggagctatggttcttcaggaaggtactgatggaaggataaccagtcctgtgcttttatgaaatagaaaaccaaaatggggaacttgacctagagaatttcattaacctctttaactacatcaaaggcagcagtgaagcaacttctcttgcgtgatgccaagaactgaaagagtgcatgctgtcctccaactcttggccctgccacttaccagctgtataaccagggccagttacttaacctctctgagccttagtttcctcatctgtcaatgggaatgatagtattttatagggttgttgtggttattaatcaagtgacatctgtagaatggctagcaagttattaagttcttggaaccatgtgaagactcagtaaaagccaatcattatgctcattattatgtttattataaatgctcattttttttggagatgaagtcttgctcttgtcccccaggctgaagtgtgatggtgcaatctcggctcactgcaacgtctgcctcctgggttcaagcgattctcctgcctcagcctcctgagtagctgggattacaggcacctgccaccatgcacagctaatttttgtatttttagtagagacggggtttccctatgttggtcaggctggtctcaaactcctgacctcagatgatccgcctgcctcagcctcccaaagtgctgggattacaggcatgaggcactgcacccagcctataaatgctcttattacgagttaccttacggcttatgatttacaaccgaggaagcaggttatttcatggcaggacttgtactgtgatagttctcttcctcgtcatgaaagatgtcaacagcactcatcgggattcccccaccttggctggacctatcctctggccttggtagttgcccatgtgaaaattgggagaaggtgatgcccacctgcttgcacaagggctgggtctaaatcatccagtctctgtgtgtatctacagccctaggaatggggactggctcatggctcttattgcatgatcagggattttgaggatatttgaggtgcccagactcaaaccttccttgtcattacctccttcctagctttttccctctacctaacaattttttctcagcttctcttgaatgtgtcccccttttccatggcctcagttgcctctcgctccctcccctggctttgtcctcttctgcaccctccctgcaattgtttttgtctctccagccccagctcctcattcctcggatgacaggacccagactttcatatggggatggataagttaggaatgcattcagctgtaaataagtaagctgatgcagagtggctgcaacataaggatttatttcattcacatagcactaagtctgaagataggtggttgcctgctttgattcagcgtttctatcgtcatgctcacagctccaggaatcacatctacactcaaggcaggatgaaggaagggaggaagaaaccacaatttgcatttgtttttttttttaatgagaaaagccaaagtttttccagttgtccccagcatacttcctttgtatctcattagcgagagctgtgttaagattccatgcctgccttgtaaatccaggctctgtcatctggcacccaaggacttcgtcatccggcctcaataatgtctcccaattattccccttgatgaaaaccactgctgcaggatttacctttttttttttaaacagtggcctttcaccatctgtacatctcttcatgctaacctctccgcctcaaacactgcttggtccatcttcacctttcaaaactctatatattcaagacataactcaaatgttgcttcttccaggaagccttctttgatcacctcaagtcataacccctgcagctcttgctgatattcatgagacaccggtcacattgccctgtggcagttgatgtgtctcttatctttccaattaaaccattagctttgtgccttttctagcacctagcagggtgccattcacattgtggggctcaggagacatagatcgctggaaaaatctggtttgggatgaatttctgtctcagcccctggagagggtttttcttttcctgaccacattttattaaagctatttttcctattaaaattttccccacaaatgtgttgaggtataattgatgtaaactgcacatatttaaggtgtcagttgggtgaactgtgagatatgtgtacacccataaagcacccccacaatcaagagtgaacatgttcttcaccctaagcagtgcccatgcccctttgtcatctctacctccctttccccaataaactccaaaacagaccttcttgacagttgagtgtgcattttctaaaatcatatgttgatggaattgtatggtttgtatttttttgtctgacttctttcactcaagagaattactttgagattcatctgttgttctgtatatcaagtttgttctgtttcactgctgaatactgttcccttgcatgaatatgccactatctatcagttcatctgtggagatttgggttgtttgggtccagttttggggttttacaaataaagttgctatgaacatttgtgtataagtcattgtatgaacatatgctttcgtttatcctgaaaatatctaggagtggaatggctggatcaaagggtaggcatatattgagtttttaaactcttttatgtagtggtaccattttacattcccactggttctagttgtacatactctcttgccacattttcatttcttccccatatatcaaagttaatgcttttcaaactctaaaaaatttgggtttgtttttgagacagggtcttgctctatcatccaggctggaatgcagtggcatgatctcagttcactgcagcctccaacttccaggctcaagcgattctcccacctcagtctcctgagtagctgggtatacaggtgtgtgcaccaccatgcctgtctaacttttgtattttttggtagagatggggttttgtcatgttgcccagcctggtctcaaactcctggcctcaagggatttgtctgccttggcctcccaatgtcctaggattacaggcacgagccaccatgccccgtctgtttcatttgttttgttttgttttttaaagaagcagaaacctttaagcataataataataataataaaaggccatccctagacccctagtgaggaaagtgcataaggagatagatgctttggctgaagggttgtaggaggcatgtggcgcctgaggccctgggccacctcttccaactctggagccccaggaacacatatatgtagacacccactctaggtgacaagcatgagtcagatttgactttcacttaagttctgggccacagcacctgccagccacgctgagaacctcaccatgacctccaaactgacaaggcttggaggtggcccagacgcagcaggctggactatgaggtgatatctgtcgctggatagaataggtttttcaggatataaatactacctgtccaccaccatgacatgtcagtcaaacttcctccatctccaagacaaatatcagaaactgcatgactcctgacaccaggaacaaagaaacaaattgggaacatcatgtgcaaaaaaagattttaataaagattcagcggctccgtgcatagatcctgccatactgcttattgtgatcttgacagtgatgttgggcgagaatgaatagactgtgaggccattcatattccaggcactgatgagcccaatgcagcctaaatgatggctgactatagacagggaccctttcaggggctgctttgggggacctctggcctcagcctcttggcctctgcaggctctgcgaccctgaagctgaggtttctcactggcctgcagggagcctgaaaaaggcagattcctgggccctcaaccttcatttgccctcctgagccaggaccctgaagagctgcatttttaccatgctctctgtgtgtttcttcctcctcctcattctgcttttttattatagaaaactttaaacatacacaaaagtagacaggaaagtaaaatgaaccctatgcacccacagccgggcttcaacagttacccatagatggccagtcttgttgcatctctactcctactcactgtccccagtattattttgaatcaaatcccagacatcaaattatttcatccagagacaggtccccctatctaaaacataaggggatctttttaaagacataaccataatactattatccccacctaaaaatgagcactgatttctttctggtgcatagtggagtgtgaggaccatggcctaagctctctcagccaatggggaggtcacttcctctggtagtggcagccgtgcctgacacgtgttgcaagagggtggcatttttaaaggaagccggcaggagctctacttctggaaatccaagctcataagtgaaaaacagcaccaagttgagctgaccccttgtgttgcaaagggggccttgggtcctaggcaggactattatctagaatcttgccatccacaccttctatttgtttttaaagccaactttgcattttaacctaaggggtgcagagaagccactgtcaagttccctatggagtagttcctgggggcttaccagtatgacgtcactctgggcagtctttgaatatccagtcagaccccctggatttgatgtgtggctctgcagtttacgcactgtgcattaggaagctggcgcttgctgtaatcagctggcaggggtgttttttgagatagtgacagtagacgacatgctgataaacaggctggatgctgggagtgtctggtgatgcaggtcacccatcttcccctgcttgcctgtgcccactgcctacccaggggtccatgcagatggttttccaagccctaccttcatcccaagagctggattcatggtttcttgcagatgccaaataggaaccagctgggattcccagcactcagaccccccgaggctggtgggcagagacaggccctgttggggctcttgctccagctgtcccccttggagaaccctctgcagtgtgcagcgaggcactcctgggctgactgtcttccagcccttgctcctgaaggcaccatttcacacacatcccaggccccttggaactgagatggccgtggccgcggccttggccgaccaggtgtcccttgattccagtgaggagcagggacataggaaaaggagctttgctggtggaggaggctgcacaaaggagcagtgggatgccaaggtctcctattgctgtccatcctcagggctgaaggctgctcagtaggaagcagccaggaaggtgggctcataggagctgcacccagtacagtggggccaaagtcttaaaggctccccaataacagggcctcttcctctagcaggggccacagtgcgtgcggattgctagacagtggacaaaggatgggttgtatctttgaaggcctaggagtcaaagctactctgcctccttcagctgctgggggttggggggctgaggagtgttccacaagggcccactctctccaggagctgctgcctactggctggatagacacagcttggctcgctcatgcccagcgagacagaaagagttaagctgctgaacctgaaggcaagggaatgctggttgtgctgctgcgtgtgggaaccaaactaagcagccgagacagggcagacagtgtaagaaagctggtgatgagagctgctgctgaataaaatcatcttttaccttcctacagccccctaagtgttctttctgctcatccacccactgccttcagacctcaacatgacatttggcatagtcatgaacctgacagggggaaacagtcttggctttggagtcaggaggtcctgggttctactccctgcaacggggaatcagttggtacaaccataatagggggaagtttgatggcattttttaaaatcataaacacatcagtgtatcctttgacctagcaattccacctgtgcaaaagggcaggtgtacaaggaagttcattgcagtgtatttgtaaccacagaagactggcaacatctcaatgcctatctatagtgggcaagtttaataacctgtggttatttcatacaataacctcttaaaaagaatgaggcagttccatgcattcattgctacaaaacaattgtcagtgatattagagggaagatctacttctggaaatccatgctcataagagaaaaatagcactaagttgggctgaccatttgtgttgcaaaaggggacttgggtcctaagtagggccattatctagaatcttgtcatccaggccatttatttgtttacttatttagcgatggagtctccctctgtggcccagattggagtgcagtggcaccatttctgctcactgcaacctccgtctcccaggttcaagcgattctcctgtctcagtctccctagtagtggggattataggcaccaccatgattggctaatttttgtatttttagtagagactatgtttcaccatgttagccaggctggtctcgaactcctgacctcaagtgatccactcacctcgacctctcaaaagtgctgggattacaggtgtgagccaccatgcctggccaatattttttttaagtgctctcctcaagctaatgtctagattcaatagaatgtcaatcaaaattcccaattttgggggaacttgacaagctgattataatttatatgaaaatgtaaaggcccaagaatagcaaagactttcctaagaatacattctttcttaccagatatcagaacttataacaaaaattatagtaattaatctaatgtagtgctggtgaaagcataaacaagtagacacagggcatagaatagagtttggaaacagactctcatgcatatgtggacactttaagacaaaaggagcagagcacaacactggggagaggagttcttttcgagaaattggtgctgaatcaattggatgctcatttgaaaaaaaaaattaagctagactcctacgtcacaccacatgcaaatcaactgcaggctgggcacagtggctcacacccgtaatcccagcaccttgggaggccaaggcaggtggatcacttgaggtcacgagttcaagaccagcctggcaaacatggtaaccctgtgtctaccaaaaaatataaaaattagccgggtgtggtggtgctcgcctgtaatcccagctattcggcaggctcaggtgggagaatagcttgaaccagggaggcagaggttgcagtgagctaagatcgtgccactgtactctagcctgggtgacagagtgagactctgcttcaaaaataataataataataataataataataataataataataataactgcaaatagaccatagtcctgaatatgaaaaggtaataacaataaatcttttagaattgctctgttcatgtatgactattgagcacttgagatgtgctattaagtgtaaaatttgcactggattttaagcacttagtagaaaaaaacttaaaatatctgtattttaacattaaaattttgaaataataatttggatacactgagttaaacattactaaaattagttttatctaattatttttgttctgttaatgtggatactagataattttaaattgcatgtgtggcttcctatttttattgaaaagcactaatctagaaggtaatagagacatataccttcaggacatcaaattaggaagaggtctgttaaattgtatttcaaaagtttgaatcaggcagggcgaggtggctcatgcctgtaattccagcactttgggaggctaaggcaggcagatcacctgaggtcgggagttcaagatcagcctgaccaacacagagaaaccctgtctctaccaaaaatacaaaattagccagatgtggtggtgcatgcctgtaatcccagctacttgggaggctgaggcaggagaatcgcttgaacccaggaggcggaggttgcagtgagccaagatcgtgccattgcactccagcctgggcaactagagcaaaactccatctcaaaaaaaaaaaaaaaaaaaaaaaggcatgaatcaaaacggaaaagactaagagattaatatttgaccacactgatattttgctgtcaaaaagacataattaaaagactaaaaagccacagagaagaaaatacatttgcagcacctacaactctcaaaggacttatgtcaataatatataaactccagcaaattgataaagaaaagacaacccagtagaaacaaaggaaaacatttggaatggatgcttcacaaaagagaattgttaaatgaccagtaaacataaaaaagtgttcagcttcattaataagtcagaaaatatatattaaaaccataatgaaatacccctacaaacccaccagaattactataattaaaacagtcaacaagattgtggagcaacaagaatatatatttattcttgtttttagatgtctctctctatatataaatgtgcacccagagacatctaaaaacaatggtcatgagagcattatttggaatagcccaggttgaaaccacccaatgtccattagcagttgaagggctaaataaatggtggtatatcacagaagggcacagtacatagtaatgaaaaaaaaagaaaccacagctatatatgacagcataaatgaatttcacaagcaaagtgttgagcaaaagaagctgaataaaaaagcatgcaaactacataattccgtttatatagggtaaaaacaaaaacaaacacaaactcagctaaggggatctacagtgttaggagtcaggatgagggttccctttgaggaggaaagagaagacagtgtttgggaagggccatgggcggattctggggtgctgtcaatgttctgtttcttgacttgtgtgttacaaatgtatattttgggctgggtgcagtggctgacgcctgtgatctcagcactttgggaggccgaggcaggtggatcacctcaggttaggagtttgaaaccagcctggccagcatggtgaaacccagtctctactaaaaatacaaaaaaattagccaggcatggtcgcaggcacctgtaatcccagctactcgggaggctgaggcaggagaatcgcttgaaccccagggggcagaggttacagtgagccaagatcacaccactgcactccagcctgggcaacaagagcaaaactctatctcaaaaaaaaaaaagtgtattttgtgatgaattcgtgtgatatatatatttttgaggagagcgtcgttctgtgatgaacaataaaaaggttttgttttgtttttattttgtattatttcaaaatattttttaaaatttaatatctaaatatgctatttaaatattcaaaatttctgatgatggtttcacttttccatcatgacatttttgcggttaaatcagttaatttctttgggaggccaaggccggcagatcatctgaggtcaggagttcgagaccagcctgaccaatatggtgaaaccctgactctactaaaaagactaaataggccaggtgcggtggctcacgcctgtaatcccagcactctgggaggccgaggcgggcgaatcacgaggtcaggagttccagaccatcctggctgacatggtgaaaccccatctctactaaaaatacaaaaaagttagccaggtgtggtggtgggcacctgtagtcccagctactccggaggctgaggcaggagaatggtgtgaacccagacgcggagcttgcagtgagccgagatcgcgccactgcactcaagcctgggagacagagcgagactcagtctcaaaaaataaaaataaaaataaagacaaaatattagccaggcatagtggcgcatgcctgtaatcccagctacttgggaggcttgagacaggagaatcacttgaactcaggaagcggaggttgcagtaagccgacatagagccattgcactccagcctgggcaacaagagtgaaactccatctcaaaaaaaaaattcaattaatgtgattaaatcaatcaatttttgtggttgggtcggttctgtgattgagtcattttgtgcttagatcaagcccagccctgacagcctttaagagtgccaataagtatatacacatgtaatttttgtttttttgagacagagtcttgctccatcacccaggctggagtgcagttgcgcaatctcggctcactgcaagctccatctcctgggttcacgccattctcccgcctcagcctcctgagtagctgggactacaggttcccaccaccacacccagctattttttttttttttttttgtattttttagtagacacagggtttcaccgtgttaaccaggaaggtcttgatctcctgacctcgtgatctgcccacctcagcctcccaaagtgctgggattacaggtgggacccaccacgcccagccatatacgtgtaatttcttttatataatttcaacttttattttagattcagacagtacatgtgcaggtttcttacatatcatgtgatgctgaggtttggggtacaaatgatcccatcacccagatcatgagcatagtacccaatcgttagtttttctgcccttgccttccctctctcttccctctgccccatctagtagcatcttgtgtctgctattcccatctttatgtccatatgtacccaatgtatgtccatatatcccacttgtaagtaagaacatgcaacatttggttttctgtttctatgttaattctgttaggatgatggcctctagctgcatccatgttgctgcaaaagacatgttcttttttatggctgtgtagtattttacagtatatatgtaccacattttctttatccagtctaccattgatgggtatctaacttgactccatgtcaagatcacaccactgcactccagcctgggcaacaagaggtccctgcgccccacacacaatgaccccgcatcagggtccctgcgccccacacacactgaccctggatcggggaccctgggctgcagaacccatccatgatgtttctgtgcccctggctctggtggcattgggaccctccaggctgggctgagcagggcccccccaccagtgtgttccagcgggagtggacctggattggggggcagggattgacacccaaggggacctgccccagcctcctcctgtactgtaggggttctcgttttccttggctgagggaagtggcctctccctgctgaaacttggggtcgggctgggtgtgagaggaaacgggggtgagcaggaccccaaaccttgggaatcctgagtgtgtgtttgggggggttggggggcaggcctatgatgtgcctgggagctgtctgggggccctcctggggagccaggctcacacactgttgtgtgggactcaacgtggggcagtgtcctggccaggatgaggaaagccatcaccccggggtttgcgggagatacatgcaggctaagatctcgcccacccggctccccgatccactgcagccagagtccctcagccttggccaggacctgaagtccgagcgccatccctgggtctacccggccaggcgggcaccccccgcttacaggtcatccccaccccctccatctgcttccgttagagtgacagctaccttgtcctggtgccctggttgaggggggaagctgcccttggacccgcatcggagccgcgcagcgccttctgttggcagttgttggaagtgcagcctggcgtgagcagtgcctttccctgtagatgggacccagggcagcacagctggaaatgggggatggtaacttgtggaggtgatccccactgtccactgacagcggcagtagtagctgcggactatgcagactcaagacagccccagcccatgtcagcaccaggagctaaaacggagtcaagggtttggtgtggggaccagccgggggcaggcctggggagcccatttggcaatgcgggcaggaaggcgcccactctgggactgtctgggcctgccgggggtctccagccagagaaggtgggtgtgatggggcgcccaacctcgaagggctgagtgccaggccggccctgggggcccgcgctgcccacacggactagatgaagtccagaggcgcccacgtcccactggctcagggcgcgggcctcaaacagctgcttaatgagtgctgacttctcctgctccagctgcgtgatgcgctcactcttctctgtcacctcctgggtgaggagtcggttctgctcattcagcatgaggatggtctgctgctgccggcccagggacgaagtggacgtgcgggcaggaccgggtggggggcggaggaggacttggacagggcctggctggcacaggccgcagccagcagctccctcaggcaccaggccacctcctgtaccttgggcagtagccgccccagtgggcgggggctcccgcagccccatagtcggtgctggtgctcctgcactcattgcagctgctgctggtaccagccgcggccccgcgccgtcatctccaaagcctgcaactgcacagccttctctgctccagcttctttatctgcttcagcaggccgcagtccataccgctggtgatggtgtgactccgacgttcccctggggcactggaggcccgccaggcatcccctgagtccgcctccctggccctgggccctgcaggccactgcacctgcgtctgcactccggctcggttccagcgcggtgctctgggacagctccggctccacggggcagggcgccgcctcggcccgggagcacagctgctccgggctgcgggccgcgccgctgggacggccagatggccgcgcacgcccaggggctggggcttcctctccaggaccgtccgcggctcttcagcgggcgctaacaccaggcgctgccgcggcggcggcggcggcggcggcggcggctggtccctggtcccggccagggcgcatgtggggtcccaggggccgccatcgggctcagcagcgtggtgcgcaagccggccacgaagcgctcgaaggtcaagtagccgctggcctgggccacctggcacaagccctccagcaccccgcgtggctgctcccacgtgttggcgccctgccagcgagactggatctcgtgcaggtgcctgcagccgcaccgcctgttgtccagatgtggaacagggtgtgcaggctctgcagcaaggcgcgcggcagcccctcagtgctgggcgcgggcgcaggcacgggggtaggcacgcggccccgctcggccacggcggccatggccacaggtgcccgggctcggtcccctcctccacccgcgtgtgttcccgggcggccccatggaggggccggcccagagcgctcccagattttttaaagctgaaaaaaattcatttatctctaaatttgccatacaagtagtgttaaagtccttcaggttgaaataaatgaactttaggcagtaactatataagtaaataagcaagctatatgaatatataaagctctttggtaaaggtgaatacttaaacataaaaacagtattattataattttggtttgtaactccgctttttattttctacagaatttaaaagacaaatgcataaaatataattataaatctggtaggtggtatacaatgaataaagataatttgttaggtggtatacaatgaataaagatataatttgttacatcaataacgtaaaaagagtagagctatatagcagtagaattttggtatgtgataagctgatataaattcaaattagaatgttataactctgggatgttgtatgtaattctcatagtgaccaaaaacgaaatatacatcgaatataaacaaaagaaaatgagaataaaaacaaaacgtgtcactacaaaaaaaaaacctaaagataaaagaagtaaataattgagaaaattgactgtcaaaaatcagtaactttgacttattaaaactttccatgctacataaatctgaaaactctatttcacataaaactggagctgaaagagacaaatatttacttatacagttaaaagttacataggaaacaaacactaattttttttagaaaaaaatgtgaaaagagtaaaagtatgccttatactatcatataatttcatgttttatagctctgggaaaatagaaaataaaatgttctcttagcatgaatccttctgtgccccaaaaaagccctatggattataccattattacctaagaagtctattctcaaatgcagcagagtgataatttttacaaggtagatattatttttagatatggaataatattggtgatttcaattttaataacactggattaagatgaaataatgagaagataaaggtccctcagcaacatgactcacaaacattttcaaaagcagtaagaatttacattaattatctttttaaagtcaataatctacatttttaatgtatgcatatagcatagctaatgtactattgctgggtccatttattcaatgaataattgccgctatgtatcagacattgttctaggcctaggaatggatacataagtgaacaaagcaaagattctggttcttgtagagtttccattaaaagaccatttagtaaaattttctttcccccaagttttaaaatccgtaagatcagttaacaacacgtataaaagtcattgtgggccgggcacggtggctcactcataccaggtgtggtgactcatagtgctctgtcactcaggctggagtgcagtggcacaatctctgctcactgcaacctttgccttctgggtacaagtgattctcctgcgtcagctttccaagtagcagtgactacagatgcacaccaccacacccagctaatttttgtattcttagtacagatggggttttgccatgttgtccaggctggtctggaactcctgacctcaagtgatccccccacctcagctcccaaagtgctgggattacagatgtgagccaccacacccagccttattttctacaactttgataactttagcatataccccaaatctgtaagacataatattatcattcaaatgcaactcatggcttctcattgtactctgactttctctagcttttgaattcttgattctaataccagttttaaatctgacacaaaagcatgggagttctaatcaaaatccaaccttttatcataataaaaactatcaagaaattattagtagaatttaagaaggaaaataagcctattaacgtaatattttatgcctatggttccccaacaaagcctccagcttctatttaaatacgaaatgtaaaagtcactactggatccacaaacaggtctatggtaaagaaatttctccacctaaacagctccttttacatgatgttacatgtttctattgtttttttcattttggcaaatattgattgaatgtcatctttgtgtttgtctatgtcctaagtgctgggatacagaatctgaaaagatggacacagcacctgcgttcagggagttcacacttttttttttttttgagacagagtcttgctctgtcaaccaggctggagtgcagtggcgtgatctctgctcactgcaagctccacctcctgggttcacgtcattctcctgcctcagcctctcaagtagctgggattacagctgccagccaccgtgcctggctaatttttgtatttttagtagagacagggtttcaccatgttggtcaggctgatcttgaactcctgacctcaggtggtccacctgcctcagcctcctaaagtgctgggattacaggcatgagccatcacaccccactaggtgttcatgctttaattggggaaaatatacaataagcaagtgaatttttaaaatgagaaccacaatcagagttaaatgctacaaagacaatctcacaggaagatgggatgtagaatataaggctctcaaacagaataataagagaaactaatatttcttatgatctttgtctttgtattagtgctcaactgagtctgccgtgcttcagaagcagccttcattttataaaatctattatttctccttccagttttttctcttcctcaagcttccttatctcctgctgttgaatcattttgagatgctcgaacttgtcctgcagctgtgaaaccaatgtgcagttgtgacaccaaagcacgatgtggctgaacacccaaaagaataggcttttttctgattatcgaacacacccaaatcatcacagtagagcatgatcttaataacaatctgaaaaactcaggagttaaacactcagatatggaatttttcttttctttcgtttttccttttttaagatgaagtctcactctgttgcccaggctggagtgcaatggcatgatctcagctcactgcaacctctatctcctggttcaagtgattctcctgcctcagcctcctgagtagctgggactacaggcatgcaccaccacgcccagctaatttttgtatttttagtagagacagggtttcaccatgttggccagtctgatctcgaactcctgatctcaggtgatccttccactgtggcctcccaaaaactcttttttttttttaatatagagacaaggtctcactatgttgcccaggccagtctcaaactcccaagctcaagtgatcctcccacctcagctttccgaagtgctgggactaactggatgcagtggctcatgcttgtaatctcagcactttgggagaccaaggcgggaggatacagatacaaaattagccaggcgtggtgatgcatgcctgtaatcccagctacttgggaggctgaggcaggagaatcacttgaacccaggaggcagaggttctggtgagccaagattgcaccactgcactacagcctgggcaacaagagcgaaactctatctcaaaaaaaaattgcatatcttgacacaaatgaagataaaaaacaacatatcaatagttacgagatacagcaaaagcagtttaagttcactctcaataaatgcctacattaagaaaaaagaaaaagatcaaataatgtaatttcacacctcaaggaaagagaaaaagaaaaaccaagtgcaaagtcagtaaaagcaagaaaatagtaaaaattgggctaggcgcggtggctcacacctgtaatcccagcactttgggaggccaaggtgggcggatcacctaaggtcaggagttcgagaccagactgaccaacatggagaaaccctgtctctactaaaaacacaaaataagccgggcgtggtggtgcatgcctgtaatctcagctacttgagaggctgaggcacgagaattgcttgaacccgtgaggcagagtttgtggtgagcagagatcgtgccattgcattccagcctgggcaacaagagtgaaacgctgtctcaaaaaaaaaagcaaaaatcatagcagaaataagtaagctatacaacaaaaataagagaaacaacagcaaaaaaattagtgaactaaatctgtttttaaaagataaacaacccttagaaaaactaagaaaaaagagaaaactcaaacaaataaaatcagaaatgaaaggtgatacattactgctgataccaaagaaatacaaatgatgagactactatgaaaaattataagccaataaaatttgataacctaacaaagaaattggataaactttgttaataaactcctataaccacataatctacaaagattgcatcatgaagaaactgaaaatctgaaaagactactaataggtaaggagatttaatcagtaacaaaaaatgctaccaaagaaaaggtagtactaggtgacttttctggggaaggctacaaaacatttaaaattgaaatagtaggccaggtgcagtggctcatgcttgtaatcccagcagtttaggaggctgaagcaggcagatcacttgagctcaggagttcaagaccagcctggacaacatagtgagaccccatctctactaaaagtacaaaaaaaatccaggcagggtggtgcatgcctgtggtcccagctactcaagaagctgaagtgggaggatcacttgggcctgagaaatggaggttgcaacaagctgagatagcaccacttcactccagcctgggtgacagagtgaaatcttgtcttaaataaataaataatatggaaatagtacaaaaatacatcccaaactcttccaaagaattggagagtacgcttcttctttttcttcttatttttgttttttttgagatgaaatctcgctctgtttctaaggctggagtgcagtgcagtggtgtgatctcggctcactgcaactttcacctcctgggttcaagtgattctcctgtctcagcctcctgagtagctaggatgacaagtgtgcaccaccacgcctggctaacttttgtatttttagtagagatggggtttcatcatgttggccaggctggtcttgaactcctgacctgaggtgatctgcctgccttggcctcccaaagtgctgggattacaggcatgagccaccatgtccggccaggataatacacttctaaatgcatttgaagaagacattattactctgatactacagccagaagaggacactatgagaaaaaaaaaatataggccaacatttgtgataagcaaactagcaaatcctcagcaaaatactagcaaactgaattagatcgcacattaaataccagatagtccaagtggaatttattcttgtaatgcaaggatgattcaactacacaaatcaataaatgtgaccacatgcagaaaaacaaaattagatctttatctcaaaccatatgcaaatctcaactcaaaatggatgaaagacttaactgctgtaagatctaaagctgtacaactactttaaaaacttagggataagttccttaacttggtccgagcaatgattttttggatacaaactccaaagcatagacaacataagcaaaaacggacaaataaaattatatcaaactaaaaagctcctgcacagccaaaaaaaaaatcaacagagtaaagaaaagaaccatgaaatgtgagaaaatatttgcgaaccatacatctgataaggggttaatgcccaaaatatacaagaactcaaacaattcaatagtatgaaaacaacctcattccaaaaatgggcaatgaccctgtaatttttttttacttttttttcttttttttgagatggagtctcactctgtcacccaagctggagtgcagtggtgtgatctgggctcaccgtaacttccacctccccggttcaagcgattctcctgcctcagcctcctgaatagctgggactacaggtttgtgccaccacatctggctaatttttgtatgtttaatagagacagggtttcaccatgttggtcaggctggtcttgaactcctgacctcaaatgatctgcccacctcctgacctcaaatgatccgcccacctcagcctcccaaagtgttggaattacaggcatgagccactgcgcctggctgaatctgaacattttttaaaagaagacataaagtccttgcccatgcctatgtcctgaatggtaatgcctaggttttcttcaagggtttttatggtttttggtctaacgtttaagtcattaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgtagtgtgatgcctccagctttgttcttttggcttaggattgacttggcaatgcgggctcttttttgtttccatatgaactttaaagtactattttccaattctgtgaagaaagtcattgttagcttggtggggatggcattgaatctgtaaattaccttgggcagtatggccatcttcacgatattgattcttcctaccgatgagcgtggaatgttcttccatttgtttgtatcctcttttatttcattgagcagcagtttgtagttctccttgaagaggtccttcacatcccttgtaagttggattcctaggtattttattctctttgaagcaattgtgcatgggagttcactcatgatttggctctctttttgtctgttgttggtgtataagaatgcttgtgatttttgtacattgattttgtatcctgagactttgctgaagttgcttatcagcttaaggagattttgggctgagacaatggggttttctagatatacgatcatgtcatctgcaaacaccaaaagcaatggcaacaaaagccaaattgacaaatgggatctaattaaactaaagagcttctgcacagcaaaagaaactaccatcagaatgaacaggcaacctacaaaatgggagaaaatttttgcaacctactcatctaacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactacgcagccataaaaaatgatgagttcatgtctttgtagggacatggatgaaattggaaatcatcattctcagtaaactatcgcaagaacaaaaaaccaaacaccgcatattctcactcataggtgggaattgaataatgagaacacatggacacgggaaggggaacatcacactctggggactgttgtggggtgtgggggggagggatggcgatgggagatatacctaatgctagacgacgagttggtgggggcagcgcaccagcatggcacatgtgtacatatgtaactaacctgcacattgtgcacatgtaccctaaaaaagtataataataataaataaataaataagacataaaaggcaaatagggacatgaaaaaatattcaacctcattaatcatcagagagatgctaatttaaaccacaattagatggcacttcatatctgttagaatggctattaccaaaaaaaagaaagataagtgtttacaataatgattttataaaatgttgatgaaaatgtaaatcagtacagctattatgaaaaacaatatgggagttcattaaacaattgaaaatagaataaccatatggttcagcaaccccactaatagttacatattcaaaggaaataaaatcagtatgtcaaagagatatccacactttcatgtttattgcagcattaattaacagtaatcaagatatgtaatcaatcctaagggaccacatagttgagatatcaaaaagaaactaatccccagaaagaaagaaaaaaaagaagcagacgtacaggaataaggttcataactaagggaagtgaggtgggagagaaagagaaaatttaaatggttgctttggtttctgctcactttctagtttcagtttaagtcttcatgagattcagctatgcctcttgttcttggatgccatgacatacccctgtatacatccagacttttcctttgtacctaagctaatggattttttttttttttttgagaaggagtctcactcttgcccaggctggagtgcagtggcacgatcttggctcactgcaacctccacctcccagtttcaagcaattctcctgcctcagcctcccaagtagctggaattaaaagcatgcaccacgaggcctggctaatttatgtatttttagttgaggcgaggtttcatcatgttggccaggctggtctcaaactcctgaccttaggtgatctgcctgcctccgtctcccaaagtgccggaattataggtttgagccagcacacccggccaaaacttttattacttataattcaactgtctttgagtgagacatctggcctatagcgcctaattaccaatttatttttatgaaaaaggaagttcatgttccaatttacctaacaacactaaatgttcttaaactaaagccacctacacttgagagaaagaaattatggtttcaaaaatgtcttcaccaaaaatgtatttgtggcaattaaaactatattaatagccttcttttccattttattagaaatggcatggaataaaataatttaccaacttaaaattttctcattaatcaaggccagcattagtcaacatttgcttatttataaaagtgaagacaattttctagtgcattaatagcattagacagtacaagactcttctcaaaagtaaatagcttgggtttgtcacaaattaaactttgtgcatgaaaatttaaattataaataaaataaataaatttttataaaatgatcttaagggttatttaaatggaaaattatctaagttctcttgaaaaaacactacagactatacttttgtaaaggctatattccaatctacatggtaaaaagttactttttgaaaaacagcaagtatcctccaaaaactaaactcttgagattaaacccccaaattaattgggcacctaaaaattagtgcaaattatatccaacttcagtactgacttcttttttggcttctttaaatgttgcttctttctccttgactcgctgcataaatctctgtttcaactcttcttcttgcctctgacattgatcatagaactcttgtcttttggcttcagagatttcttgaaaactaaagagaaatgttttcttagtcttatattaaaatgaggtaggagaatcgcttgaacctgggatgaggaggttgcagtgagccaaaattgtgccactgcactccagcctgggagactgagcaagactccatctcaaaaaaaaaataatgctagtataaacatgtaaaaaatatgtattgtatgtaacgtcctatataaggaaatctgccaacattctctcatgtttagcagcacaaaatggaaatttccatatcataagatgtaaaaaccaaggcataatacttaagatcagagtatatagagagtatatgtaaagaatactagaattttccaacacttgtatgagtgaattcttatccccaccactttccagcatatcatacttcttcacatcttttgacaataaaattcagggaaacctctaatgtatgggacaattttcaaaaatagtctaaaataaagcaaagagtctttcaaaatattattcatttaagatagtcaaatttttagtgtctgcagagaacaacaaatgatataactggattatatacactacagtgccatatttttgcagcacgagtcctacttgtgtttttttttttttgaggcagagtcttgctttgttgcccaggctggagtgcagtggcatgatcttggctcactgcaacctccgctgaccaggttcaagtgattctcctgcctcagcctccaaagtaactgggattacaggcgcccgccaccatgcccggataattttttttgtatttttagtagggacagggttttaccatgttggccaggctgatcttaaactcctgacctcaggtgatctgcctgcctcggcctcccaaagtgctgggattacaggcaggagccaccgcacccagctgtattcttcttcaagttagagaagtacacctgctctcaaacttttctcatttaacttccaggacactgcactacagcttttcagctggttcctccatcaaactcttcttaatatcttttgtcaaactttactaatatttttctacctttttctttatcttttttttattttgagatgaagtctagctctgtcacccaagctggagtgcagtgatgcaatctcggctcactgcaaactccacctcctgggttcaagtgattctccagcctcagactcccgagtagctgggattacaggcgcacaccaccatgcccagctaatttttgtatttttagtagagacggggtttcaccatgttagctaagctggtcttgaactcctgacctcagatgatccgcacgcctcggcctcccaaattgttggggttacaggcatgagccactgtgcccagcctatcctgtctttcatataataaatatacctttcatataaatacaaaaaatagaatactaggttttttctttgatacacatttcagcttatatacatattgtatacacatatttcagcataaaaatgagatctcacattgtgtttttcctactaactatctctatcttcatcaaaagatgataaaaacacctaacattcaagatgttttctttaggatggttcaagatgggagaagtataattattctcatgcccaaattattgtaccttgtgtttgtaggggactcctaaattatccatttggttgtgttagcaatattttactcacctaactggctggttcccacatctgcaaagcccattttctgcagtttttggtacctataacattcatagtgctgagtgtgggttttttcttttagattttccatattggtacaaagaagcgtatctcagagcttaatgaagtcacagtgattttcattttccactagtaaaaaaataataatgaatcaaccacactcattatcaatccctgacaatcatgaatgaatgaaatcatgaaataatgaatgaatacatgagtaaaaaacacatttaaaacaacacacaactgaacaatttgattaatagctataattctttaaaccatgtaagtgtggttgtactacacataccaactataggcagagattatttataggttagcaaatttgctttaaagttattacctgaagaataagcaggaaagagtgaaatattttatatgtatatatgctacaggttttggttaacaattgtgttgtatgttataaactacctctgggtattttggagtgctaacagaatatgtaatataacatcactagtgtaaataattttatcaaagtaaattctgctagcaaaaaggccttacaattatacatactttagttggaaagatattccatgcaattagaaactaaaagagggagcacagagagctatattcccatcacagaagatagactttaagtcgaaaactgtaaagtgatatgaagaaggtcatataatgatgaagaggtcagttcattaaaaaaaattgtaaatatatatggacccaatatcagagcttctaaatatataaggcaaatattaacagacctgagggggagatagactatattacaataatagtaagaaacttacataccctactttcagaactggatagattatccagccagaaaatcagtaaaaaaaaaatgtgagatttaaactacactttagaccaaacagacctaatggacatatgtggaatatttcatctgacagcaatgtaatacacatacttctcaaacaaacccaagacattcttcaggacagattatatgttaggccacaaaataagtcttaatatattttaaaagactgaaataaaaatgtgagtgcagatgtcttttgacagatcaatttcattccactagggtacatacccagaagtggtactgctggatcatacagtaatactatttttagtttttgagggaacgtttatattatttcccaaaatggctgtaccaacttaaattcccaccaatgatgtttaagaattcccttttctcttgggaatgtatataaactgctggtgggaatataaattagttcagccattatgaaaagtagtttgataatttctttctttctttttttttttttttgagacagagtttcactcttgtcacccaggctggagtgtagtggtacgatctcagctcactgcaacctctgtcctcctcttgggttcaagcgattctcctgcctcagcttctcgagtagctgggattacagatatccaccaccacgcccagctaatttttgtatttttagtagagacggagtttcaccatgttgactaggctggtttcaaactcctgatctcaggtgacccgcccttttcagcctcccaaagtgctgggattacaggcatgagccaccgtgcccagcctgacaatttcttaatgaagttaaaacagaactaccatttgacccagcaatcccattactgggtttatacccaaaggaatatatattgttctaccataaagacataggcatgtgtatcacagcactattcacaataacaaagacatagaatcaacctaaatgcccatcagtggtagactggatagagaaaacatacatatacaccatggaatactgcacagccataaaaaaaaagaacaagatcgtgtcctttgcagcaacatgaatgaagctgaagccattatcctaagtgatgtaatgcaggaacagaaaaccaaatatcacatactctcttttataagtgggagataaatattgagaacacatgaacacaaacagaggaacaacagacactgaggcctccttgagggtgggaggagagtgaggatagaaaaactactatgtttttcctttttttttttttttttttttttagtatacgtgctgccgaagcgagcattttttttttgtttttgagatggagtctcgctctgttgccgaggctggagtgcaatggcacaatctcggctcactgtaaacttgtaacctccgcctcccaggttcaagaaattctccttcctcagtctcttaagtagctgggattacaggcgcacgccaccatgcccggctaatttttgtattttttagtagagatggggttttgccatgttggttaggctcaggtgatccacacgcctcggcctgccaaagtactgggattacagactcgagccactgcgtccagccagtactatgcttattatgtgtgatgaagtaatctgtacaccaaactcccatgacatggaatttgcctacataacaaacttgcacatgtacccctgaacataaatacaaatttttttaaaaaagaattctcttttctccatatgcttgccagcacttgttatcgtttgtctttttgataatagtcattctaacagacatgagatgatacttcatcatgtgtttaattcacattttcctgatgattagagatgctatttttttcatatttcttttggccatttgtgtttcttcttttgagaaatgcctattcagatcctttgcccatttttccttgtgttgttttcttgctattgagttgttagagtcacagcaaaagtattgtatattttggacattaaccccttatcagatgtataatttgaaaatatttttgccaatctctgggttatatcttcatgctattaattgtttccttttgttttgttgctggtgcttttgaagttcttttttcaattttattttatttgaggcagagtctcgctctgtcacccaggctggagttcagcggcatgatctcagctcactgcaacctctgcctctcagattcaagcgattctcctgcctcagcctccagagtagctgggattaccggcacccaccaccacaccgagctaatttttgtatttttagtagacggggtttcaccatgttggtcaggctggtctgaaactcctgaccttaggtgatccacctgcctcagcctcccaaagtgctgagattacaggcgtgagtcactgcaccctgccagcttttggagttctattcaagaaataattgtcatgaccaatgtcatggaggttttcccctatgttttgttctaatagctttacaattttaagtattgagtttaagacttttatgcattttgagttgatttttgtgcatgctgtgagataagagtccaattttattcttctgtgtgtgaatatccagttttatcaatactatttattgaagagaccatactgtgcccagtatatgttcttggcaccttggtcaaaaatcaattgactatacttaagtttatttatgggcgttctatcctgttatgttgattaatgtgtctgtttttatgccagtgccatgctgtttggattacaattgctttataatatatcttgaaatcaaggagtacaatactttcagctgtgctgttttctgccaaaattgttttgactatgcagggtttcttctagttttgtataattttaggatttttttctacttctgtgaaaaatggcttaggaattttgataggaatggtattaaatctgtagagcacttgtgtagtatggacattttaacaatattatttcttctaatcatgaacatggggtaactttctatttatttgtgtcttctccaattttttttaaacacaaaaccagcatgtattgaaagcaggtatcagctctgattacaacaaatcagcttagagataccattactcagaagaaaaatatatacaaaatatatatgtgtgtgtgtgtgtgtgtataatatatacaatatacacaaaaatctcaaagaaaggagaacaaaagaacttaaaataattaaacttgaaaggtactgtattactaaaatggtcttgttgtaaagtaataacaaataccacaatgagccctacttgagaaaaccatgtgccctcaagcctgggggtgaggactctagttctcaaattcttagaacacagcacaggattctctggggcagagaggctggctgcagcatgagggcctcactgttgactccatttaacaaagtccatgccccagacacaggctaaacacagggaatgaggccaccaggcaaatcacacctgcccctgcccccatgagccccataaaagagaagtggtttctgaaatctacagacttggcagggaccactgggccatagatagcttagagagaattattttgtgatcagtcacataaaaaccctagaatctaagccctacaattcccttatccaaattcccactgactagggaggtagaagagtaagacgtggaagctgtcaccaaaccagtatttggtcttctgtaaacagggataaacataaaacactgtttcagccaggcacagaggctcatgcctgtaatcctggcactacagaaggccgagacaggtggatcacttaaggtcagaagttcaagaacagcctggccaacatggtgaaacatcgtctctagtaaaaatacaaaaattcaccaggcgtagtggcacgtgcctgtaatcccagctacttgggaggctgaagcaggagaatttcttgaatctgggagacggaagttgcagtgagccaagatcatgccattgcactccagcctgggtgacacagcaagactctatttcaaaaaaaaacccaaagaacaaaaaaacaaacactgtttcacaagtgggcttcaaagaactactggacacagcaggtgaaagatcccaaagtcccattgagcacctcccacaggaggaggaggaggaaaaggagggggagggggaggagagatgagtgccagaggggagatgtgcttgttccctgctgaggttactgctgggaacagtgtactgctgggaactctgtctcaaaacaaacaaaaaaaacaaaacaaaaaaaaaaaaaaaagaaagaggaactgtgttttttgccattacttttaatgccataacttctaatagcaaaaactgcaactatttttgcaccaacctaatagtaagtatacagatacacatggaatgttataacaagcttattgtagtgggtaaagcactcatatctgtagtagaaatactaaaatgtaaacctatcaaaaatgataactacaacttttcaagacatagacagtataagatagaaatagaaaatttttaaacgttaaaaaagtggagggatgaagttaaagtgtaaagtttttattagttttttgctcattcattagtttctttgttcatttatgcaatcagtgataagttgtcatcagtttaaaataatgggttataaggtgctatatgcaagcctcacggtaatctcaaaaaaaaatacaatagatacacaaaaaatagaaagcaagaaattaaagtataccatcagagaaaatcacctggactaaaaggaagacaagaaggtaggaaagaaagaagacaagaccacaaagtcaccagaaaacaaataacaaaatgataagagtaagtccttacttatcaataataaccttgaatgtgagtaaatggactaaactctccaatcaagaaacacagagtgattagctgggcatggtggtgggcatctataatcccagctactcgggaggctgaggcaggagaatcgcttgaaccctagaggtggaggttgcagtgagccgagattgtgccattgcactccagcctgggtgacagagcaagactctgtctcaaaaaaaaaccaaaaaccaaaaaacaacaacaaaaaaaacaagacccaatgatccgttgcctacaagaacacacttaaaaagacacaaatagactgaaaataaagggatgggaaaagataattccatgcaaatggaaacaaaaacagaacacgaaaatgtatacttatataagataaaatacatttcaagacaaaaactgtaaaaacagacaaggaaggttcattacttatgaataaagggatcaattcagcaagaggccataacaactataaatatgtacgtacccaacattggagcacttagatatataaaggaaatattattagagctaaagaaaaagaaagattccaatacaataatagctggagacttcaacactccactttcggcattggacagatcatccagacagaaaatcagcaaaaaaatcctgacttaatctgcagtatggaccaaatgaacctaaaagatagttacaggacatttcatccaatggctacagaatgcgcattcttctcctctgcatgtagcatattctcaaggatagagcatatgttaggccacaaaacaagtcttaaacaatgcaaaatatgaaatcatcaagtattatccctgactacaatggaataaaagtgtagatcaataacaagaggaactttggaaactacacaaacacatggaaattaagcaatatgttcctgaatgaccagtgggtcaatgaggaaataaagaaggtaattttaaaatttattgaaacaaatgaaaatggaaatataacataccaaaacctatgggacacagcaaaagcagtaccaagaacaaagtttatagcaataagtgcctacatcaaaaaaagtagaaaaacatcaaataaacaatctaacaatgcatcttaaagaactagaaaagcaagagcaaactaaacccaaaattagtataagaaataataaaaatcagagcagaaagaaatgaaattaaaatgaaaaaaataccagagatcaatgaaatgaaaagtttattttttgaaaatataaacaaaatctgcaaacctttagccagactgagaaagaaaaagagtagatccaaataaataaaatcagagatgaaaaaggagacataatggccaggtgcagtggctcatgcctgtaatcccagcactttgggaggctgaggcaggaggattgcttgagccaggagtttgagaccatcctgggcaacatagtgagaccccatctctaaaaataaaaaaagagaaagaaagaaaaaggagacattacaactgaggctgcagaaatccaaaggctcattagaggccactgtgagccactatatgccaataaatttaaaaacatagaagaaattgatgaattcctagacatatacatactatcaagattgaaccatgaagaaattgtaaacctgaaggacaagtaacaagtaatgagaccaaaatcataataagaagtctcccagcaaagacaagtccaggatctgatggcttcactgctgaatttcagcaaacatttaaagaaccaatactaattctactcaaactattctaaaacatataggagaagggaataaatcagatctcattcaacaaggccagtattaccctgataccaaaaccatagaaagacacatcaaaacaagaaaactccaggccaatatctctgaggaacattgatgaaaaacccctcaaaaaatactagcaaactgaattcaacaacacattaaaaatccttcaccacaactaagtgggatttatcccagggatgcaaagatgcttcagcacacacaaatcaatcaatatggtacatcatatcagtatggtatcataatgaaggacaaaaaccatatgatcatttcaattgatgctgaaagggcatttgataaaattcaatatcccttcatcataaaaaaattcaaaaaactgtggatagaagcaacatacctcaacataataaaagccatgtatggcagactctcagctagtatcatactgaatgggaaaaaacttaaagcttttcctctaagatctggaaaatgacaaggatgcccactttcaccactgttattcaactggaagtcctagctagagcaataagaccagagaaagatataagggggttccaaattggaaaggaagaagtcaaattatccttgtttgcagatgatatgatctcctatgcagaaaaacctaaagactccaccaaaataaaactattagaactgataaacaaaattaataaagttacaacatacaaaatcaacctacaaaaatcagtagcattattatatgccaacagtgaaaaatctgaaaaaaactaatccaatttacaatagctataaataaaataaaatacctagaaataaacatgaccaaagaaatgaaaaatccctacaatgaaaactataaatactgatgtaagaaattgaaaaggatgcaaaataatgagaacatagttcatgttcatggattggaagaatcaataatattgttaaaatgtccatactacccaaagcaatctataatagattcaatgcaatacctgtcaaaatatcagtgacattcttcaaagaaaaagaaaaaacaatcctaagatgtatatggaaccaaaaaaatacttaaagcaattctgggcaaaaataacaacactggaggaatcgcattacctgacttcaaattatactacaaagccattagtgaaacagcatggtaccagcataaaaacagacacacagaccaatggaacagaatagagaacccaggaataaatccatacagccacagagaactcattttcaacaaaggtgccaagcacatacactggggaaaggataagctcttcaataaatggtgttgggaaaactggatatccatatgcagaagaaataaactattatctttcaccacatacaaaaatcaaatcaaaatggattaaagacttaaatgtaagacctcaaactatgaaactactataaaaaacattggggaaactcttcaggatgtttattgagtaataccccacaagcacaggcaatcaaagcaaaaatagacaaatgggatcatctcaaattaaaaaccttctgcaaaacaaaggaaacaatcaacaaagtgaagagacaacctacacaatgagaaaatatttacaaactatttatctgacaagagattaataaccagaatatatttaagtaactcaaacaactcaataggaaaaaatctaataatccaatttaaaatgggcaaaagatctgaatagacatttctccaaagaagacataaaaatgtcttcttttgtcttattgataatagccgttttaacatgtgtgaagtaactgctcattgtgggtgttttaaaatgccgaacaagcaaatgaaaaggtactcaacatcactgattaccagagaaaggcaaataaaaactacaatgaggtatcatctcaccccagttaaaaaagcttttatccaaaagacaggcaataacaaatgctggtgaaggtgtggagaaaaaggaatccttgtacactgttggcaggaatgtcaatcagtacagtctttacggaaaaaagtatggagtttcctcaaaaaaactaaaaatagaactaccatatgatccagcaatcccactagtgggtatatacccagaaaaaaggaaagtagtatattaaagagatagctccactcccatgtttgttacagcagtattcacaatagccaaaatttgaaagcaacctaagtatccatcaccagatgaatgaataaagtaaatgtggtacatatacatgatagagtactgttcagccttaaaaaataatgagatcccgtcatttgcaacaacatgaatggaaccgaggatattatgttaagtgaaataagacacgggaagacaaatttcacatgttctcactcatttgtggagctaaaaattaaaacaattgaacccatggggataaagagaggaatgtttattaccagaaactaggaaaggactggggaggaagagacgtggggatggttgatggtacaagtaaatagttacatagaatgaataagatctagtatttgatagcacagaaggtgactacagtcaacaataatttattgtacattttagaataactaaaagagtatacttggattgtttgtgacacaaagaaaggataaatgcttgagttgatgggtactctatttaccctgatgtgattactacacactgaatgccagtatcaaatatctcatgtgccctataaatacttacacctactatgtatccataaaaattaaaaattaaaaaacaaaggcctggtgtggtggctcatgcctgtaatcctagcagtttgggaggctgaggcaggcatatcacctgcggtcaggagtttgagactagtctgcctaacatgccaaaaccccatctctactaaaaatacaaaaaaaaaattacctgggtatggtggcatgtgcctgtaatcccagctactagggaggctgaggaaggagaattgcttgaacccaggaggcagaggttgcagtgagccgagatcacactattgcactccagcttgggcaacaagagctaaactccatctcaaaaaaagaaaaaaattaaaacacaataagctgttacttcacccatgctaaaatgactattatcaataagacaaacaagtgctggtaaggatgtggaaaaaagggaacccttgtacactgttggtggcaatgtaaattaggacagccattatgaaaaacagtatggagcttcttcaaaaaattaaaaataaaacaactaccatatgatccagcaatcacactactggatatatatacctccccaaaatgaagtcagtatgtcagagagatacctacactaccattactcacaagagccaagatatggaagcaatctaagtgtccatgaatggatgcatgaagaaaaaatgtgtggtatatatatgcaatggaatactattcagccttacaaatcaggaaatcctatcatttgcagcaacatagatggaactagaggactttacactaagtgaatatgccaagcacagaaagacaaatagtaaatgatctcactaacatatcaaatttttaaaagttaaacttatagaaacagagagtagaatgctggttacatgagttaggtagagggtatagtaggagagatgttagtcaaaggatacaaacttttagttagataagaacaagttaaagagatctattgcacaacatagtgactgtgttaataacaatattttatactcttgaaaattgctaagatagatgttaagctttcatcacaaaaataattgagataacacatgttaattatatcaatttagccattccacaatgtatatgtatttcaaaacatcatgttgtacatgataagtacatacaattttatttgtcaattaagattaattaatgaaaaataatttgtatggctctctcctgtgtttatcatgtccagaagattgataatatatggtttattgtgattaatactatgaccaaattttatacatcaacatatagtacagatatatattttataacacatactaatatataatacaacataatatatattaaaacattaagtttatatattaaaacattaagttaaacaaaagtttaacaaattttaaaatttttaatatgtcattttttgaaaaacatcatttggggctgggcatggtggctcatgcctataatcccagcacttttagaggccaaggcaagtggatcacctgaggtcgggagtttgagatcagcctaatatggtgaaaccctgtctctactaaaaatacaaaaattagccaggtgtggtggcaggcacatgtaatcccagctactcagaaggctgaggcaggagaatcacttgaacctgggaggcggaggttgcggcgagccaagatcgtggcacttgcactccagcctgggtgacaagagaaaaatctgtctcaaaaaacaaacaaaaaaaccaaaaatatcatttggaaaccagtacaagtagaaatcttccattccccaataattagtaccataactatatgaacaagataataaattactgcttactacactattctaactcattatgatgctaaataataatataaatgtcaaaggtataatctttagccaaaggtaaattgtactttgttttaaaaagtttatcactcttttttctagtgaccagtttaaaatggtttctacattagctagcaatgagtttatgcaacacatctacacactagtatttttgcttccattttgtttaaagtgctttccagcattctcaatgtcataatttatacaaagacagataatatgcacgtggcacattgggagcattgggataaacaaagaggttcttcccagcctctggagattttggcttaaagcagcgttcagcagacttctatgagaatgagtcattgtcacagtaagcattaatttacataaaacagagtttgcattcctcattagtaattgttaacttacagattagcaagagttaccaatattagctcaatttaaaatgttactttgagactacaaatgatacacatatatttaacttaatcattccagagtctgccctccttcatatttaccttgcaaaactccccaagggtagtaacagcctctgaccaccctttttccaactttcacttcaaccatactccctaccacagcaaacggtaacagtccctagaaaacaagaatgatatgaattgaattctctagcaccaataaagcttactatattactctcactcctgttataaaaatgacagcgatgacaatattgtaataaatttaattagggatctaccctgtgtctcattttaagacttgacagtatgcgctaattggtttctgtcagcatcagtctcaggctgtgcacacaattggaaactgtctactaagcagagcctaaagcaaggtatcctgctgtaggaaacacaaagaaaaaggatttttagtagacatcatttttctcacactatctttaccctgaaccatcttcaccctgaaccatctttaccctgaatgttgaagaaataacatgcaagtaacttttaactctggtataaaagttaaaagacaaaatattaaaaatcactaccactattataataattgatggatacaatataaaatgtattaataagcaatactctatatgtctcaataaattatgtttattttttgagacagagtctgaccctgtcacccaggctggagtgcagtggcatgagcttggctcactgcaacctccaccttccaggtttgagtgattctcttgcctcagcctccggagtagctaggattacaggcgcccgccaccacaactagctaatttttgtattgtttagtagagatcgagtttcatcatgttggccaggttggtcttgaactcctgacctcaggtgatccgcccaccttggcctcccaaagtgctgggattacaggtgtgagccacatgcccagccaaaagaattttttaaattttacagtacttagcatttaaattcagaaatctatttagtgtttgaggtatcttaaaataaaggtggtgtaaatcataggaaaagagaaatggaagaaatggaattaacagttagttacagttacctgttacattctagactccgtgtgtcagatcctgacacttacacttcaagaaaaaaaaacccttaatagagatgtcattgatcccatagcatagataagttaacagtctcagggaagatgagtgaattgttcaggatcttttggcttttaagcagagaagctaggatggaaatctaaatctatatatatatactttcaaaatttatcatcttttggctgggcatgatgtctcatgcctataatcccagcactttgggaggccaaggtgggtggatcacctgaggtcaggagttcaagaccagccttgccaacatgatgaaaccccatctctactaaaaatacagaaattagttgggcgtggtggtgggcacctgtaatcccagctactcaggaggctgaggcaggagaattgcttgaatccaggaggcagaggttgcagtgagctaagattgcaccattgcactccagcctgagcaacaagagtgagactccatctcaaaaaaaaatcatctttcaaattttaagctaatattttaggcatttactagcataaaatatttacacaaataaagagtttagtcatctttactactgccctgattctaaaaccagagacaatacagcattctgcatccaagccccatctactgtttttgaggctaagtccttggcaagtgcatttgagagttggaggctcccttttaccactcaagacctacttgtgaaataggggcccttccttgtatgcagaaaacagagaagatgggggccctgaccaaccttgcctagttcatgaggcagtggctcattgtgtggggaagcaatccaaagaacctcagactgctgctcctccacaatgagctctcagttgccagaagtgcctgaagcttcagggtcggggggtaacctgccattgtttccacccacaattccagaaccctgtctcagagattttggcttggagaggaaacaggccaagaaacagagaaaacccatccaaaaatttaaatgtaatcccaagggacctgaatagccaaaaaaatattgaaagaccaaagttagagatctcacacttctagaattcaaaacacattacaaaggtacagtaatcaaaatagtttgggagtagcataaagacagacatgtagaccaatggaatcaaatacagagtccagggttaaacctcccttacctattcttctgttgatggacatttgggttgcttccatctctcagctactgtgaataataatgtgatttatatgctttacaaatatctaagtaagtctctactttcgattctttcagatatatacccagaaagaggattgttagatcatatggtaattttattttcaattttggagaaaccacctgtattagtctattttcatgctgctgatcaagatatacctgagactgggaagaaaaagaggtttcattggacttacagttccacgtggctggggaggccttaaaagcgtcatgggaggtgaatggcacttcttacatggcagcggcaagagaaaattggaagaagcaaaagcagaaacccctgatacatacatcagatctcatgagacttattcactatcatgagaatagcacgggaaagacctgccccccacgttttaattatcttccactgggtccctccaaaaatacgtgggaattctgggagatacaattcaagttgagatttgggtgcagacacagccaaaccatatcaccaccttactgtttttcatagtggttctagatgagaaaaactgtaaaacactattgaaaaaatcagggacaggcctggtgcggtggctcatgcctgtaatcctagcactttgggaggctgaggcaggtggatcacctgaggtctggagttcaaaaccagcctggccaacatggcgaaacaccatctctactaaaaatacaaaaaaaaaaaaaggaaaccctcagggactatctaaataaatggaaagacattccatgtacatggatagaaagactcaatattgtcaagatgacaattttccataacttaacctatggattcaccacaatcccagtcaaaatttcaccaaattattttgtgaataacaaataataaataatatgtaataacaaacaaataataacaaactaactccaaaatttatatgaaaaggcaaaagaactagaatagccaacacaatactgaagaacaacaatttactacaaagccatagtaattaaaacagcatggcatggacaaaataacagacaaacagatcaatggaacagagtagagagcccagaaatatgcctacacaaatagagtcaattgatatttgacaaagaagcaatgggaattcaatggagaaaagatattcttttcaacaaatggtgctggaacaggatattcacatgcaaaaataagaatctataaacagaccttacgtatttcacaaaattaactcaaattggatcatagacctaaatgtatagcataaaatgataaaattcttacaagataatgtagagtcccaattagggaaggggagtcaggcttgtgggagcagaggaaagaaaaaaaaaaagcagataagctacaagtatgcctttcttcataatccagaacacacagccctcctgcacaaataactcacaatcttcctgtgtctaggtatcagtagacccttggctgatacaaaaagttgcaagttaagtcactgccactgatagtggcaggaggtggacaaatgcctaggcagataggggcaagttcccagggaaatcccacctccaagccaaagacagtttaaagcctgaaagccaagctacaagtcaaatccatggactggattgagaacctgtcttcctgcttggtgcactttcctcagactgatccccacccttcagctgttttacatatacctatgcttcctaattttttttttttttacatagttgtgcccacctttgggtggtgcctttgttttaacctttttgcatactcacaaaccaatcagcacgcactcccctattctgagtccacaaaagccctgggcttagccacacaaggagagaaaccacccccaggtcccctctccactgaaagctgttccatcactcaataaaattcctctctgctttcctcatccttcaattgtcagggtatcctcattcttcttggatgtgggaaaaaagctcatgaatcgccgatctcaggtagaagctataacacaggcaggctagggcatgatagcccagccggaggctgagccactgtgcaagccagactgggccaagtggacggggagcctcctgtgtggcaggtagcatgcccaagcaaggcccaggtggggatgtcactggccagacgtccctggctgagaatgactgaggaatcctgcatcacaaccttggcattatcagcaccatacaaagccctcttcagcatacagcctaagaactatcctatacaatctccagcaatcctttgttggtttgcagtcagcttctttcttgcaagctgcccattgcctccctagcaatgtatgtttctactttctttaataaatctaccttccttacctacaacaaggtaaattctttctttctttctttcttttttttttaagagaaaatctcactctgtcacccaggctggagtgcagttgtgcaatcttggctcattgcaacctctgcctcaacaaggtaaattcttttatgcctgtgccaccagtccaggtagtcatcactacctcacaacagataacataaaaggaaatataggagactttgggtttagcaatgacttcattgatgtaacactgaaaacatgatcgatgaatagaaagaatagatgagttggacttcattaaaactaaaacttctgggctgggtgtggtggctcatgcctgtaatcccagcactttgggaggctgaggcaggtggatcacgaggttaggagttcgagaccagcctggccaacatagtgaaacctcgtctctattaaaaatacaaaaattagccaggcatggtgatgggcacctgtaattccagctactcaggaggctgaggcagaagaattgcttgaacctgggagggggaggttgcagtgagccaagatcacaccattgcactccagcctgggcgacagaatgagactccatctcagaaaaaaacaaaacaaaacactaaaacttctggtagtcaaagacactgttaaagataacaagataagccgcagactgagagaaaatctctgtaaaacacacacttgataaaggactgatgtccaaaatatacaaagaactcttagaactcaacaacaagaaaatgaacaacccgattaaaaatgggcacaagatccaaatagccacctcaacaaaaaagatattcagataacaaattaagatgtaaaaaaggtcccagctactcggagaggctgaggcaggagaatggcgtgaacccgggaggcagagcttgaagtgagccgagatcgagccactgcactccagcctgggtgacagagtgagactctgtctcaaaaaaaaaaaatactggtggacagtggtgaataatagttttatattcctttaaaaaataagaaaatggttgaactagtttacagtcccaccaacagtgtaaaagtgttcctgtttctccacatcctctccagcacctgttgtttcctgactttttaatgattgccattctaactggtgtgagatggtatctcatgtggttttgatttgcatttctctgatggccagtgatggtgagcattttttcatgtacaaaaaaacaaacaccgcatattctcactcataggtgggaattgaacaatgagaacacatggacacagcaggggaacatcacagtctggggactgttgtggggtggggggtggggggaggggggagggatagcattgggagatatgcctaatgctagatgacgagttagtgggtgcagcacaccagcatggcacatgtatacgtatgtaactaacctgcacattgtgcacatgtaccctaaaacttaaagtgtaataataattaattaattaaaaaaataagaaaatggataaattcctggaaacataaaacctcttaagactgaaccaggaaaaaatagatacccaaaataaaccaataacaagcaataaaattgactgagtaataacgtaatttcaaacaaaaaaaaaaaaaaaacaagaacagatgggtttacagccaaattttgccagaagtacaacgaagagctggtatcaatcttactgaaactgttccaaaaatttatggaatttttggattggaagataaatatcattacaaagaccttactaaccaaagcaatctacagattcaacacaattcctatcaaattaccaacatcatttttcataggactagaaaaagcgatcctaaatatcatatgaaaccaaaaaagcatctaaatagccaaagtaatcctaagcaaaaagaaccaagtcaggggcatcatgtgtctgacttcaaattatactatagtgctaatgctatatactaaataaaacagtatggcattggtacaaaaatagatagattaatggaacggaatagagagttcattgttaggaaggatacagctaaaaaaaggacaaaaaattgtgaaagaaaagagaataaagaaccagtaataaagccacatgcctacaaccaagtgatctttgacaaagttggcaaaaataaaccatggggaaagggcattctattcaatcaatggtgctgggaaaattggctacccataggcaaaagaatgaaactgaatccccatctcttatcatacacaaactttaactcaagatgcattaacgacttaaatgaaagaccagaagctataaaaatcctagaagaaaatttaggaaaaactcttctagatattggcctagacaaataattcataaattagacctgaaaagcaaatgcaacaaaaccaaatatacacaaatgggacttaaactaaagagcacagcaaaagaaataatcaacagagtaaacagataacctacacaataggaacaaaatatttgcatctgacaaaggactaatatccagaatctacaaagaacacaaacaactcaacatcaacaaagaataaataaccccattaaaaagactgcaaaggatataaacagacatttctcaaaagaagacatacaagtggccaccaaacatatgaaaaattgctcaacatcaccaatcatcagagaaatgcaaattaaaaccacaataaaggccgggcacagtgactcatacctgtagtcccggcactttgggaggccaaggtgagtggatcacctgaggtcaggagctcaagaccagcctgaccaatatggttaaaccccatctctactaaaaatacaaaaattagttgggcgtgatggtgggtgcctgtaatcccagctacttgggaagctgaggcaggagaatcccttgaacccaggaggtggaggttgcagtgagccaagatcacaccactgaactccagcctgagtgacagagtgagactctgactcaaacacacacacacacacacacacacacacacacacacacacaataagatatcatcttacatagtcagaatggctattattacaaacacaacagatgttggtgtggatgcagagaataatgaatgcttattcactgctggtgggactataaatttgcacaacctctatgaaaaacaatatagagatttctcaaagcactaaaaatagagctaccatttgacacagtgattatactactaggcatctacctgaaagaaaatattatataaaaaagtcactttcactcatatgtgtattacattcctactcataatagtaaagtcatggaattaacctaaatgtccattaacagtggactggattttttaaatgtggtatatatataccatggaataccacacagccattaaaaaaaatgaaatcatgctctgtgcagtaacatggatggagctgggggccattatcctaagtgaaaataactcagaaacagaaaatcaaataccacatgttctcacttataagcaggagctaaacaatgagtacacaaggacataaagatggaaacagtagatagtgagactccaaaagggagagattgggagggggctgatggtcaaaaaattatctattaatagtgagatgtgatcacaccactgcacaccagccagggcaacagagcaagactgtatctcaaaaaaaaaaaaaaaaagatctgttgggtaaaatgttttactatctcagggataggtacactagacaccaaacctcaccattatgcaatatatctatttgataaatgtgcacatacaccctctgaatccaaaataaaaaaacaaaggaagtttatagtagcaaacacttacatcctttttaaaaagatcttgcccacaagtggtggctcacacctgtaatcccagcattttgggaggctgaggcaggcggattggctgaggtcaggagtttgagaccaggctggctaacatggtgaaatcccatctctactaaaaatacaaaaaaaattagcagggtatggtggcgcacacctgtagtcgcagctactcgggaggctgacagaggagaatcactctaacctgggaggcggaggttgcagtgagccaagattgcaccactgcactccagcctggtgacagagggagacttcatctcaaaaaaaagatctcaaataaacaacctaactttacacatcaaaaaaaaaccttaaaccaaaaattagtagaaggaaagaaataacaaagattgagcataaataaatgaaatagagaataaaaatttttttttaatcagccgggcacagtggctcacacctgtaatcccagtggatctcttgaagtcaggagtttgagaccagcctggtcaacatggtgaaaccctgtctgtactaaaaatacaaaaattagccaggcgtgggggcatgctcctgtaatcccagctacttgcaaggctgaggcaggagaatcgcttgaaccctggagatggatatgcagtgagccaagatcgtgccactgcactccagcctaggcaacagagtgagactctgtctcaaaaaaaaaattaatcaatgaagctaagagttgatatggaaaaataaatcaaaatcaaagccattacctagactaagaacaaaaagagagaatatgttaataaaataagaaatgaaagagaagacattacaatttattacagaagtttatttcttacagaaataaacagaattataagggactactatgaacaattatacactaaccaatttgacaacttagaagaaatggtgaaattactagaaatacataacctaccaacactgaatggagaatagagagcttaaagagaccgataacaaatagagaatctaaagaagtaattttccaaaactccaaaacatagcctaggaccagattacttcatgagtgaattctatcaaactttaaaagaaaatttaatataaaacatcctcaaattctttgaaaaaatagaaaaaggaggtaacaccttcagagtcattctatgaggcaagcatccccctgatatccaagaaagaaaatatacttccaagaagaaaattataagccaatatccttgaggaacacggtgtatgaattaaatctaaataaatctgtttacaaagaatcaattctcaaaagaagtttttcaaaataaaaaaattaaaaaattttcacactggattctggataaaaactcatttatagcctctttgtcagatattgttactgaaacttacattaattgaggagttcgcttgagcagcagtttcttcatctgctgggagctgatatatctggaggccactgctaatcaattcactcattatcttactcttttttttttttaatgttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcgttgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactggtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggtggtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttacgtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagcatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtagattaccttgggcagtatggccattttcacgatattgattcttcctacccatgagcatggaatgttcttccatttgtttgtgtcctcttttatttccttgagcagcagtttgtagttctccttgaagaggtccttcacatcccttgtaagttggattcctaggtattttattctctttgaggcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctgttcagagattcaacttcttcctggtttagtcttgggagagtgtatgtgtcgaggaatgtatccatttcttctagattttctagtttatttgcgtagaggtgtttgcagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgccagcttttgaatgtgtttgctcttgcttttctagttcttttaattgtgatgttagggtgtcaattttggatctttcctgctttctcttgtaggcgtttagtgctataaatttccctctacacactgctttgaatgcatcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacatgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagactcgatggtctttacattttggcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccctaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcgctctgcgttttagagtttccaggttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcagggttcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctagagaggcaggcaggcctccttgagttgtggtgggctccacccagttcgagcttcctggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtctgtcacccctttctttgactcggaaagggaactccctgaccccttgcgcttcccaggtgaggcaatgcctcgccctgcttcggctcgcgcacggtgcgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccccccatcttactcttaaaagtctgtaaatcatttttagaaattgtgtctgctttggcaatcagcggtataatgttcacctattaagacaaaagacaaaatctcagcatcaaggattccttgttcatcctatagtttttatagtaaagccttcacaaactctgacaacaaattgtgaaactagataatcactggctgtcatgcctttcttaaaaattattttccaaagttatcaatacttttgaagattcatcttctatctaaattcaggtttacaagtctcaaccttgttgctcttttaaaaatcccttacacctctacacatatggagttagtaaaatgtaaatagtaggacaatgtaaattatttattttcaactttcttattaagctgagtgattaaagacaaattgaatgacatttcatcaaaattatggaagagattttgtctttctactttttccatcactttttccatcaattaatcttaattaatgtcccattttcacacactcttgccccacctagatgtgtttgcagatagatttgattttgttttccaaaggccacctaaaaagaattttttttttttgagacggagtcttgctctgtcacccaggctggagtgcaatggcatgatcttggctcactgcaacatccaccttccaggtttaagcgagtctctgcctcagcctcccgagtagctgagattacaggggcatgccaccacaccctgttgatttttgtatttttagtagagatggggtttctccatgttggccaggctggtctcgaacccctgacctcaggtgatctgcccacctcggcctcccaaagtgctgggattatgggtatgagccaccgcacccagcctgattaccacagtctaaaggctgtgtgtgtgtgtatgtgtgtatgtgtgtgtaagagcactttgcaaacaaatatactcattcttttgtaaaaagatgtaatttccacattggaagttgaatagttgcatatttgaggttgaatttttacccacaacattttttcctagtgcttcaacatgatcactgctgtgttttgcatttgcacttaaataaactttttagaaaataacaatatacaaaattataaaatgttttattactgttaaaacatcttattaaattatagctccacaaaatcagtatctgtaatacagtacaaatatataaatataaattttaggcagactgcttttgttttagattgctcaaagcatatttttcaaaaaatccatggacaagccaggcacagtggctcacgcctgtaacccagcactttggcagcccgaggcgggtggatcacctgaggtcaggagtttgagacgagcttcgccaacgtggtgaagccctgtctctactaaaaatgcaaaaattagctgggcatggtagtgggcacctgtagtcccagctactcaggaggttgaggcaggagaatcacttaaacccgggaggcggaggttgcagtgagccaagttcatgccattgcactccagcctgggcaacaagagcaaaactccatctaaaaaaaaaacattagccaggtgtgttggcagcacctgtagccccagctgctcaggtggctagggtgggaggatcacttcagcccaggaagttgaggctgcagtgagccgtgatctgacaaaaaacaaaaacaaagaaacaaaaaacaaacaaaaacaaaaactccataacctgacctcctcgctatgaacaaagctagataggacatctcttttctcccactgtccatcacgaggactgccacagcactctgtaagctccctcataaaggctttggactgatcaccctggcattttagtagttcgccctgtggaattcagccctatctccggaccatttggggtactcctttgtgggaattcccctgcaccacttttggggcagctctagccagccttgaatttgacatgacataacacagtgatggtaaatcattaacataaagaaatggaaacttttggctgggcacggtggctcaggcctgtaatcccaacactgggaggctgaggcgggtggatcacctgaggtcatgagttcgagaccagcctggccaacagggtggaaccccatctctactaaaaatacaaaaattagccaggcatggtggtaggtgcctgtaatcctagctacttgggagactgagggaggagaatcccttgaacccgggaggtggaggtggcaatgagccaagatggtgccactgcacttcagcctgggccacagagtgagactttgtcttgaaaaaaaaaagagagagagagagagaaagaaagaaagaaatggaaactttctatgtcaataattcctcaggtgttcagatttaagaggaaaggcattcattgcaaggagaacagaccaacttgaaaaagaagacaagcagggcatggtggctcacacctgcaatcccagcactttgggaggctgagaccagcagattgcttgagcccaggagtttcagacccatctggacaatatggcaagacccctctctctccaaaaaattaaaaattagccaggcgtgcaggcacacgcctgtggtcccagctacttgaggctgaggtgggagaactccttgagcctggacgatcaaggctgccatgagcctggttcatgtcactgcactcctgcctgggcaacagagtgagatcttgtctcaaagaaagagaaaagaaaaagacagtagccatatactcttgcctatccctttatataatggttttgtgaaaattagagattttatattctggaaaatggtttgatgataacagatgaacatgaaattaaaagtgtgtatcccagttgagtgtggtggctcatgcctgtaatcccagcactttgggaggctgaagtgggcaggtcacctgagttcaggagctcgagatcagcatgaacaacatggagaaaccctgtctctactaaaagtaaaaataaaaaagtagccgggtgtggtggtgcaagcctgtgtcccagcttcttgggaggctgaggcaggccaggcgtggcggcacaagcctgtaatcccagctacttgggaggctgaggcaggagaatcgcttgaacctgggaggtggaggttgcagtgggccgagactgtgccactgcactccagcctgatcaacagagtgagactccatctcgaaaaaaaaaaaagtcctatgcagtatgaatccacgttatatgtattatacaatatgtaataaatattatatatgcatatataatatagtacatggtacgtatactctatcatttacatatatgtgtataaatatttatatatctatacaaccacataaaaggataaacattatatcctgtcatataaagaataaacatttatccacataaaaggataaacataataccaagtagtattgaactcttaatacgttccttaatatactcacatactctcctactctatgttctatatgccatttaagtcttaaatttattttatacaaaatcatatacgcaaaagtgtggatctaacatgtgtacaatgcagacaataaaaataaatagggccaggcatagtggctcatgtgtgtaatcctagcactttgggaggccaaagcaggaggataactttaggtcaggagtttaagactagcctgggcaacatagggagataccatctttatcaaaaataaaataaaggccaagcgtggtggctcatgcctgtaatcccagaactttgggaggccaaggcaggcggatcacccgaggtcgggagttcgagactagcctgaccaacatggagaaaccccatctctactaaaaaatacaaaattagccgggcatggtggcacatgcctgtaatcccagctactaggggggctgaggcaggagacttgcttgaacccagaaggcagaggttgcagtgagccaagatcgcgccattgcactccagcctgggcaacaagagtgaaactgcgtctcaaaaaaataaaaataaaaataaaataaaataaaataaaataaaaagttagcaggctaggtgccgtggctcaggcctgtaatcccagaattttgggagactgaggcaggtggatcacctgaggcaggagttcgaaaccagcctggccaacatggtgaaaccccctctctgctaaaaatacaaaaattagccaggcatattggcacatgtctgcaatcccagctactcagcaggctgaggcaggagaatggcttgaacctgggaggcagagattgcagtgagccaagattatgccactgtactccaacctgggtgacaagagtgaaactccacctcacaaaaacaaacaaacgaaaaacattagccaggcatggtgacacatgcctgtggtcccagctgccatgggggctgaggtaagaggattgcttgagcctgggaggtcaaggctgcagtcagctatgattgtgcatcactacgctccagcctgggtgacagagtgagacactgtctaaaaaaaaaaaaagaaaagaaaagaaaaattaaaataaaaagaactttcatgtacccatttctcagctttggctagaacacaaacaagacctttatgctttccttgattgcaggtcaccatacccgcttggaagtctctgctatactgaaatttgcattaactctcttgcttatgtttattcattttctatggtggttactaaaacacgtaacataagggctatcctcttaaatttgtaagtgtacattacaatatttttaactataagcacagtgttgcacagcagacctctggaacttttcaatcttgcataatttaaactttatactcattgaacagcaacttcattttcctccacccacccccagcccctggtaaccagcattctactttctacttcaatgggtttggcaaccttagatacctcggattggtggaattaggctatgtttgttttttctgactggctcattcattcactttgcataatgtcctcaaggttcatgcacgtcattgcaaatgacaggatttctctctttttataaggctaattaatattccatttatgtatatgccatattttctctatccatttatcagtcgttggacatttacattacttccatgtattggctattgcaaataatgcttccaaggacgtgggaataaaaatatctcttcagcatcctgatttcaattttttggaataaatactcagaatctgggttgctggatcttatgacatgttttttgagacaggatctcattctgttggctgagtgcagttgtgtgattatggctaactgtggccttgaatgtctgggctcaagcaatccttctgcctcagccttcccagtagttgagactacaggcatgtgccaccatgcctggctaatttttttttttttttttggagagattgggtcttgttctattgcccaggctggtctggaactcctagcctcaagtgtctttctgccttggcctcccaaatgctaggattacaggtgtgaagcattgcacccatccaagaattcttggatcatgaaatcaacctaatttatttgagatgtgtggccacttttaatacattgctggtatcaatttgctattattttgattaatctttttgcatctatgcaagttcctcatttgattcttgcatggtgttgcatcaagtttatgctagattcataaaataaattgtagagtgctgctctttttccttgtccctaaaatagtttggataatattagaattatttctttcttgaatatttttaaacttcgtgaataaaactttctcagcttagtgctatctttgtgaaagttcttaaactgtaattttcattttgtaaaaagttattggttcattttgattttctattatttctaaaatatgtacgtttcaagttttctcttaggtatttgctcatttcactaagttttaatccattacttttttcaaaaaaagtttttacattttatttgtgctcttcttctgggactctaagaacacagatgttagaacttttgttattattccatgggtctctgacactgtcttaatttttttaaattattatttttgtttattctcttctgttcagattaatttctcattatctttttccacgatcatcaatttttctttgtcttctttatcttgctcctgagccccttcagtaatttttagagaattttggtagttgcataaaattttgattccattcttttaaaataccttctatttttctggtgaaactttctcaatttcattctatttcaacagtgttcaatcttacttcttgaagtatagttataacagctgctccaaagtctttgataatcccaccttctgtgtcaacttggtattcgtgtctgttggttgtctttttagctttgtgagatgttcagatttttctaattataaaaaattagaggccaggtgtgttggctcacaccttttatcccagcactttgggaggccgaggcaggtggatcacctgaggtaaggagtttgagaccagcctggccaatgcggtgaaaccccatctcttctaaaaatacaaaaaattagcaaggcctggtggtggaggcctgtaatcccagctacttgagaggctgaagcaggagaattgcttgaacccaggaggcagagggtttagtcagccaagattacaccactgcactgcagcctgggcaacaagagtgacactccatctcaaaaaaaaaaaattagaaattttaaaagttttctaattttctaattcttaatgtgttgagtaattttttattgtattctggacatcttacacactatgctctgtgaatctgagtcttgataaaatgctatagagtttttttttatttaacaggtagtaaccttgctagagtcagccacaaattcctaccgaccttctgtttgcattggttcattctagtgccaattctgtttacaaggcccttataagaggtattgagatgtgtcccactggtgcaccacctaagggccagtttgggattatgggattatgggatctgggtagagttctaacccatccttcagttctcaaaaactacagtttagcatcagattttatatatatatatatatatatatatatatatatatatatatatatatatatatatatatattttctatctatatatataataataaatatattctatctatatataataatatatatattcagttttcccctccaattttaatactttcaaattctagtggttcattgagatctttttcaaatcttcctgattatctgtacattctcttgtttatcattttcaatccacttttattattttgatatattcatttttatagcgttgctcataatcctagtatctatagtctttgtagatctgactttatactttgttgtttctgttggccgttgttcatagtgacttgttttcttcagagatgtgtttgtttattccgggttccaagagaatatacctatgtgagtttgctttaacctaacattttgagttgaagttttccaggacatatatgtggtatgaattctggcccaacttttcattatatatttgtcatcagggattctcagaggctatgttcttttttcagtcattcaacacagacctaagaaaaaaaccaatgaatttgtcaacattcatctctagagaacaggattttcatttaatgtatccagtgagggtttcattgctctaggcccccttctctatgacgaggcttctgacctgtccttctgttatgttgggacttcagactttgtttacatttttgtgtgtatgtttctctaacacccatgatagacaaacagtcatcctcagggaaaaagccagcttcaaaaactgcttatcattcttgtatcaatctttattattttttttaatttttttttttgagacggagtctcactctgtcacccaggctggagtgcggtggtgcaacctcagctgactgcaacctccacttccccggttcaagtgattcttctgcctcagcctcctgagtagctgggattacaggtgcatgccaccatgtccagctaatttttgcatttttagtagagacggggtttcatcacgttggtcaggatggtcatgaactcctgacctcatgatccacctgctttggcctcccaaagtgctgggattacaggcatgagccactgtgcccagcatcattctttattattgtttttcacttccaacttctatttaagctcagcatacttaaaatatgctttagatatgttgttgagcatttttaggtgttctatattaggaggtgcttgtgtgtgtgtgtgtgtgtgtgtgtgtgtgtgcgcgcgcgcgcgcatgcttggtctgatatatagctttaagtaaaagtttgttcataattttttcctaaattcactataaaataatgctaataagcacaccaaatatcagcagtggtttaattttgaaagtacttatgagttattttttctttaagttcttttaaattttcagaaatttaaagaggatcatttgttatttttataattagaaaaaagttatgaaagaaacattatcacaaggaattacatggtgtaaaggcagcaaaacaggaagttagcaataaataaaagaatgagatgagagaattcttcaaaagaaggaaattgttgagctgattataaaactagtactcgaattctgttaagtacacaatgaaatttccaataaattacatcgcaaagaagtatatgttaattttttttgttaaaagtaatttgaagtgtacttcccatacttgtcctgaatataaccttgactaaatctgacttcatataatttttgcaaaacttaaatgagataatagttgaaaaatgctagctcagatgaaacacccagttttgaaaattttagtagcattatattatggcaataagacttaagtaatgaaatgataaagcttctggttattaagctgctgattgtatcagagtcaaatggcatatacttgtgtttgaaattcaggtgcagactttcaatataagagagttcactttcctatattccagtaaacagtatcctaatcaccatcaatagcatttgtcaagcacatgatatgggtgtcagtgtttgctaagagagggaaaggttatataaggaagtatttacccttgaatttcaaataattgttatggggatatgaaaacatagacaattcccttatgcagctcagaatttattagaggccaaacaatatagacacaagtgaaaaacagagttgagctacataatctttaaatatcttgtaactaggccaggcgcggtggctcacgcctgtcatcccagcacttcgggaggccaaggcgggcggatcacaaggtcaggagatcgagatcatcctggctaacacagtgaaaccctgtctctactaaaaatacaaaaaattagccgggcgtggtggcgggtacctgtaatcccagctactcaggaaactgaggcaggagaatcacttgaacctgggaggtggaggttgcagtgagccgagatcgcgccactgcactccagcctgggtgacaaagtgagactccatctccaaaaaacaaacaaaaagaatgagagagaaagcagtttcagggttaatatggctaggaagcagtcatcagagagcttaaagtattctgtagcagtagttctcaaactttatcacctgtaaggcttgttaaaccacagattgcacggttttagtctcagcattcctaatctagaagggcatgggcagggtataagaatttacattctagggccgggcacagtggctcatgcctgtaatcccagcactttgggaggcttaggtgggtggattacttaaggtcaggagttcaagaccagcctggccaacacagtgaaaccccatctctacttaaaataaaataaaataaaaagctgggtgtggtagcacgtgcctgtaatcccagctactcgggaagctgaggcatgagaattacttgaacctgggaggggaggttgcagtgagccaagactgcaccactgctctcaaacctgggtgacagagcaagactctgtaaaaaaaaaaaaaataggttttacattttaacaggtttccaagtgatgctgatgctgatatttctggttctggggctgcactttgagaacctctgctctttaaaaaaaaaaaaaaaaaaaaaaaaaggatgcccttttgtgtaaatgggtctctaccctcacaccaatagtcccagaaccatatccagaacgagcttatctagaactaactacctattgcaatttgaaaacaaagatccctactctcacttcaaataaattaatcacatgttactcttattgggtgatggggagagtaaggaagaggagagtccaggacataatttgggagatggagtaatagagcccagggaagtcaagagacttgttcaagctccacagctcatggccaatagatagtctgtcaaattttcactatataaaattggcacaaaatgtgccaaatctgcatttagaacattcgtttctgattgccatagagaagacagaactaaattccaagtagaaatgatacttaagagatctaaatgccaaaggaacattggcggttttttttgtttttgtttttgtttttttttttgagacggagtctcggtctgtcgcccaggctggagtgcagtggcgcgatctcggctcactgcaagctccgcctcctgggtttacaccattctcctgcctcagcctcccgagtagctgggaccacaggcgcccgccacgacgcccagctaattttttgtattttttagtagagacggagtttcaccgtgttagccaggatggtctcgatctcctgaccttgtgatccacccacctcggcctcccaaagtgctgggattacaggcgtgagccaccacgcctggcctttttttttttattttttattttttacattattgtttttctgaaagcaagatatactactgagcaatggagaaaaaaattagaaacaataaaagtgtttatgataatgggagagaaacccattaagaattttattggataaggatgacaaaattaactttccctgttttcattttagaatcactgaacatttgtgtttccataataaaaatagcaatgaaaagaaaattggacacagcattacccttttctctctgtggggtggaggaggatgatttgtccttccttgaaagatgaggaaggcctaccatgggtttaattaaggaggacgttgtatgcagaaaaagagcaaggcttaaggtatcaccctgcaactgagttccccatgttgcatagtagttatgcgcttgggctctgcacttggactctgcacttggactatgtgattttgaatattgccatgggggccctccatttcagagcccctgtaccacctcatcaactctttctcacggttggaatagctctgactttctctttgcctactcttttaaatgagtttaaatggtacgtgtgattagattgtgcccacctggggaaacctcccttttgcttaattcaaagtcaactgtctagtgcaataatttggtagggtgccatcacaaaataccagaaactgggtggtttaaacaacagaaatgtatcatctcagcagttctggaggctgaaagtctgaaatagaggcatctggtgggttggaaccttctgaagactgtgagggagaatccattccatgcctctctcctaggttctcccagccttatgcactgacttgtagacagccttctccctgtgtctttacattgtcttccccttactagtatctgtctgtatacaaatttctcccccttttaaaaatcaggacataagtcataatggattagggcccaccctagtgacttaccccatcttcctatcttaacttgaacatctgtcaagaccctatttcttttctttttctttcctcctttttttttttttgagacagagtcttaatctgtcacccaagctggagcacaatggtgccatcatggctcacagcagaagttccagggttcaagtgattctcctgcctcagcctcccgagtagcagggattacaggtgtgtgcctaatttttgtatttttagtagagagaggattttaccacgttggtcaggctggtctcgaactcctgacctcaagtgatccacctgcctcggcctcccaaagtgctggtattacagacatgagccattgtgcccagcccatatttctaaataaggtcacattcacagggactgggagttaggaactcagcatcctttaaaacccataagaattagtaacctgaattaatctgcaaaataaatgaggaaacagaggccaaagaggataaaccactatcagatagactagaacccaggcacgagggctcgttacttcagcccttcatcctctgcgtgtgttcacaatctccatttaaatatatatgttgtattaaggactacagtagtaatttggagtttgggaaaatttcatatcctgctttgatggactggaagatgagacgtgctttacgcagagcctcttcatcaataggtgagtggctatgaaatgggggtaggaacccatagggaagaaactagatgatctgctgaaaatgagaagaaaaatgagctactggacctgccagctggcaccactgctcaagtggattatgaactgaatatagaaaatattagggaacaaagagttacatgaatgttcacagctgctctcctcaagtgcgtgacctcttcccaaacacattttctgaacgaatcactctcagcaggaaagtggtctctctactaggaataacaaacaagacagtctctacagctacttgggcaaagaagagcttttccatggaggggtctgctcttacctatgttttgcagaatgctctgcagagaaatactcactttgttcatgacttgtctaattcctggaaaacatcagcactgtaatttaggattagaatctgttgaaaagatgtgccagcattaaaaaaaattaagaaacaatgctgtgaacttcagactttctgagaaagtcagaattatctggaataatttggcccacacatttcctctcaattgagaacacaaggtttggaatcaggccaggtgacctaggttatagctctggctctaactagatgaccttgtccaagttacttaatgttcataaacctccatttatctatcaataaacaggcccaataatacatacatacctcatgaggatgctgtgaagatgagatgaaatccatcatcaagggatgttagccagaatcagaatcctcatcaccactacattctcaaagtctcttttgatccaaattgaacattttcaggaataatttttaaaaataaaatctatcttttctttgtaaatttgctttttactttaatgcttaatgttttggtcagttgaatgaactctttcagcatcctaaaattatgttaatattcaggaaaatattgcttactaaatttttttggattagaaaatagtgcatgaatgcagtaaattctcttgtcaggactgcaagctcactcaattgaaggaatagtgttttatttttcttatttatttatttatttagacagagtctctgtagcccaggctggagtgcagtggtgtgatcatagctcactgcagccctgaatatcagggttcaagtaatcctcccagctcagcctcccaagtagctggaaccacagatgtgtgctaccatgcctggctaattttaaattttttgtagagatggtgtcttgctatgttgcccaggctggtctcaaactcctgaacttaagttatcccccaaccttcacctcccaaagtgttggaattacaggcgtgagccaccacgcctagccagggaaaagaatactaaatgtgaacatcaagaaccttgatgttatttaacaaccttgtcactagccagggagatgtcctccagtgccttaaatcttggcttccttattcatcagatttagtgactaatgaggcataacggagtaagcaacaaaggactcataaaagaaaaggtctccatttggacaattgcaagaatgataatatttctacattgaaatatggaatttagaagaaaaaatggcttatgtaaaagaaaaactttttttagacatcgagttcaagaacgagtttaagaacagaaatttctagaaattagttggcaatctacaactggatttcagcagtaaagactgaaaacaaaattaggataatcgcttggacagaacatttgacgttattagagtgaatggtaagtttgataaatttatcgatatgaaaagaactagatggccataaattatctttgggaagaagagtgggaactagaggaagagaggtcaggggagattcacaatagcctatgcatcattataaatgtgcacatgtcctgtggtcaggcagtaatgtgtgaagatacaagtgagtgcatgcaatgaagaaatacaacttttgctaaaacaacatgctgatcaaaaagaaaaataaaaagaaggctagttgcggtggctcacatctgtaatcccagcactttgggaggccgaggtgggtgatcacctgaggtcaggagttcaggaccagcctggccaacatggtgaaaccctgtctctgctaaaaataaaaaaaattagctgggcattagtggcacgtgcctgtaatcccagctactggggggctgaggcagaagatcacttgaacctgggaggcagaggttgcagtgagccgagatcgtgccactgcactccagcctgggcaacagagcaagtctccatctcaaaaaaaataaataaataaaagaagaagaaaaagaaaagaaagacaagagaaaaccgtctttgggcctaacaaagcactgagtaggcatgaggttggggagtcaatgtccattgaatttaacccttaagaaaattttttgtggctttcaacactgctggttcattagaggagcagacaggttacaaaccatcttgctgggaatcaataggaaagtaaatgatgggaaagtagagagaaattctatgagtttaggtgtgaaaagaaggaaagactccatatggtagccaaaaggaatgaggaggggaagggaagagaaatatggaatctgcagggctagagggaaggaagcatattatcagggaacggtttaggtgagatcacagggcactcacatagtcaagtggagttaagctttgaaatgttagcctaaaatagtaataatctttaaatatttacttatttggcagaatgattagcttagaagcaaactctttgttaaaagcaacttctctgtttctggaattcatccttattattctaaataaaggtagagtgtaactagactaagttataatgtgttggtcttaaaaggtgtgatattaccttattaatttgaatgactggtgctgatttcctccaatttaaaaattttgtttagctagttctaacaatccccagggagtcttgttttgcttgatagctgcctctgatgctggcgcacagtcacctctttccaaccttctgcatccagcctttattttttttattttatttattttattttattttatttttgagacagagtctcgctctgtcgcccaggctggagtgcaatggcgcgatctcggctcactgcaagctccgcctcccgggttcgcgacattctcctgcctcagcctcccgagtagctgggactacaggcacctgccaccatgcccggctaattttttgtaatttttagtagagacggggtttcactgtgttagccagtatggtcttgatctcctgacctcgtgatctgcccacctcggcctcccaaagtgctgggattacaggcgtgagccactgcacccggccagcatccagccgttatgagaaggggagctaacaaactaattagactggtagtttaaaaaaatatcaatcttggtacatacccaggccaaaaagtcttacatttaccgaaacagaacatttgcgtctgcccaactatccaagactgttaacctcaggcttttatctcacacttaaaaactggttttattttgcactttggcatactgtatagaagtttgacacatttgcaagataagaactacattcgaaatgatgagatctacattgggaaaattatgtgtgaacaaatttggagacataactgaacagtttgtcattgatggaaatgtgcaagctctgcctcccaacttcaagtgattctcctgcctcagcctcctgagtagctgggactacaggtgtccaccaccatgcctggctaatttttgtatttttagtagagatggggtttctccatgttggccagcctggtctcgaactcctggcctcatgcaatctgcccgccttggtgtcccagagtgttgggattacagccatgaaccactgcacctgcccaaaaaggggttaatttcttgtactgcttaaagaaaaaaatttaaaaattaaaaataaaataaaataaaaacatgtattaatagttggcttgtgaaatatggtattttttgcccagctcctggtaaaattgtttttactgaacatgactatcatgtcagtagggttttagttatcagtgccagaaaggaagtcaaagataagacacaatatttctcaatccactggccacctgcatcagaattacttaaggtgttgttttaaaaaatgcagcttctggccgagcatggtggctcacgcttgtaatcccagcactctgggaggccaaggtgggtggatcacgaggtcaggaattcgagaccagcctggccaatatggtgaaaccccatctctactaaaaatacaaaaattaactgggtgtggcggtgggcgcctgtagtcccagctgctcaggaggctgaggcaggagaatggattgaactcgggaggcagaggttgcagtgagccgagatggtgccactgcactccagcctgggcaacagagcaagactccgtctcaaaaaacaaaaaattgcagattccaagttttcatactggatctactgaatctctgcaggagagtcctgctaatttactattttaataaggtcttaggtggttcttatgaaaaccgaagtttgagaactagattttgaaacatacaactatacttagattcagcactgttcagagggagcaaaaattgtcgtatcctttataatgtgccaatttttcatgcaatctctttaccagaatttaaaatgtacacatcctttgacacagccattccatttctaggaatttatctgacagaataattgaataaatgtgcaaggatatatgttaaaaaaaaaccatccattacaaaattgtctattgtaggagaaaagtcttaataacttaaatgcctatcaaggaatgttacatatcaggtactgttctaagcacttcaaaagcagttaagtcatttcatcctcataacattatatagtaatagaatataaaatatatattaaaatataatcttaataatattattatccctcattttacagatgacaaagctgaggcacagaacagttaagcacttgtccaaaatcacactgctggtacgtggcacagccaggtcacaaagccaggttgtctggttctagagtctgtgggcttaatcctgcactatttgcctctctcaacattctgctgccttcacataatcattatataaattttttaatttacaaaaattaaatttaaaacatgagcgagctagtataggtggctttctttttctttttatttatttattatcctttaagtcctgggatacatgtgcagaacatgcaggtttgttacataggtatacatgtgccgtggtggtttgctgcacgcatcaaagtgtcatctacattaggtatttctcctaatgctatccctcccctagccctccaccctgtgaaaggccccagtgtgtgatgttcccctccctgtgtccatgtgttctcactgttcaactcccacttatgagtgagaacatttggtatttagttttctgttcctgtgatagtttgctgagaatgatggtttccagcttcatccacgtccctgcaaaggacatgaactcatacgtttttatggctgcatagtattccatggtgtatatgtgccacattttctttatccagtgtatcaatgatgggcatttgcattggttccaggtctttgctattgtgaacagtgccacaataaacatacgtgtgcatgtgtctttatagtagaacgatttataatcttttgggtatatacacagtaatgggattcgtgggtcaaatggtatttctggttctagatccttgaggaatcgccacagtgtcttccgcaatggttgaactagtttacactcccaccaacagtgtaaaagtgttcctatttctccacatcctctccagcatctattgtttcctaactttttaatgatcaccactctaactggtatgagatggtatcttattgtggttttgatttgcatttctctaatgaccagtgatgatgagctttttttcacatatttgttggccgcataaatgtctttttttgaaaagtgtccgttcatatcctttgcccacttttgaatggagttgtttttttttttttcttgtaaattggtttaagttctttgtagattctggatattagccctttgtcagatggatagattgcaaaaattttctcccattctgtaggttgcctttcgctctgatgatagtttcttttgctgtgcagaagctcttgagtttaattagatcccatttgtggattttggcttttgttgccattgcttttggtgttttagtcatgaagtctttgtccatgcctatgtcctgaatggtattgcctaggtgttcttctagggtttttatggttataggttttacatttaagtgtttaatccatcttgagttaatttttgtataaggtgtaaggaaagggtcgagtttcaattttctgcatacggctagccagttttcccaacaccatttattaaatagggaatccttttcccattgcttgtttttgtctgctttggcaaatatcagatagttgtagatgtgtggcattatttctgaggcttctgttctgttccattgatctatgtatctgttttggtaccagtatcatgctgttttggttactatagccttgcagtatagtttgaagtcaggtagcatgatgactctagcttttttctttttgcttaggattgtcttgctatatgggctcttttttggttccatataaaatttaaagtaattttttctaattctgtacagaaagtctatggtagcttgatggggatagcattgagtctacaaattactttgggcagtatggccattttcatgatattgattcttcctatccatgagcatgggatgtttttccatttgtttgtgtcctcttttatttcatggagcagtggtttgtagttctccttgaagaggtccttcacatcccttgtaagttgtattcctaggtattttattctcttagtagcaattgtgaatgggagttcacttatgatttggctctctgtttgtctattattggtgtctaggaatgcttgtggtttttgcacattgattttgtatcctgagattttgctgaaattgcttatcagcataaggagattttgggctgaggtgatggggttttctaaatatacaatcatgtcatctgcaaacagagacagtttgacttcctctcttccttttatttgtaagcccctgactggggctgctgcctttctttcagagatgccctgcccagagaggaggaatctctagaggcagtttggctgcagcagctttgctgagctgcagtgggctctgcccagttcgaacttcctggtagctttgtttacactgtgaggggaaaaccgcctactgaagcctcagcaatggtaaatgcccctccccccaccaagcttgagcatcccaggtcaacttcagactgctgtgctggcagtgaggatttcaagccagtggatcttggcttgctgggctccatgggggtgggattctctgagctagatcacttgtctccctggcttcagccccctttccatgggagtgaatggttctgtcttgctggtgtcccaggtgccactggggtatgaaaaaaactcctgcagctagctcagtgtctgcccaaatggccgcccagttttgtgcttgaaatctagggccctggtggcataggcacctgagggaatctcctggtttgcgggttgtgaagactatgggaaaatcatagtatctgggccagaatgcactgttcctcacggcacagtccctcactgcttcccttggctaggggagggagttctctgaccccttgtgcttcctgggtgaggcaacaccccaacctgcttcggctccccctccataggctgcacccactgtttaaccaggcccgatgagatgagccaggtacctcagttggaaatgcagaaatcacctgtcttctgcgttaatctcgctgggaggtgcagactggagctgttcctatttggccatcttgccagccacctagacctgtttttctgaattagaaattttattttctattcaatctttcttttactctaccacaaagaaataagttttctcttttgaaataaataacatttgaaaaaatatgtttgatatgatcatgttcatgtggaaatgcatatttatgtatgcattttaaaattaaagaatttttaagaaaaggataggccttagaagtgggcacacaaagttgaagacagtggtctgtgagtgaagttctgagtgttttctattttctgccttttgcttgtctatggttccttttcattttcccactaattaacatactttgttcttgtaaaatgaaaaacacaacagcaatatgtgaatgtgcctaccatgcaaatatgtataaagtttatgcttttgtaagagtggcttttaaggataaatagatgaaattacaaatagagatgagggaaaatatatcttcttacactgttttatagttttgcttcttaaaactgtagagctcatgcatcaagtagactggaaggtcttctgatgctcaaacttgcttattttcatcatcgatccacttcagtaagagcagatctcagagaacaaataaacttttctattcccatattctccttcctgcatactagtccactgtgtttcttgcctgccactcttctcagctaggtttctttttcatgagcaaacaagtataggtggctttcctttttcttaattagcaattttattttctattcaatctttctttttctctaccacaaaagaataagatttctcttttgaaataaataactttctttgcctcatctattaactggatgtgatacatttatttcatgaagttatcttgggtccttcagggaagccagctttattcagaacaatctgaattatatgcattgataaaccaatcagttgtgattcatccaaggtgacagaatttacgagggcttcaaagtggctatcacactaaactctgggcaatattaatgttgggctaactgaaaattataactaggacatttcttgaacttattttcctttagtacaggcaggtaaaattggttctcttcgttttataaatgtcattcttcaaaaagaatctggtagtacaagatgacttgcttgctttctgaatattttaattatggattgtcgctggtaagttatttaagttattttaattgatcatattgcttttaaaaatgagactttaaaaatatttttaatttgttctcaatttggggggtacatacacaggtttgtttcaagggtatgttgtgtgatgctgaggtttgggcttcacccagatagtgaaccaagtgccaaatgggaagtttttaaagccttgcccctctcccttcctctctccttttagagtcctcagtgtcgattgttcccatctttatgtatgtgtataaccaagatatagcgcccacttataagtgagaatgtgtgatatttgattttctatttctgtattaattcgcttaggataatgacttctaggtgcatctgtgttgctgcaaaggacatgatatcattcttttttatggctgtgtagtattccatgatgtataaataccacattttctttatccagtccactgttgatgggcacctacattgattctctgtctttgctattgtgaacagtgctgtagtgaacatacagtgcatgtgtctttttggtggaataatttatattctgttgggtatgtaaccataatgggattactgaattaaatggtagttctatttttagttctttgagaaatcttcaaactgccttccacagtggctgaactaatttacattcccaccagcagtgtataggcattcccttttctccatagccttgccaacatctgttagtttttgactttttagtaatagccattctgactgatgtgagctgctatctcactgtggttttaatttgcatctgtctgataattagtgatgttgagcattttttcatgttagttggctccttatatgtcttcttttaaggagtgtctgtttatgtctcttgcccactttttaaatgaagtgttttttttattctcattgagtttaagttccttatagattctggatatttgtcctttgttgtacgcatagtttgtaaatattttctcccattctgtaggttgtctgtttactctgttgatagtttcttttgctgtgcagaagctctttagttcaattaggtcccgcttgtcaaattttgcttttgttgcaactgcttttggagactttgtcatgaaatctttgctaaggcttatgtctagaaaggtatttcttagattttttcctagggcttatatagttttaggtcttacatttaagtctttattccattttgagttatttttgtatattacgaaagaaggggtccagtttcaatcttctgcaacgttctgtatatggctagccacttatcccaacaccatttatcaaatagggtcttctttttctattgtatgttatgttcgactttgttgaagatcagatggttttaggtgtgcagctttatttctggattctctaggtctatgtgtctctttttgtaccagcaccatgctgttccggctactgtagccttgtagtatagtttgaaattgggtagtgtgatgccgctgttcttttagcttaggattcctttggctattcaggctctttgttggttccatatgaattttagaatagttttttctaattctgtgcaaaatgacagtggtagtttgattgtaatagcattgaatctgtaaattggtttgggcagtatggcctatataacgatattgattcttcttatctatgagcatggaatgtttttctgtttgtttgtgtcatttctgatttctttcagcagtgttttgtaattcttactgcagatcatttacttccccagttagctatattcctagttattttaatctttttatgggttaccaattttctagcaaaatgttaaatattaactaatgaacattaatcctttttgaaagatattttttctaaaatatattactacgtattttacattttcctaccattgtaattttgataattttgtctgtttcctttttaaatcaaacatataaattaactttattgttaaatatagaaaattccttattgaatgactataatgattataagcacacacgtaattatgttctctgaaacattctgcataatttacaatgaacaataactctttaaaaagtatttcaggtgattgtatataggatcaaagtcttctgcatttacataatgtcaaggagaagtagttattggacatgttccaaagagctaaacaggtgggtaattgaactataactggtaaagtatattgcttggtcttttatgatacaagtcctttccattctgagtttttaaatccaccctcaccccaaattttagatattaaaaaattatttctactattgccgtttcacctgccataaaaaatgctcattcttagcaataggtaagtatataatatctaaataattgaaaaaaaagactcaaatattttaattgagtctattcgctataggtagtccattcagtggtataactgagaggaactcaggatttattgctctgggtaagtaggaaaaactctgaaaaatgtggctaatattgagtttcaaatggctcttgaaattgctcgtgattatccacaaaagcatacactgagttgatgtacgctaaggtaacaaggtaaagcgttaaggcaatgctttttgagttggtgtatctgtttgattctcatttttccatatcctcatatataaaacgagacaataataatgatctatcaagattactggaaggtggtaaataatgcataggaaactgcctgccacataactcacaattagtattagcctcttccccttgcatgataaatatcagtggaatatctacagactttttaatatgatggaattatttttcattcattctgcaaatctttattgaacaagtcagtcagggattaggcatgaaagcagaagcctctcaatatattccaagtatgaatattttcaatgcagggaattagaggcttacccagttgttagaaggctgcagaaaccaacgtgaagaaggctgtcagcaacaatctcagcctttgcactatgaggttctcaagagcttgcacaaaagacccctgaaagaacctctgggagattccctctgacctctcagtctgcaggagtgatgcaggtgattttcaggaagctcacctggaaactgcctcaaatcttgtatcttggtcatgtggctgcagccgcttccagaaaataatgacccctttctcttccaaatcttgtgcacgtgcttcccattgcaatgggtttttgggaaatgtcattctcagcttctcctgcagtggagaccttagagaggggtagcagtgatgccaagttgaccctaggtaatccagcacaccaactaagtgcagagccctgtgctcaatgttgtgaggaatacaatggtaactcatatgtggatcttgtttccatcctgctcccaatgggaaagggaggataagacatgtaaataaaaccagtagtccaaggcagaagactcaggtggaggcagaggcaggaacaacgctgggcaaattggtgaaagaaagatgtttttcagtcagggaagggagaatcagggaaggcttcatggaataggtggactgtggattcaacttggaagaaccagtaagtttggggtataagtaaatatggaaaagcagggaattccaggaacatgaaaacattacgaagagaaacacagaaatagaaaagagtgtagtgggttttgagaatattattaaatggaagaaaagtattattgaaaaggaataaaatggaggggatatcccgaaaagtagttattatttaatcagaagatactattgccaaatatgagtttgaaatctctttaataggaaatggggaggaatttaaggttttgagagtatcatgattcacttgtcccatgaggatgactccttaccacaattctattatgcctgtattactcctgcaatacctccactagacgctactacatattctggatgtgtgcaaattcagtacgcacaactatacttaggcaccctcttaatcctccatttaataggttgatagaagaaattgaagctcagaaaaataatggaacttcccacgaccacacagttgatggaactggaatttgaggctagtactttctgattccaaagctaaaattatttccactacaagtttctataccaaaccttcccccatcctaccaccggcagccccaccaaattaaaataaaaatcccctcagctgctttttactccctttttctaactgtatagatcttattctgaatcctgagaaatagtcagggggtagtaagtttgatctccagttgaagatcaaacttacaatcttggtttctcttcatatacatattacagtacaaatattatgaagttttacataataagagaagattctgaaagttgtttttcatccaacctaatttcaaggaaactcagtcagcaaatgttctgataatgcaaatactctcaacccatgtccttcaggcatgaaaatggttctgggttaaaggtgactattctgcttagtagatcatataacaaatcttaaaaaaatcacttcgtctttacttatacatgcattacaatacaatcatcatgtttaagatgaactcatgtcttgtcttgtcaaagtttacaatttcaaactgtgaccccaaacatacccagcccatgtttctgaccttactcatcaatatttgcattcttattcttggctgtttcaactctgtgccacgggtttctctgcctaaaattctcatctccatatatccaaattctactcattctttaaaccccaatataaattccattttctgatgaagtctttgttcatcagtcgcccattattaccccgctaaattttctttcctctgacaatcccataacactttatctgaatcactcctagtgatgtcgagtcacattttaattagttattttcattttttatttgtatacatttgaggagtacaagtgcaattttgttacatggtgtattagtcagggttctctagaaggacagaactaataggacagatgtctatataaaagggaatttattaaggagtattgactcacgccatcacaaggtgaggtcccacaatagactgtctgcaagctgaggagcaaggaagccagtccgagtcccaaagctgaagaacttggagtctgatgttcaagggcaagaagcatccagagtgggagaaagttgtaggcttggaaactaagccagtctagtcttttcacgttcttctgcctgcttgtattctggtcatgctggcagctgattagttggtgcccatccagattgagggtgggtctgcttttcccagttcactgactcaaatgttaatctcctttggcaacaccctcacagacacacccgggaacaatactttgcacccttcaatccaatcaagttgacacttaatattaaccatcacgcatggatatattgctcagtgaagtctgggtttttagtgggtccatcacctgaataatgcacattgtatccaaaaggtgatttctcatctcccaccctccccgaacctcccacccttctgagtcgccaatgactattattccacactgtgtgtccatgtgtacacattagtttacattttaattattaatgtatagtcatgcaccacatgatgcttccatcaacaatgaacctcgtataccatggtcctaatagtcctgaggtactgcactgtcccttatggttattttttacacacagatcagggctgtggtgcaggtataaataagggacttagtgtgaaggtgtttatggataagagtttgaaacagagtttgatagaacagaaattgatcagagccttttatttttcataactaaggttaaactccctaagggaattaccacatatgtcataaagctttaaatttgctgcctaacgttagcagtataccatgaattcttgtaaagaataaaattatgcttgcttctttaattccattctgtaactcagactcttactttgtcagtctacacatgcctacaattagaatgaataaataataaaaatagtaaacattcaacatagcactgtattatgcaccaggctctggtctgagcattttactaaacaatgcaattaatacagcaacactgagaggtaggtactattttttcttttttattttttcttttttttttttgagatggagttttgatcttggtgcccaggctggagtgcaatggcaccatcttggctcaccacaacctccacctcccgggttcaagcgattctcctgcctcagcttcctgagtagctgggattacaggcatgtgccaccacgcccggctaattttgtaattttagtagagatggggtttctccatgttggtcaggctggtctggaactcccgatctcaggtgatctgcccgcctcggcctcccaaagtgctgggcttacaggcgtgagccaccgtgcctgtccaaggtaggtactattatcaccattttaaaaatgagaacctgaggcccagagaggttaaataacttgtccaatgttacacagtgaatacttgtcaaagctagaatttaacgtcaggtagtcctagttaattccctagtcagctttttcaatcatactggatttgaagtccttcagaaacaaaagcaactcaaaacaggtaatcaaacaattccgactactgctgcaatcataaaagcagaaaactttcggccaggcacagtggctcatgcctgtaatcccagcactttgggaggccgagacgggcagatcacttgaggtcaggagttcaagagcagtctggccaacatggtgaagccctgtctctactaaaaatacaaaaattagccaggcgtggtggctcacgcctgtagtcccagctactcgggaggctgagatgggagaattgcttcaacctggcaggtggagcttgtagtgagccgagatcacaccactgcactccagcctgggtgacagagtgagactccgtctcaaaaaaaaattttaaaaaggcagaaaactttctcatcgatgctttatgaagtgaatcactgatttgagccaaagaacctgccactatttaaagtgaattctaatataaagttggacaatatattttattctcatatatgtgatagttaccattttataatttcagtaatgtgacttcttcatcacaagtattgctttttagttgatggatatgaaaatgtgtgagaaaaatccccaaacctctgaatctgtaaaatgcaacgtggagcttatcatcataatgaaatatgtccatacaaccaaagatagtcctcaacttatgattttgttactttccaatgggtttatcagggtattaaatgcattttcaacttatgatagttttttatttgcaacaggtttattgggatgtaaccccactgtaagtcaaggaacatctgtataattattttgttataaatatgtaaataccagaatgtggaagactatatagctaaataatattaacctttattgagtgtttaccaggggccacattctgtactaaatgttctgattgtgtcatctcgcctgattctcatgatatcgtgatgagatcagtctattaccctgattttagaaatgaggttgaagacattaacttgtgtatatgaagtttccgaggagataagcagtgggaccaggatctgagtatgtgtgggccccagctcagcaacgtaatgatgcaaaaccacggcaaacagtccaatccaaaatgagaacatgaaaccatgtccctggtggtcctcaatctccatgtctgtcagaattgcttgtggagcagtacaaaccaaacaaaaacttccatgcaggtctgtctatttttgtagattcttattctttaggactgaggtgatatccaggcctctagaattttaaattttaacaaaggtgattctgatgcacaatcagaatgaagaaccactacgttctgtacattctgcatagtgtctgtagagatgtagaaacatttctttttaattacatgaatgctacgtgaaattttcattgaaagattcaaacaatgtagaggtatacagagcaaaacaaatatagacacatttccattctatcatatacattgttattctatttcaggtatttctagcatgcgttcttattaatgcactgattacatcagttcttttgatctaagggtcagattaaaatgtaagatgagattttggccaaaacagatcgcacatttctattggtggattttgtattgctgtgtatcttgtcttccataaatcaatgtcattatcttccatattcaaaagttcctgctgattgtgcaggtacacacacaaggctgtggagtcggttgtgtgactcacagtaggtgccttcataatttgttccctgcttagtcattcttggcaggagctgtcactgtttgcagctctgcctcttttttcccatggactacatggccatttggtttaaaataattcaacttttatctgactgctttaagatatcttgatccatctgccaggcgtctcccagcctttcctgctgaggagctcatttggatttttctggaacttgtgttctttcctaatcctgggactggggataaagagaatggggttcattgacaaagtcacccacaagggaattctgactgtactggagtctaattcaggcagccgcctgccataccatcttccttgcgagattccccagcactgtggggaagggagtgagccaacttagagactgcagccagcttagagactgatcctgtaagggttcaagaacagccagtggatcactattgacttactagttcatccgagttcagtggcttttggtctcttataattatttctttctactctaaagaaggttctttggaaccactttatagtgtctctttaatcagtcagatctgatcaacaaaacaaacctcgttaagtcattccaagaagttatgaagatactgaaaagtgctattatctccaaaataaggtagaaaaacagaataagggagaatttccataccccatccagaatctcacagtgtacagatctttcatgcgcctctccagatccagtctctacccttcttcacctgctctgtgcccttggaggctcatctgtaggggctatgtcattgcttccagatgggcatactacatagggaccactggcaggaaatcagcaggaagaaagacaataaagttgaagtacttatttcctcgggtccctctttttggggtcacagggaaaagctggacccataaactaaagatacagtgccaggtaagtggctttgtctacacagccctcttttctttaaaatttcaccagctgttccctctcctctccctttcagcctttgatgaatagcagagtcctgctgctaccagcactgtggtgtcgtgctgatgtggtttgtctctgtgtccccacccaactctcacgtcaaattggaatccccagtattgacggaggggcctggtgggaggtgattggatcatgggggtggatttcccccttgctgttctcatgatagtgagtgaatctgcatgagatctggttgtttaaaagtgtgtagtgggccaggcacggtggctcacgcttgtaataccagcactttgggaggccaaggcaggtggatcacgaggtcaagagatcgagaccatcctggccaacatgatgaaatcccgtctctactaaaaataaaaaaaattagccgggtgtggtggagcacacctgtggtcccagctactcgggaggctgaggcaggagaatcgcttgaacccgggaggcagaggttgcagtgagccgaggtggcaccactgcactccagcctggtgacagagcaagactccgtctcaaaaaacaaacaaacaaacaaaaaacaaagtgtgtagcatctccccctgtgctctcccttcctcctgctccagccatgcaggacatgctggctttccctttgccttctgccatgattgtaagtttcctgaggcttccctagccatgcttcctgtacagcctgcagaactgtccgccaattagacttcttttctttatgaattacctggtctcagtagttctttatagcagtgtgagaatggactaatacatgttctcttcctagtaatttttccacatactgtccatgcttttgtacatcatccctttattaactactcttcttaaattgccttatttcagtgtgacatcttgttttgctgggacccatataaagcatttagaggacatctctgtaattctccaaaatagcacaatgcctagaaacacactagcattttggattatataaagtaggcagccctgaaggttgagtgcagcaatattctctctatatgatttccagaaagacatgttaatagggctttcacatgctgtagatttccaacaacacctgaaggaaacttctccctcatggataccagccccattctctttattgcctcaaccaatctccttggacttctacctcattcatttacaccaactacccaattatcttagcaatatattcattctgaaacttaatccaaagattttagtaaatatccattagtcagtttccaatgtaaaaaatataagcttttaccttaaggtaaaaaggttttatttgggaattatatataggaaggattagccgggagtggtgtctcacgcctgtaatccaagcactttgggaggccgaggcgggcagatcacctgagatcaggagttcaagaccagcctggccaacatagtttaccctgtctctactaaatatacaaaaattagtcaggtgtggtggcaggctcctgtaatcccagctgcttgagaggctgagtcaggagaaagaatctcttgaacctgggaggtggaggttgcagtgggctgagataaaaaaaaaaaaaaggattgcaatctggtacatacatacctacaaactagggtgacttttggtatgtctgaaaaacaagaaaagattagaatttattggggaaagagaaggttacacaacttgttttggaaaaaagcttattggcacccggagtgtcttacaagaattggctgagcataactatgtactaagcactgtgctattctaatattgggtattattgtaacaagacttaaggtaaattttccattggattaaaaacatacaaagcaaattatttatattggtagacactatatgcctatatgtgtacttagataaacttatgtatattaataagcaaaatctaatattaggacaatttttaaaccatattttaagaagtgcattttttgtcattgaaaaatgtcaaagaacaaaataagacacacttctataacctcatctggattcattaagcagtaacatttatgccatacctgatatctcttcccctatttcctccaaccccctcgctctctctccatatgcacacacacacacacacacacacacacacacacacacacggacacatagacagaaattcccttttctcaactgtccaaaaattaggctgcagacatcaggacacttcattcctaagtatttcagttctcaagaacaggacattcttctacagaaccacagtaccagtaccacaccttagaaaatcattactagccgggcatggtggcacatgcctgtaataccagctactccggaggctgaggcaggagaatcagttgaacctgggaggcagaggttgcagtgagccgagatcgcgccattgcactccagcctaggcaacaagagcgaaactccatcttggggaaaaaaaaaatcattacttcaatagtaacatccaacacgcagtccatacccaaatttcctcaattgttccattatgtcctttattgttagatttgttttttaatccaggatccaatcaaggttgataaattacacttggctgctgtatatgttcagactcctcatattttgatttgtaccattgcttccctggtttataataataaagtctttgaagagacctgcagaacaccccatattcagatttttttcctcgtcgttaggctcaatttgaacatttctggcaagaacaccttgtaggtgatgctatttccctcccactgcataagttcaggaggcagaacgtcaggctattccactagcagcaatgtcaagctcaaccacttggataatatggtgaactctctattataaagatgtattttgtccttttgcaattaataagttatctgggccaggcgtggtggctcacgcctctaatcccagcactttgggaggctgaggctggtggatcatgaggtcaggagatcgagaccacggtgaaacaccgtctctactaaaaatacacaaaaaaattagccaggcgtggtggcgggcacctgtattcccagctactcgggaggctgaggcaggagaatggcgtgaacctgggaggtggagcttgcactgagccaagatctcgccactgcactccagcctgggcgacagagcaagactccgtctaaaaaaaaaaaaaaaagttatctgtgggccgataccttaaaacagcaagagtattctgttcccccagaacttgtaacctaatgatttaagcatctatctatctatctatctatctatctatctatctatctatcatctatctatcatcatctatctatctatccatacatacatatatttttcgagacagtgtttcactctgttgcccaggctggagtgcagtggcacatcatagctctctgtagcttcaaactcctgggctcaagtgatcttctctttttgccttcccaaagcactgggattacaggcatgagccactgcacccagccctaagcatttatttttaatgactcaaatcaagttttacattggaggttaaaaaataattttctcattctatcagtccttttatatttattagtggatgaaataaatatgctttaataaacactgaataaccagccaggtgtggtgactcatgcctgtaatcccagtattttgggaggccaaggcaggaggatcacttgaggccaggagtttgagatcagcctctggtctctctctctctctctctctatatatatataatatatatatatatatattatattatatatatttatatgttatatatatacatttatatataaaaatctttctctatatatataaatttaaaaataaacactgaatgaaatgacaaaatttcatcaactaagcaaagtgataaaaattttatcaccaggccttaggacttatgaaattctgatctccagccgttcaactagtctctccaagttcaaaggtagataatggcatccaaaagtgcctgggatacctcaggatttcagttcatttccaactacaccacaccccgagccaatcacttaagccaagtactttcacacatcaatttgagtgttaccacctctaggaagtcggtcctcattagccccaggtagagacagttgctctcatttgtgcccaagccatccacaaagctctgtcagggcatctctgacacttcattgcacataattactgttgagtttatttccctcctctggagaagccaagggagaataagaatcttgtcttactggttttctcacccatagcatctaggatgatgtttaactgacgttgaattcacagacatactctatatcatctaagaaaacccctgacggtaaagtgggatgtatgtcatttgtttgttttatgcagagaaaaattcagagaggttattttcagaggtctgattttgtatctacccaagaataaatcccaatgatgctcattcagtagtttagggatttccaggaataggaaaacatcccacatgttctgtcataaaatgcctcgctcatttctccaaaccttcccatcttgaatattctttccatttttctgattttttttgagacaaagttttcactcttgtccccgaggctggagtgcaatggcgcgatctcagctcactgcaacctccacctcccaggttcaatcaattctcctgcctcagcctcccaagtagctgggatttacaggcacctgccactatgaccagctaattttttgtatttttagtagagacggggtttcaccatgttggccaggctggtctggaactcctgacctcaggtgatccacctgcctcggcctcccaaagtgctgggattacaggcttgagccaccatgcccggccatttttctgattattaaagctattatttggtaacagaaacagagacaaggaaagactacataacttgactccaccatatactcttagaacataaaggggccaggatttccttggacagtccacagcatgggcttgaacactttcataatagagccttcatcttgttttggtgcagaccgagtatcaggcctgagaaagaagaaccgcttaaagaggaattgttagtctcctcatttacgggaggaaatccatctcaaagggggatcaggtaacttcccaagtaatggctagtaactagtaaaactagggttctgaacccagatgacctgactccacaggtagaggtcttcatggttgatccactgcctctttaaattcccctttcaaagtccaagagcaccttctttcttataattagactttacagaggaagggaaatccgcagttgtgccaaggctaacaccagctaccatttattgagcacggactatgttccaggaagtgttctgagtattttaagcatgttaccacatttcttccccactttcagcctgtaaagtagatgttgctctaagcataaaagattcttccttaattctcacaaccaacattgttatgaaaatcatggaggttttaactcagaagtataactcttttatgaaaatgtgcacagaataagcaatacagtagagaaagactcacaactgtaacattccggataagaaagagaattctggactttcatttttttttttgagacaaggtcttgctctattgcccaaactggaatgcagtgtcatgatcatagttcactgagcattgacctccctggcttgagcaatcctcccacctcagccttccaaatagctgggaccacaggcgccatccccacacccagctaactgtattattagtagagatgggccttcaccatgttgcccagactagtcttgaactcctaggttcaaatgatctgctcgcctcagcctctgaaagtgttagaattactggtatgtgccactatgcctggcctgggcatctttttactatgaaaacagcaaaaagatcagtggttgccaggggttcaggggggtagagggagagacggacgggtggaacacaagggatttatagggcagtgaagccattctgtataatactgccatagtggatgcatgtcattatacatttgtcaaaacctatagaaggtacaatgcaaagagtgaacccaatgtaaactgtggactttagttaatagtagtatattaatattggctcatcaattgtaacagacataccgactaatgcaagatgttaataatagtggaaaatgggggtgggaatgtgtatgggaactctatgtactttccactcatttttctgtaaatctaaaactgcaccaaaaattgcctattaattaaaaatacatatctaggctcggcatggtggttcacacctgtaatctcagcactttgagaggccgaggcaggtggatcacctgaggtcaggagtttgagaccagcctggccaacatggtgaagcagcatctctactaaaaatacaaaaaattagccgggtgtggtggcaggtgcctgtaatcccagctacttgggaggttgaggcaggagaattgcttgtacccagcaggcagaagttgtagtgagccgagatcacaccactgcactccagcctgggcaacaagagtgaaaccccatctcaaaaaaaaaatgtgtatctataagtatagatacgtacacaagaataaggatgtgtagcaaagaaagaacagtatttgcaaggtgctcaatgtatcatatgttgcaatgttcttaaaattggttttattggcttctcagttagcttctcttcaacttgttcctagtgaaccacactgcttcaacagagttgacagcagcagacaccacatcccatggcaaaactaaagggagtttccctttcagtaagcaaaaagagttgcattattaacatgcatccctatggtctgcggaaagtggcttccagtatttctgaacttaaactagtcaaagtttatgcaataggaaaacccaggtcatttttgccctcagaaagactgacgtgggaaaatattcccattggcactgcgagtgacaacaaacaaacaatcaaacaaagtgttctcatggtttttaaattaggtgtacttactctttaaccaaagtttcttttctgaaagcaagttctagcagcagagatggtacaaggtacaccacaagggcagtcataacaatccatattggcctggagcccaaggcaggagtcatcagggacagaatcattgccgcaggtccttagttccgtctgtgctccgtggagtgtggagaaaagtgtcttccagatcagctggtgggggctggggagaggggggagacgtgcacaccttgaaactagggcatctttatggcgtgagctcattttacctcttttctttttaaagtctagatgaggcatgaatattatgaattggaaattagaaagagaggagaagtcaaagaaggagactttcagtgtcagttgagaaaaactacacccaacatgcactcatacacacaccagtaagatcttgcctagggcgtacttcaagagcctggaaattagagggcacaagcatgagaaagcgaaggtgaaggtcagtggccctaaatgaaggactagggagaaatagaaagatcttattatcaagttcttaggttttgtttttttcttagtggggtgggaatgggggagtgtgatttaaaaaagaaagtaacacaggtgctatcttaaattacatggatactgtcagtgctggaggcggaggtggtctttagatctaatgtagagcatgggctttcagatgcattccatgcagcccaagaattttctgaagttcctctagggccattttcagtggctaaagctcagctgtgggccacccttcttccgcttcaacctcaacagctctacattcatgtttttgatatttggaatgcacatagtttatttgtgtgcctgaaaaaggtttccacttcttcaaagaaaatattttttaaaaacaatcaatttagtcctaagttcaaagagacagaatcttctaaagctacctgtatttacctgttgtcactttttccagatccgaaataactgaatggagtcttattttttccactcttttgctaatggaaagcctactttgagtacacaggctaaatcacatgaaaagaaaaatctcatgggactatccaaatcatgatgcagtcttcagtattattctgatatgaagaaataccgactaatgcttaaaaattggaaatgttgtcaaaatgacatatttaaactgtaaattatcaccttttcaggaaatagattaatccagacccttaattttaataacctgttttgcctttgttttgatacatttttataaaataaatgagtagtaaatactctttatttaatttaatggaatcttatatgaaacaaagtcttacaatgcctcagtctttgctccgaaatcagtgttcactgtacttatgtagttgtgaatatagaaaatgtgataaatttggctgaatttgtactttccctgtgttacattttgcaaaatgactctttaactcatcccctagccccagccttgtgcgtttatatgccaggggcataatccttagtaacagaattgatggatcctaggatatgcaaagcttcaaatttactaaacaaatgaagccaaattttgtttatcctagtgtatagcttgctttatcgtattctttgtggtattgtttgaaaagctggttcttactaaagtttataacattttcttttatattttataaccttttatatgtcctaagaaatctttgcctgccttaaatatttcctgctggaagtattgtggctttgatttttcatttagtctctgatcaagttaattttgcttttgttatttttttggtgtagtgaagtatattatgagtcaagacccattttctttcttacaactggtatcttctatccagttgtttcagcattacttgttttaaaaagaagaaaaagaaaaaatgatccttttctcatgaagtaccttgatctctgtcaaaaatcaattgttcatatgtatgtggatttaccggtagtcactttattctgtttaattgctcaattattatatttatttttataccaatacctcacctttttggttactgtagttttataataaatcttgaaatcagatagttaaaaatgttcaaaattatattgttctctttcaaaattattttggctcttgttaggtctttgtgcttctgtattaaatttggttttatttatttatttatttatttgagatggagtctcactgtgtcgcccaggctggagtggagtggcatgatctcggctcattgcaacctctgctttcggggttcaagcgattcttgtgtctcagccttctgagtagctgggattacaggcccacgccaccacacctggctaattttttgtatttttggtagaaacggggtttccccatgttggccaggctggtctcaaactcctgagctcaggtgatccacccgcttcagcctcccaaagtgctgggattacaggcgtgagccaccgtgcgcagctgtattaaattttgaactggcttataaaaatttccaccaaaaaaagtctataaggattttggttgggattgaactgattccaaggtcaatatgggggacctaatatgttaaacatattgagtcttcatattgagcagaatatatatatctctatttatttttatatatgtctaaatatttcctgagatatatttataatatttctcagcaaagttttgtagttttcagtgcataggtcttgcacataatttgataaatttatctctaattacttcatgtatttggatgctagaaaatggtattttaatttcatttttcaatttgtattgctagtatgtagaaacactactgatttttgtttattggcctcatttcctgcagtcagctaatttaacttactagtggttccctaatcgatttttcttattagttctcctgccctgccctctcaacggtcagctatgctctctatgacatcttttctttttggtaaacaaaccaaacaccacgtttgcagctgagtagctttctcaactgaatttctgcttcctgccttaaagaaactgatgaattaagggccttttttcatttagtgccgtgtctctctttctttttttaatgcaaactgatggtgttttctccaacagaagtctccggaaaggtcctctatgtagcctcttgtcatccctgcaccgtggccacaggggagtggtctaagggagtgaaagtaaaacggataaactttgttttaatatagctgacttctctccccactcttctgggctattattgtctctataattatttctttgtacaactttatgtcttttaaaaaagctaagagatgccgggcgaggtggctcatgcctgtaatcccagcactttgggaggctgaggcagacggatcacttgaggtcaggagtgcgagaccagcggaaccccatctctactaaaaatacaaaaattagccaggcgcggtggcgggtgcctgtaataccagctgctccggaggctgacgcaggagaatcacttgaaccctggaggcggaggctgcagtgagccgagatcgcgccactgcactccagcctggcgacagagcaagacttcatctcaaaataaataaataaatacattaattaatttaaataaacaaagtaaaaagctaagaagaaggagacatatagtcttttatattaatccacatatctatcatttctgattttcatatctgcctatggattttagttgtctttttttttttttttttgagacaatttcactcttgttgctcaggctggagtgcagtggcgtgatctcggctcactgcaacctctgccgcctgggttcaagcgattcttttgccccagccttccgagtagctgggattacaggtgcctgccactacgcccggctaatttttgtatttttggtagaaacggggtttgccggtgttggccaggctggtctcgaactcctgacctcaggtgatccacccacctcggcatcccaaagtgctgggattacaggcgtgaagcaccgcacccagccgttactttctcattttatttccttgttccaatatatctctattctcccccgacctccactttgtggtattattggtacatattagatctttttaaaaaatgattacttttctgtttgtccctgcagtacatattaatctttatgtgtcattacccttgcaatatattttgataattatcatttcatgcaattatcttttaaatcagttaagagaagacatcatatttaattatgtaattaccagtgcttgttctttctttatataaatttgagttactatccagtgtcatttcctttcagcttaaagtacttatttagtatttcttgaaagccaggtatgttagcaacacatttgctcagcgtttgttcatctgggaatggtgttcatctggaatgtctttatttcagcatcatttttaaaacatagtcttgccgggcgcggtggctcactcctgtaatcacagcactttgggaggccgaggcgggtggatcacgaggtcaggagatcaagaccatcctggctaacatggtgaaaccctgtctgtactaaaaatacaaaaataaattagccgggtttggtggctactcaggaggctgaggcaggagaatggcgtgaacccagcaggcggaggttgcagtgagcagagattgcgccactgcactccagcctgggcgacagagcaagactccatctcaaaacaaacaaacaaacaaacaaaaaaacataatctttctggttacttctgggattagggcaaatcaagtgaggcactcaccttgagcacaaaatttaagggaaaccaaaaatctcagtaatcaaaataaataaaaatgttttaatgccatatttaaaaatgaaaatggatgcaataaaacctatgatgaacaaaataccaaaatttaaaatagagataggatcaatattgctgatttttccttttgcctcaggctccagtatggatggcatgacatggcactgttggataaaattcttcattttcttttagaattgtgaattacgttatcccattgccttttggtcaccactatttctttttttaattaattaattaatttttgagacagagtctcactgtcacccaggctggagtgcactggcgcgatctcggctcactgctgcctccgcctccagggttccagcaattttcctgcctcagcctcctgagtagctgagagtagccaccacacctggctaatttttgtatttttagtggagatggggtttcaccatgttggccaggctagtctcgaactcctgacctagatgatccaccaaccttggcctcccaaagtgctgggattacaggcgtgaaccacctcgcccagcctggtcaccactatttctaatgacaagtccattgataatattaatgtcgttcccttgcacataatgaattttttttcttgctacttttaaggttttctccttgtctttggctttcaacgatttgattctgacatctctaggtatggatctgttttctatctatcccacttggaattctttgaccttcttgggtatatagatgaatgtttttcatcatgtctgggaaacttttggctgttatttcttccaatacagttgacctttgaacaatgcaggggtaaggggtaccaaccccacacacaataaaaaatctgcatatgttgactcctcaaaaactactgttgaccagaagccttacctataatataaactgtcaattgatcatattttgtattttatgtgtattatatactgcattcttaaagtaagctagagaaaaaataaaattataaggaagagaaatatatttgttatgcatcaagtgaaagtggattatcataaaggtcttcatcctcatcatcttcacattgagtaggctgaggaggaggaggaagagaagggcaagggttggtcttgctgtctcagggtggctgagctagaagaggtgaagacgggagaaggggaggcagaggaggaaggcacactttatgtaagtttatggaaatacatcataatttctgtttccttttttatttctctaaaaatgtttctacatggtaccaatccttcttccacctttgctttagtttcagtgcctgtatcatgaaagggtacatgttgtaaaataagttaaaagcaatcttgattaatcagaacccttctgccagatggtctcatgtcaatttattttctgacactgcttcttctacatcttcttcctcatcatgtaagcctggttcggaagcacttctttccaccaacctgccttctgttaactcctctggtgtggtgtctgttcactcttgaatttccttgagatccttgtcttgaaactcttcactcaccacctttctttttcttttcttttctttccttttttttctctctctctctttatttctttgcgatagccacaatctttttcatgatttccttgattgactctgtcataaatcctgtgaaataatacactacatctggacacagttttctccagcaggaatttattccttcaggcctgttggctttcctggcgttttctatcacaatgatgacatcttcaatggtgtaatcatttcagactttcatgatgttctttcttttgaagttctcttccatagccttaacaatcctttccacagagtatggtatgtaatgagccttaaaggttcttatgactcctaatctacagactgaattagagacattgtgtttgggtcatgtagaccccttcagtgctttcagtgttgaactcatgggattctgggtggccaggagcattgtccaatatcaaaagaactttcaaagtaggtatgtttatatacaccatggaatactatgcagccataaaaaatgatgagttcatgtcctttgtagggacatggatgaagctggaaaccatcattctcagcaaactatcacaaggacaaaaaaccaaacaccacatgttctcactcataggtgggaattgaacagtgagaacacatggacacaggaagcggaacgtcacacaccggggcttgttgtggggtggggggaggggggagggatagcattaggagatatacctaatgttaaatgatgagttaatgggtgcagcacaccaacatggcacatgtatacgtatgtaataaacctgcacattgtgcacatgtaccctaaaacttaaagtataattaaaaaaaaacgtaggtatgtataatgtgtcccacaggtattcattttttcctttttgttcatattggatcatctccagagacccatcttcaagtctgccaattcttttttttctgctagttcaaattttcttttcttcttcttcttttttttttctttgttttgagacggagtcttgctctgtcacccaggctggagtgcagtggtgtgatttcagctcactgcaacctctgcctcccaggttcaagcaattctcctgcctcagcctcctgagtagctgggactacaggcacgtgcctacatgatctaatcatcctctataagccctatctccttttactatcatattggtaattatgtttcaacatatgaatcttcagcgaacacaaatgttcagaccataacaatatcatactttctttaattctttcattacaaagtttctgagttctaaaaacatatattgtaatagttgctttgaagtctttagcatccagtcccctcaaaatggcttctattgactttttgcccctgtacatagatcatactttcctgtgtttttctgtttgttgttttgtttttaattttgctctgtcatgaattttattgactttctgttcttacagtgcctcagtagctttgtttgtttgtttgtttcttttgaatagctgctcctcaaattgctgtgtgtctggtcaatttccactcttgaaatgattgtttttgaaaatttttatccagttttatcattgcattttgaggtaagtaggtgctaagtgtctctctcagccatttggaactcctgcttcctgcaagaccctttaagacccagcttttaaagccacacatcacttctgcctcattttattagtcaaagcaagtcacagggctgagaatgggaaaatagcaggagagattctgtggctaaatcagtttttgctataatactaaatacaaaatgatctgttttggattttgttttttaattatgtaatctttcagagactatttttttaaagagatgaggtccaggctcgggtagaactcctggctcgaactcatgagttcatgagttcaagtgatcctcccacctcagctttctgagtagctgggattatagggttttcagaggcttttatatgataatgtcaactatgtagtgtcccaaatatctgtgactgtggattcttttgtggggttcctaagagcagggatatatgtctctcatttcctgtttggcacacagtgagcactgaaatattgctaaatggaatatatggaaatattttcatataagctctcacatgactagcatcctctggcaaatgctgggacacattgcattaccacagctcctttcccataaacgagcctaacttccaccaataacatctctacattcccacttagggtgaaaattttcccttggttccttttctccctaccctgtggaagggaagagtttatatttgtacttaggaatgcaatctccgtagtttaaaggcagagaaacagtggaattgacaggaagtacaactggaattttaaagagatcatttctagtttgggcttccaagctgttcttcatagcactagtaggatttaagctgaattttgatgttacagtgggagttcagcagcagagacaagtgagaaagtaaaagcagtcaaaaaggaaaggcaacaagtcagaaaagcatagtggggacaagaaaattagtttgtaggggaagtttatatgaagaggctagctagatatcactgaggaaaacccatacggaagaaaaggaaaaatagccatgataggcattatgaaggagaaattacctggtgactttttggatacagatggtgaaagaaagagttaactcaactatacacttgggtatatgaaagatattgcaaaaatccaggaaagagaagataaggatcagataggaaaagtgatttcaggatagagaagagaggacacaatggagaaaacagtttggaggtaaagtagtcaagatttgacgattgattgactctgaggaaggatgagttaaagttatgggtctaagataccccagctagccttcacctcaattgatattgggaatagtttggaagttgccaggttagaagggaaggtcgtaagttcagtgtcagatgtgttgatggcttgtcagacatctaggaagagatgactagtaggcacttgcataagtaagtctgaagcacaaggttagagcttgtaataaagattaaggaattgagtggaaacattggtgagataatcatcattgagagagagagagagtgtgtgtgtgggatgtgttcttacgtgcatggatgtgtatgtgtactcaagcacatgtagttttgatcttgaaatgtttgttgtatgtcagtttgttcattatattcttgattggtatgctgggctattatcccattgtcaataaaaatgtcaataaagaatagatttgggcaaggtggctcatgcttgtaatcccagcattttgggaggccgaggtgagcggatcacctgaggttaggagtttgagaccagcctggccaacatggtgaaaccccatctctaccaaaaatataaaaattagcctggggtagtggcacatgcctgtaatcccagctactctggaggctgaggcgagagaatcacttgaacccaggaagcggaggttgcagtgagtcaagatcacaccgctgcactctagcctgggtgacagagtgagtgagactccatctcaaaaaaaaaagaatacattttctttttggtcttctttacttgttgcaggaggctaagtaaatttcttttattttggaagcaagaaaacaaaaagaaattttacttgaccttgaatatcttccacatagaaaaacagcaattggaaaataaagttaaataactaactgattcattcaaaccaccataaaaatacatagaggtctgaacaatttagaggggttgtttttcacccatcttctccgctacgtaattttggagccctttatttagtctatatagactcctagcaattgtgactacctgtcctgaatcagaagctctgtatttaaggatttcacccaaaacttgctgtttattttgctggttcaacttataaaattgctcaacacagccggagagtcttcactggaaatagtgcatgatttatgagataattaggtaccttttttggttttgtttttagagtcgattcagagtgatccaagccatagcttgtggcatcgccccttctccttcatttttctctaaagtcaccttgatctgatccactcagagatgccagaaaaatgctcttcccttttggtaatgactaaattgcatagactatcattttattgtgctaggtctagtaagtgacctattaatgtggcatagggaggcccttgtggggaagtggtttactccaacacatttgcctggtgtgataattattcaggacatacccacgagtcactcctgaatatattgtgctattagtcagcctttttctcttaatttgcaacacaagtcatctgattgtaatcactgaataaaaccttcccaaagaagttgtgatctagaattgttttgtataataataataaatatctcttatttcttgttttcaactttgcatacacttagaaaagtttagggccgactgatggaatttaggatatataaaaaggagcttttgagttattttgaagttaatgagaaaaagaacaggttaccattttaaaaatgcttatattgcctatagtgtatatacaccaagtaattttgttccagtatatattgcagtcaaatgacagaatttgaaagatttcagattgtgaaagtgctatgtcagaaagcacagttagcattctagatttataagatgtagaatgaggtatatcctaaccggattatgtaaattttaaggaagtttcaaatatattactacatgtaatctaccccttctcacttccctgtaatgctgtgaagaggccacacatgctctggtaaccaggttttacagatgaggacactaacagactgaggttttgtgactttgtcaagatcacacttaagtggctgaagtaggattagaatgtaagaatttttgctcttaggaaagggttttccccatgaaatcatattggttctgaactttaaaaaagaaaaagaaaataaacattatatagctcttctggttgatgaatgtcactgtatctatatctgcttcactgtgattgagttagacttgctgtgattgacatttgctgagaggaccactgagctggaccaaacacactgcacagagaaatctcccacactgttctgttccatgtccattggcatgctcaggaatatgctaatttaggaaggtagtttttgcctacaatcaagcagaatgtcttttgaagagagaaggtgagaaaatgattgaaaattcttttctttcctgggttcttaggattatacacacacacacacacacacacacacacacacacatgtatataatcctaagaacccaggaaaggattttatatatatatatatatatacacaccacacacacacatatacacacacatatatatacacatatataatacacatatacatacacatatatacatatatacatacatatatacacacatatataatatacacacacacacatacatatatacacacatatatacacacatatatacatatatacacatatatacacatatacacatatattcacatatatacacatatatacatatatacacatatgtacacacatatacactcatatacacaaatatacgcatatacatatatacacacacatatatacatatacacacatatacacatatatacatatatacacatatatacatatatacacatatatacatatatacacatatatacatatatacacatatatatacatatatatatgtgtgtatatatatatattctagcatccagccaagagtaaaatagagtatttgaaaatatatcccatgactatagcttaggaaagtgtgattccactccctccttcctctcacctcccacacatgatgtgtgtggtgtgcgcatgcatgcgcactcacacacacccatcttctcaaattagttagctggcctatttctgaggtctgactcacatgagacattcttgtggggagtgacttttccttttcctctgcctctggaagacatcagaagccagaagaattcagaagaaaagggcagctgactgaacatggggttggagcctggtggatcttattataaaactttcatactctgggaaagtatacagtcttgtttagagtctgatatttgccattaactacaatctgcaagatgtttagaaacttcaattgactaaactgttaatgtcacaaaactaatcagtgattgttctactgcagaatgaattcttaatttgaggcttttcttgggtaactttattgtgacataatttcaaattcataggaaagttataagaattgtactaggaattcctacaaatacttaacctagattcaccaactgtttacattttagcctgtaccccttccccttcctttccagagcacatggaaacatcctctccctttaccccttaacatcagagcatatttcttaagtacgggggtattctctaaaataaccatagtacgccatcaaaatcatgaaattcaacattgatacaattatgcaattcacagtctgtaatagaattttattaactaacctaatgatgtctttttgaatgttttttttccccagtgcagtacccagtctggaatgctgcattgcacttagcgtcatgcccttttagactcctttaaactgaaaccagtcccttagtccttctttgtctttctaaagttaatattttttgaagaatacaggccagctactttgagaatgtccctcagttttagtttgtctgattttcctcatgatttaaaaatgcaagttaagctttttgttgttgttgttgttgttgttgttgtcaggactatcacagaagtgatgtgtctctctcaggaaatcacattagagacacattgtgctggtttgaactattattactcatgcttcctttgatagcttgcttaaggtagtgtccaacaagtgtctccattgtaaagttacaatgtttctctttaggtaactttcagggagttgtttttgaaaccttgcaaatatcccttcctcaccaaattttcacccccttgttttggcatccactgatgattttttttaaatcaattttcccttcaaatatttttagtgggcaatctactggaaggaagaactttcccttctcacccatttatttattcatttaaaaaaatcagagtaaggactcagagattattaatttattcaatgagttataatcccattgtttattttgatgttccaatactcccatatttggccaaaggcagtcaaatcctggactgtaataaatccttgaaccaaaaataaaatgcatgctcttctcatgatctctgatattttcctgatctggcctctgctgacctcatgtcagattcatctctggctccagtccctctggttctgtgttctttagccacactggacacctttcgattgctcaaccacatcaggttctttttcatcttagggactttgcacttatggttccttctacttgaacatattttcctgaatctccacttgcctggctttttctcattattcagatcttggcaaaccaagagattgtgattactctacctaatgttgcttaccacatttcctagtcattctctgtctcctccagtgttttattttctatatagctatcatcactctcctaaattatttatttgtgtgtctcttgtctaacaccctgtaagcagtctggaatcttatctatacgtgtaaccgcccaatgggttcaccatgcccactgcctagacagagccgattttatcaagatgggggggaattgaaacggagaaagagtaattcacacagagctggctatgcaggagaccagaattttattattactcaactttgtctccccgagtatttggggatcagagtttttaagataatttggcgggcaggggcttgggaagtggggagtgctcattggtcaagttggagacggagtcatacagggttgaagtgagtttttcttggtgttttctgttcctgggtgggatggcagaactggttgagcccgattactggtctgggtggtgttagctgatccaacaagtacagagtctgcaaaatatctcaatcactaatattaggttttacagtagtaatgttatccctatgaggaatttgaggaggttgagactcttgcagccagaggctgcatgacccctaaactgtaatttctaatcttgtagctaatttgttagtcccacaaaggcagagtggtccccagggaagaaggaggtcttttcaggaaagggctattatcaattttgtttcagagtcaaaccatgaaccaaattccttcccaaaattagttcagcctatgctcaggaatgaacaagtacagcttaaaggttaaaagcaagatggagttggttaggtttgacttttttcactctcataatttcctctgttataattttgcaaaggcggtttcatacagcagctaggaaaatgtctgcaaatgtgtatatgcatgcataggtgcttgtgtgtgcatgtgtgtgtgtgtggaaggggctcaattaatatttcttggatgaatggatgatgtaataatttagcctgatattctttatgatatgtctttcttagttttaagaatcctgaaggacaaaatttttccttacacaaattattaatgaatagaaattaccatttctttacttttatactttttactttgcttcattttctaataagcaaatatacactattctcttactgcaatatgtttgcatgtaaaaagtgtatgcttattgatatttttgagcaattactcagaaaataatattttcaccttgaaattatgaaaatactaaacattaatattttagtttacacaaacatatgcctagttagagccataaaaaaaatgctggccgggcgcggtggctcatgcctgtaatcccggcactgtaggaggccgaggcgggcggatcacgaggtcaggagatcgagaccatcctggctaacacggtgaaacccccgtctctactaaaaatacaaaaaaattagtctggtgtggtgtcgggcgcctgtagtccaagctactccggaggctgaggcaggagaatggcgtgaatccgggaggcggagcttgcagtgagccgagattgcgccactgcactcccacctcggtgacagagcgagactccgtctcaaaaaaataaaattaaaaaaaaatactgctgtctctttttaagagtattaaactaggacaaaggttacttgacctaggagattactcagcactgcctctacacggaaatgaaactgggggttttgtctctggtgtaacataaataacaaagaatgagccattagggacagggactggggactctggaataaactccactctgtgacagaggacagctgttcacttcccataagggcagttagacacaagcttttaagtttggctttgtgtttacttgttgctcaatgggcttggggtggagagagtactagttcataattggatttatttttgctcctccacagatttttagttgtggcaccaaaatagctgttaggttggtgcaaaagtcactgcagtttttgacaaataaatatgtgaatgaaatatctgaagcaatctgtctcaggatttttaaaaaatttgttaacctaaaaattccaggaaaacctttgacaaatatttgatcgttttctagatggtacctcatttttagaaatgtaattgttataattgcatagctgatttttttcccctaggaatagagacataggggttgtcagaagaggcagcatgcattttgtttgtgtgtttgtttctaaggagcttagcagccaccgatcatgaaccgacagatgccaggaaatcctttccttgttttgatgagtgcaacaaaaaggcaacttatacaatatctttcacccatcccaaaggatctgaggcatttcaaatatgccagtggcggtaagtgttttttaaatgtcttgtttgtgcagagtctgttgacaacattaggtcaattaccttattttctgtgaaagaaaacccattgaattctaaaactaaatgtgcactaatagtttattaagctgagtaaaatacattttggcaatatttttctttgagtcctggaagtttttaagataccacagtccagtaagaaagccacattggtgtttctacacaggagacaatgccatggacacatacatcagcttgagagtcgtgacaaattacagtaatagcaaactaatggaattacagacttgaaaatatttgagggctactcactatttagttttcaggtgaatataaatccagtttttttcgttttgttttgtttttaagataaagctactataaaaaaaacatcacttaaatactgggttgtggaagcaaactccagggaatactttgcccatagactcctttggtgactgaaaagtacttgttaaatgtctggagaaaaaaataacaggctataaaaaaggatgagtttttgtcctttgcaaggacatgaatgaagctggaaaccatcattctcagcaaagtaacacaggaacagaaaaccaaacactgcatgttctcactcataagtgggagttgaacaataagaacacatggacatgtcgggggaatatcacacaccaaggcctgtcaagggctggggggccaggggagggataacattaggagaaatacctaatatggatgacggattgatgggagcagcaaaccaccatggcacatgtatacctgtgcaacaaacatgcacattctgcacatgtatcccagaacttaaagtatactaaacaaataaattaattaagttaaattataaaaagagaaaaaataacatgctgataatttctgcttgtctaaattattcattaacataaaacacttttctctgttatcgcgtcttatttccataatggataatgttgttacccagagtttcattacctcaaagttgaggtttacatactttatacatctgacatgtaaaagggtcaggctcatctttaggtataataatcattaggacacaggccccaaattatgtctcccatctttctgatccactatttgaaatattatcattaaaattcatctttttaaatgataaaatattccttgaaaaagcaacagtaaaataaagcaaataaaagcttaagaggattaaaatgtactcttagaggccatccatgcttcagtgagaattaattatcaacttgttttcttctaaggtttgattggagaagaaagaggaaaggataaacttaaaatatgacacaccaatctagatgaaggtggggggaaaaatggcaaattcaccaacttctgcttgagatattcccttatggccttttcactgtgcagagttacacttcaccttctactagatccagatagtagttctggaagaaggaggatattctgggttcttaggagatcaaaactaacactactaggtttttatggtagagtaatgtaacctggagcaccaccacaattatacaagggcgtgcacacacatgcttgaagtgtcagcagcacccattctagtccagcctccctcactttatctctttttaaaccacctcaaatagagtggctgcaggagatgtggaaatgtttaagtaatggaagcaggagttgggcaagtattcatggttgaagtcttaggataggtgatcggcagtgaggacagcagagctgacatggacaaaacaagccagataggtcagtagttgtgtcaagcaatagaatccttctctctgtccatggagaccgaggcactgactttggtcatcatacctttagtctttgatgtagacaacgaaagatggaaaagagaagccaatgttccacgaaactgggtacagcaattgccctcctgcacagtcgaatcagaaaatacttgagcacgagcctgtttttcattagatcagagtactctcagatattatagtcagtatgatgtgtttcgtgtagacagataaactcctattcaactgacagtccagtcaagattttatttctccctgaaaaacctaatacagtgtgtaattcagtcagtctttcacagttctaagaacagagtaaattttcctatagtcttatcaacatcaccacaaacaatttgacctctaagctttgacaaaggacttctgactagaaagcaaggtttggggcaatcgtttatttgtttgtcttgcatatatatgattgatcttttgatagataaaagttgatcttttcttttctatagaaacaagggtcagtggatgaaaaatggaatcaaacaactgtcgagaagtctgtccccatgagcatgtacctggtgtgctttgctgtacatcagttttgtcctgtaaagagaatatcaaatattggaaaacctgtgagtctcattatattttaaaaatttaccatcaatgcatttgtaatttattttctactttttttttttttttttttttgagacagagtcttgctctgtggcccaggctggagtgcagtggcacaatctcagctcactgcaagctccgcctgccgggttcaagccattctcctgcctcagcctcccgagtagctgggactacaggtgcccgccactgcgcccggctaattttttgtatttttagtggagatggggtttcaccgtgttagccaggatggtcttgatctcttgacctcatgatccacccgcctcggcctcccaaagtgctgggattacaggcatgaggcactgcacctggccaattttctacatttctggggagtagtgcttttttttttttcaaacaacatgccagaaaatcccattagtccccagggtctgtgaacttgataatacatagaacaatatagaaaaatgactgaaaggacacaggtaaaaaataaacaaacacaacagacatagatatttatggccttaaattatttcaaaggaaaaatttgctataagtcaaaagctagctcctaagtatgccagcaaaaatacattaaaatgtttgggtatgcccagtgtaataaaatgtttgagtatatgtgtacctctcccatatatagactagacagagaagaggaaacctgaggtaaaggaatatccttcgaatgacgaggcactgagaagtttatggctccattcctatatgtaatcaaaataggagagcaactgtgtatccaaaaccatttttttaaagcatgataaaatataaataagcattttttaaaatatgaagatgactagttcaatagtttcctttgtttttgttgttgctgttgctttttttttttttttttgagacagtctcgctctgtcacccaggctagagtgcagtggtgcgatctcagctgaatgcaacctctgcctcccaggttcaagcaagtctcctgcctcagcctcctaagtagctcagattataagcgcctgccaccaagcctggctaattattgtatttttagtagagacggggtttctccatgttgaccaggctggtctcgaactcctgacctcaggtgatccacccaccttggcctcccaaactgctgggattacaggtgtcagccaccatgcccggcctcattaatggcttcttcaagttgtcttctgtgcttttttttccccctgtggcaatggggaaaattttttttgtattttgggtagagacagggtttcaccatgttggccagcctggtctcaaactcctgacctcaagtgatccacccacctcagtctcccaaagtgctgggattacaggagtaagccactgtgcctggccttaatcagcaatttttatttatttattttacattaatttttttaagagacagggtctcattttgttgcccaggcttgagtgcagtggcacgatcatagctcatgcagcctctaactccaggctcaagtgatcctcccaccttagcctctggagtagctgggactacagatgcatgccaccattcttggctaattttttcaatttttcatagagacagggtctccctatgtttcccaggctggtcttgaattcctggcttcaagtgattctcttgcctcagccccctaaagtgctgggattacaggcatgagccactgtgcccagccttttgtactctgttgaggtgctcagtcattctatattttcttgaacattgccttactttctggcatcataaaatgttctgggctcatattacttttcttgccccagtcctggaatcaaccattttcccaggaagctctgggtttgtttgtttgttttgtttttgttttttggacaaaggtacatagaaaacaagatctgaatgctaggtatataaaaagcattttgtaacacgttgtggaaaaatagagaaaaaaatcagatgagggcagtgtgtcctctacgtttagcagagtgtactcactagacacccagtaagtgtttgatgttagtgtggctacacttgtaaccaaatatagtcagtgacaaaaatgcttcatctcgacagtatgggtaaggtgacccactagctctgcttaccaggtattgaggagtttcttgggacactggactttcagtatgaaaaccaggaaagtcccaggcaacctgggatgagttggtcaccctaatatggaatagggtcagtgaggaagggaaggaatcaatgttggctgcgttcagcagaggaaccttctggagggtgggaagcatagcttatgcagctctctgagacatcaggagttgctaagaatccctttctctgctccttaggcatctcagatgctgtcattctccatgagtagcatttgcagcatggacctcatccatagcttctgattctctgccctatcctcactgagctctaaataataactttgaacctttcaacacggctcagataagctgtgatgggaaacatggtctgtgccaatggagcacatggttctgccagcgacagactgttcgagaaagaggtgggaagtccagatgtacaattactactgggcttccaacagcatcccatccggggtttacagaagcgcaactcaatcaacaaaggttttgtttcaagcatcactgtccacagctgctgtggcgtctcagtttttcctatcaaatattttccaaaagggctgagtgtgaggctgaaggatcagaggaagaaaggtttagagatgaatgcatcttaggcttgagcagaaagtcagtcaaacatcttgttaaatcccctgccttgatgtattattgcccccattctgcagattcagaaactgaggcttcagaaccattaatggttatgcccaaactgcagctagagaagggatgagagaactctttcctctaagactagcgctcatttttccacacaaatgcttcctcagttatgttcctaaaacccacataatgtgtataatgagaaagtcctattaaaaaaatgtttactgaatctagatttcccatcttatttgcgcatgaagctttcttcaccagattcccattatgagaccacagagagctgagtctaagaaagtcgtcacgggtggggaatttgaggtttttttttaaaaagaagtgaaaaatcacagacatattagaagtactaaaatactgtaaccactcatgagggaattgtttgggttgataactctgtaggactgatacaacataagggcattttgattggctgagccatggtttactttagactacaaagtactgtccctatctttcagtgtggctgtttcagtagtatttgtttcaatcctatttttcagccagtgggtgaaggacagcagtcacataaaaactttcttcaagagatttcaggcttggcgcagtgtaatcccagcactttgggaggccaagctaggtggattgcatgatctcagaagtttgagaccagactgagcaacatggtgaaaccctgtatttacaaaaaaaaaaaaaaaaaatgcaaaaatgaaccagacgtggtggtgtgtgcctgtagtccctgctactcaagaggctgtggtgggagggtagcttgagtctgggaggttgaggctgcagtgagccatcttcatgccactgcactccagcccgggcaacatagcaagaccctgtctcaaaaaaagagagatttttagagactctgagtacacacagtgttactttggggtccaaagtgtgtgaggcagagtcactcaagagagccaatctcctcatcttgacacagtctttagtgcagggctggccctttgagaatttgtagttgtggaagcattaggagatagcacctctgacaaataccttgacactttggtacaaggaactcctgcctatcagtgataaatagagagcaatcccatttttttttaaaaaaagaggagagttgctatgaaaaggatatttgtagaatgggaagccaccaaggttttgaccataagatgagagcccaagtttgctggtaattagaaataagacaaatgcaaattcaaaccacagtgagctacttcttcatgcctactggactaggtgacaattagagagctagtggggctatgggaggccacatgctctgttggtgggtgggtggactggtactgccattgtggtgttactcatgcaaattatatatatgtttacacatgcctcagtaattccttgcctggtatttatttcagggtccataatggaacttgcacaaggaagttttttgcattatggtttatggtggggaagttggtggcaacctgggaattcattacaagaagtggagaggtagggataggcaggggtcatatagtttggatacttgtcccctccaaatctcatgttgaaatatgatccccaatgttagaggcagggtctggtgggaggtgatttgatcatgtattagttcattctcacactgctataaagatattacccgagaccgggtaatttataaataaaagaggtttaactgactcacagttcagtatggctgtggaggcctcaggaaacttacaattatggcagaaggggaagcagcctccctcttcacaaagtggcaggagagtgcgtgtgcataggagaaactgccaaccatttataaaaccatcagatctcatgagaactcactcactatcatgaggacagcatggggaaaccacccccatgatcctatcacctcccaccaggtctctccctcaacacctggggattacaattcaaggtgagatttgggtggggacacaaagcctaaccatatcagatcacgagtgtggatccctcatgaatggctgagcaccatcctttggtgataaatgagttctcactcagttcatgtgagatctggttgtttaacagggtctggaacctccttttccctcttgccacgtgttatgccagctgcctctatatcttctgccatgtttggaatcttcttgatgcctcaccaggagcagatgctggtgccatgcttcttgtacagcccacagaaccacgagccaaataaacctattttccttataaatgatccagccccaggtatttctttaaacaacacaagaacagactaacacaaagggtaatattcagctgataggcatgatacagccacacgggttgttgaactagtgaaacagtgtcctcatgtcatgtgggttgataacctgctgcttctcagcctactaaatgcctctccatctcccctacaaagtaccctaacctttcctgctgcagcaatttaagattaaattctgaatttcaggagcctctgggacccagttccagcccagcattgaggctccctcctcattaggtcatgtctgtgttgttcaagggttaaatattttgtacattaactgtgtggaggggtcaaccacaataaatttatacaatgggctactaggcagtagttagaagcaatggctgtagatacaagcttatatcttaaaaaactagttcttatgcaattgaattgttctatattatgtcatttacaaaaattaaaaattgcatgcacccaaactaaaatgtgcattttataagaacacattcaaaaggtgagacacacaaacgatacattaaaattattgcttagggaagaaaagagaactggaatgagttatggcaattaaagggagtgaatgaatgaatgaatgaatgaaaacaagatggacagtgcacaggtccagaggacatatcatgaagtaaggagtatggccaactcaatcatcttcccccggagttcaaagtgagaaagcattagctaaaacataacaccatgagccaggcactgttgaaggcactttgcatatagtaactcatttgatcctgacaacattctcaagcctgtccaggtcctatttgcctttggatccagtcctggccatttccctctctctgctgtatcctagcagtgttaacgttgttccagtggcttctgaaccagccaacattgaccaaccagagcagcagaagaaaaaggtgggagagtggtcctgcagctagttggtaagccatctaaaggcacacaatggggactgtgttaatttcagagtgctgccatcagatttaccaccgatttagtggcttaaatcaatacaaatgtattattgacaattcggtaggtcagaaaacaaatcggccccactgtgctaaaatcaaggtatcaaggagaccatgttcccctttctggaggcagtagggcagtggtccccaactgttttggcaccagggacagaattcgtggaagacaattttttcatggaccacaagcagttggtgggggtggtagtttctggatgattcaagcacattacattattatgcactttatttctcttattctattattatattttatttctatcattacattgtaatatatactgaaataattatacaacttatcataatgtagaatcagtgggacccctaagcttgttttcctgcaactagatggtctcatctggggttaatgggagacagtgacagatcatcagtcattagactctcataaggagtaggcaacctagatccctcgcatgcccagttcacaatagggttaggcaacctagatccctcgcatgcccagttcacaatagggttcacattcctgtgagaatttaatgccacagctggtgtaacaggaggtggagctcaggcaggagtgtgagtgatggggagcatgtgtaaattcagatgaagcttcgcttgcttgccctccactcacttcctgctgctcggtccagttcctaacaggccatagcctgggggttgaggacccctgccctaggtgatcatctatttccttgcccttttcagcttctagaggctgctcacatcacatttctctcttcataacccccttctctgttttcaaatccaggaacattgcatctctctcaccattctcacataatcacagctccctctctgactctttttttttttttcagatggggtcttgctctgttgcccaagctggagtgcagtgatacccaaatcccaatccccagaacgtgtggatatgttatattacatggacaaaatgattttgcagatgtgatcagggttaaggactttgagatgagggtatcatctcagattatccaggttggatattatccatcgctcactgcagcctcaaccccctgtgctcaagtgatcctcccttttcagcctcccaagtagctaggaactacaggcatgcaccatgatgcctggctaatttttacatttttcttttgtagagacagtcttgctatgttgcccaggctgctttcaatctcttaggctgaagccatcctcctgcctcagcttcccaaagttctgggattacaagtatgagccactgtgcccagccactctccgactctgacctcagctggaaaagtttcttttaaggactcatgtgattaggttgagcccacctgcataatctgagatgatactttcatctcaaagtccttaaccttaatcacatctgcaaaatccttttgtccatgtaagataacatattcacacgttctggggattaggatttgggtatctttaggggaccattattctgcccaccaaagagatgaacagaaatattttggggtgaaatgatgccaaaggagaaagcagggtagaaaacaagggaatttgccactgatgttggtttccatgtgatctcatgtctaattcaaacattgatgaaatctgccagcatttgagctgtacttagaatacagtcatttgcagaagatcaaaaaagatcctggaaaaagaataagataatcaaaggggttgagggaagcagttccagactctcagattaactgcagagtggggagggtagaggtggagagggtggtgtaggagggttatggggggcagtgtgagggtgggaggagttgcaggctcccagatgtactgtgaaacacgaaaataaatgaggtgaagagaagaaaaaggatgaaaagtatacatttccttgtctctcataaaagaaagctaagatagactgggcgcagtggttcatgcctgtaatccaagcaccttgggaggccgaggagggtggatcaactgaggtcaggagtttgagaccagcctggccaacatggtgaaaccccatctctaggaaaaatacaaaaaaaaaaaatatcagcgaggtgtggtggtgggcacctgcaatgccagctactcaggaggctgaggcaggagaataccttgaacatgggaggtggaggctgcagtgagctgagatcgtgccattgcactccagcctaggcaacaagagtgaaattctatctcaaaaaaaaaaagaaaagaaaaaagaaataaagagctaagataactaagctctccaataaaaatagcaaaaacagcttttttttttattagagagcttagttatggagaggtaattttggtattaatgttttaagggaatccctagcagaatcaaaaactgtatgtttgtcttccaaatgagtgacaaagatgacaacaagtagagcattgcccagacatcagaaggccaaatagaagattcaatagcagaatattaaaatacagcatgaaatagactgacagaggctggatccaggaggcatttacaccagtgatttgtacctaacggtgtaaattccactgccaagaaaccaagactctcacactacaggactgtatttgtttaacaaattgctgcttctgaaacatctcgctgaagctgaatgacctcaaaagtctaaaagcaaaattgagaaaggcaatattaattaaaaaagaaaaggtgacttccagtgtagaaaatagtaacctaacatctagggcaaaactattggccatgacaagcaggaaaattacttatgataaaaatctaaaatcaataatacaattttgagattatcaaagtttaattctttgaatcaatataataaataaaatacaacccacgggaaagacatgaaaatcataattagaggataattttttttcttgttcttttttgagacagagtcttgctctgtcgcccaggctggagtgcagtgacatcttggctcactgcaacctccacctcccctgttcaaatgattctcctgcctcagctcctgagtagctgggatttcaggcacctgccaccatgcctggctaatttttgtatttttagtagagatggggtttcaccatgttggccaagctggtcttgaactcctgaactcaagtgatccgcccaccttggcctcccaaagtgctgagattacaggcgagagccacctcactcggcctagagaatgattttgattgttctatgttaatgacaaattaaggacacaaaaattaaatatggatataaatgatataaacaatgaaaataagttagatggaatgaataggataagtttttttactttattgaaaatataccttcttttcttatgtttgtgattgtttatacaaattgattatatgatacacactgaaaggcacaaagattcaaaaaaaagcattcaataaatatagaatttttacaaatattttattaaataacagttgtctcacagctcaagattaaaaccacagattattcagaaaataaggaaacttcttttttattttaaaacattacagaaacaggctgggggcggtggctcacccctgtaatcccagcactttgggacacggaggcgggaggatcacttgaggtcaggagttcaagaccagcctggccaacatggtgaaacctcttcactactaaaaattcaaaaattaaccaggcatggtggcggatgccagtaatcccagctagggaggttggagtgagctgagatcgcaccactgcactccagcctgggcaaaggagtatgactctgtctcagacacacacacacacacacacacacacacacacacacaacccctgccaccaaaaccactatagaaatatatattcagtcatgcgccacataatgacacttggatcagtgatgaattgtgtctatgacagtggtcccatgagattataataatgtattttttgctgtttcttttctatgtttagatacacaaacaccgttgtgttacagttgcctacagcattcagtacagtcatatgccgaatagatttgtagccagggagcaatgggctctaccatatggcctaagtgtgtggtcggctctaccatctagccttgtgtaagctcactctgtgatgttcacacaatgatggaattgcctaataaagcacttgtcagaatatatctgtttttaagtgatgagtgactgcagtgtggtcaaagcaggactccaaaataaattcttagctttgaatatttcataataaaataaaaaggtgaaaataaacaaaacgaagcattctaaccaaaatttaaaaataaagaaaataattatactgtccacttaaacaacatgaaaccatgaaacctaccaataaatgtattttagaaaagactaatagaataactaaaatactagttattttagtataaaatattatactaaatataaaatgaaataattaatattagtaatattaattagtaaataaatagtaattaatattaaataaaatactaaaataactggggctggtggtggtggctcacacctgtaatctcagcacttctggaggcagaggtgggcggatcacttgaagtcaagagtttgagaccagcctggccaacgtggtgaaatctctactaaaaatacaaaagttagtctggcctggtggtgcacacctgtaatcccagctacttgggtggctgaggcaggaaaattgcttgaactcgggaggcagaggttgcagtaagcagagatcatgccactgcactccagcctgggcaacagagtgagaatccatctaaaaaaaaagaactaaaacactagcaagtttcaaaacatgagagaaaaaaaagaggtgtaacaatagaaaataataatgcacttttaatgcattattataaatgcaattacgaggtgtacataattatattctattaataatgaagcatcttaatgagatgtattatttttacataacataaattgacaatggcaaattgatataagatcaaataagaatttgaaattatactaaggaatgaaacaaatgagaaatatttaatgtgggtgttttctgctccctgtctttacaaaaagacagaaagctataagatttatcctgtaagggagatgttgctgttcccaatacctgaccaagataaccaaaagtatattagaataatctcacttgtgaatacaaaactatgtgattaataacagtgtcagtaagtagaatttaatgatatcttaaaataataatataaaagcacaaagggtttatcccaagtatagaagtgatcaatattaagaaaaacattaatatattactatagcttatattacatctctgaaaaatgagtctataaatggataaatgagtagatattaaagggtgttttatcaagtcaatctattattattttaaagtcttataaagacatataagaattagagactacttccttaatattatcaagagtatattctaagctattaataataattgacattatgctccaaggagaaataagccctctaaggatttctcttcaaacaaagcacttaacaaaagtcccttgtctgcctttttagttaattcacttttgaaagttatgagaactggctttgtgtatcttggctatcaaggaggttagagactcaactttcatctgaaagaactctaagtatctgatataatgtttgtcccctccaaacctcatgtctaaatatgatccccaatgttagaggcgtgtggtcatggagtggattcctcatgaatggcttggtgcccgccccaaggtaatgagtgagttcttgctctgttagttcactgaagagctggatggttatttatttatctatctatttatttattttgagacagagtcttgctctgtcacccaggcaggattgcagtggcatgatatcagctcactgcaacctccacctcccgggttcaagcgattcacctgcctcagccttatgagtagctggggctacaggcgcccgccaccccgtctgactaattttttatacttttagtagagatagggtttcactgtgttagccaggatggtctcgatctcctgaccatgtgatccatccgccttggccccccaaagggcaggaattacaggtgtgaagagctggttgtttaaaggagcctggcacctcctcctctctctctttcttgcttcctctctctccatgtgatacactggcttcccattcaccttcttccatgattggaagcttcctgaggtcctcaccagaagcagacactggcaccatgcttcttggacagcctgcagagccatgagccaaataaacctcttttctctctaaattacccagtcccaggtattgcctgatagcactgcaaaatggactaacacagtaacctcaagacactagttctcttcctgcttccaggtggggcaccgcttgctttctcaccaggtgctgctttggaaacacagcacaatgaaaaacagaaagctcgcttttacttcttaggggttatctggtctgaaccccccagtttgcatgtgagaacactgaacttcggaaaggaaaagtgagctatgtaagagcaaacacttactggcagagctagggatgaataatcacaatttatagaacacccgccactcaccccttgaacagccttaggaaaaatattgcacttcctattgcattcttttttttgtttattttggagatggagtctcactctgtcacccaggctggagtgcagtggcatgatcttggttcactgcaacctctgcctcctggtttcaagcaattctgcctcagcctcccaagtagctgggattacaggcacccaccaccacacctggcttaatttttgtatttttagtagagacggggtttcaccatgttggtcaggctggtctcgaactcctgaccccaagtgattcacctgcctcaccttccaaagtgctgggattacaggacctactacattcttgcaggtgagaagagtgagacttggaggcattaaacatctgtcctaagatcacccagttagaagaagcagagcagagcggacagaacacccaggataagtttgtaatttttatttttataacatttcataaaataatgttaaaatgtttatatctctcttttttttctgagacagattcttgctctgtcacccaagctggagtgcagtggcgtgatcatagctcactgcagcctcgacctcccctgctcaagcaatcctcccacctcagcctgatgagtagcagggactacaggtatgcaccaccacacctggctaattattttttttttattttgcagagatggtggtctcgatatgttgcttggctggtctcgaactgggttgaaccaatcctcttgccttggcctcccaaagtgttgcaattacaggtgtgagccaccacacccagccttgtacctcttttaaatatttgttcactatttattcaatgagtcacatcagcatatcacctaccatgtcaagggcaaaccagcaaagcagaagtccagaacagagaccacatttctgatgtatgacatgttgacatggcctaggaccctgtctcttaatctggttctgagacagttttggattggaactcaaatttgctggttccacagcctgtgtactgggctatggcactcagagctcctgattcctggacaaatgtactttccttgcgaacccctttctgaaaaccaaaactgaagatggcattattttcccttcccaggtcattccaggggtatttcttgtccacctacgttgtgcagagtaataagcatgagaccaggcaggcaaggtctagcctcacctagaggataagaccgggctgaaacatgcaactgcattttcaggctgtggtttaatatttgtctctggaaattccagccaggtggcgctagtcttgacttctctggcttctttaggaagctttctcttctggctcctgatgattggctttctgtgggaaggtgcctgtaaactttctccccatggactctgaccttgctgcttgtagtctgatctttgctttggtttctttcttgcaggagaaggcttctactgcacaactggaagaaaccattgctttgggaattttctatcctgcagcccttagctaccctttgctggaatgctgccaccatgactgctagagacacttcgtggaagaccgcaggatgtgccatcttttctcatgtgggccaggcacaagcttctgttcattcaacctatggtttgaaggtcaaccctgtgcagcaactgtttaatctctagaagagatgctgataaaacttggaaatgggccaagcgcggtggctcaggcctgtaatcccagcactttgggaggccgaggcgggcggatcacgaggtcaggagatcgagaccatcctggctaacacggtgaaatccgtctctactaaaaatacaaaaaattagccaggtgtggtggcaggcgcctgtagtcctagctactcggggggctgacacaggagaatggcatgaacctgggaggcgaagcttgcagtgagccgagatggcgccactgcactccagcctgggcaacagagcaagactctgtctcaaaaacaaaaaacaaccccaaaaaaacttggaaatgttgtagctcaggtatctccattatgattgaaaccacctttgcaaaaagtatgacagtgagagaaacatgacatagaaaaattatgacagggaaagaaatctgacctgattccattttgcttctaacctccaagctgcctttgttcattctgggcatagaccaacctaaccatgggagaaatttaatttacagtttgactttgaatcaaggataataggactccctttctaaagctgaactcctgcttgtcccagtactgaaaccatctttgtaagatccctgaaagaccacgagattgggattataggaggggtctgaaatctgctaagatgtaggcttagttaaataataacctgccattgttccatagcttgctttcttataatccctaatcattcaggattcatgaatccagacttcacaagatttgtgacttccccaattgctcatatagatacccaaagggggccttttgagatgtttttcagactattgcattcttacaactaactccatttggacccatgactcagtactcaacccagtcctgtggtccccacccaaaggctgactcagctcacgaggacagttttccacacccctatgattttatcttcaaccaataagcactacccattgcttagcccctcccggccaaattatccatgaaaaccctagcttccaagctttcaggaagactgatatgagtaataaactcctatctcttgcttagctggctctgtgtttattaaacgctttattacaatacttctgtctcagtaaattggctctatctgtgcagtgggggataagaagccatcaggcaattacacgattactccttaatacttaaccaacagcaatactcataaagcactatttctaaatatttattcaacacaatccccagaggcccagtggcatgaaccacaacactcaagttcttcaaactgataccttaaactttttgggctttattcacttcccacatatgatggaaatcaagtttcacagcttccctttaggaagttgaaattatttctgattcatgctgtaactgcatccagttctctctcctgcagtattttttcctcaagccaaacggggcttgttgtgttttatcctcattcacaccatgtatttctacactgtcacccctttgtccaagccattctttttgcctgacatgcccttctcatggatggatctctgccttcccacagtccacttatgcttcaaaacgcctctaaaaataaaaatatcaaaaagacacctgcacttgtatgtttattgcagcattattcacaatagcaaagatgtggaatccacctaagtgcctatcaagggacgattggattttaaaaatgtgctatgtagaaaccatgaaatactactcagccattaaaaagaatgaaataaaatcatgtcttttgtagcaatgtgaatggaactggaggccataatcctaggtgaaatagctcaggaacagaaagccaaacaccgcacagtctcacttgtaagtgggagctaatcagtgcatacacatggtcatacagagggaataacagacattggagactacgaaaggtgggaggctgggagggggtgaggactgaaaaagtacctattgggtgtaatgttcactatttgggcgatgggtacatgaaaagcccagacttcaccactccacaatatattccctaagaaacctgcacttgcaccccctaaatacatagaactacaaacagaatttaacccaaaaccaacagaaaagcacaaaatgcttccaaatgccaaatgttttatgctgtgctatggagctgcgtggtgtggggaacacattcaaaattcagagttttcatgtctccctcagcgggtactttctgctgggctccttcttgtctctgacaacccggatgcatggagagttcacacacgcacacacacacacacacacgtgtataaatacatatacacatatttattactacacatatacatatttataactacatatatacatatatttttttcacatgtctatatctgtctgcttgtctatccatctctgtatccatctacttctatttatccctatccatctatctatccatttctctccatctatacatatctatttatgtatcatgtatccatctattgatctatatctatctctccctatccatctatccatatatctatccatttttctctccatctatacatatctatatttatcatctatgtatccatctattcctctgtatctgtctatgtatctatcatctatctatctattcctattcatctgtttctttctccatctatacatatctatcatctatctatcttctacttatctatttgtctctctacgcctatccatctatttctctctctccatctatactatctatctatctagcatctatctatttctatcatctatctatctatcgatcaatctatctatctcacttattcttcatggcatggctttgtgtcttttatctttaattgattccaacaacactctgggaatgaatgaacacacatgttaaataaataagagaatgtcccaggatgctactgtctgattttcttccaggcctattggctggttgggcccatgcatgtaatgtcaaggttggatatcttggctgctacgacatattccatttgaggaataatttagaaatgtgggcgcaagataaaaatgtcagtctggctcctggttaacgggtgtttctaattaagccacgatatacagtgctcacagccaaataacagtgtggctccggcgataactcaccaaatagtgtgttgtcttcattatctcattccctgacatgtccctgatgagtttataaatccctgtggaatcatggccttgatctctttaatgaggcctttaaaaactggggcaaaattatagcagcagataaggttggctccgctgtagacctacttcataaaggtttctcctccccctagtgaaataaacaccatttgctagacccaggagtttaattccatgtgaattggtcagggcatatgattgagttaattcttcaagcagcaaaagaatattaaaagtagtttctgtcttccctgacctagtgggtaactaggtaactagaaatggaaatattcctttgctctagtaaagagaagggtagaggacaatggttcacgcctgtaatctcagcactttgggaggccgaggcaggtgggtcacctgaggtgagattcaagaccagcctggccaacatggtgaaaccccatctctactaaaaatacaaaaattagctgggcaaggtggcaggtgcctgtaatcccagctactcaggaggctgaggcaggagaatcacttgaacccaagaggcggaggttgcagtgagccaagatgacaccactgcactccagcctggacgacagagtgagactccatctacaaaaaaaaaaaaattgtacttttcgtagaggtggggtttcaccctgttacctaggaaggtctcacactcctaaacagcagtggtgtgatcacggctcactgcagcctttccagtaatttttctgcatttaaaaaaaacagttgagggctggcacagtaactcacacctgttagcccagtacgttgggaagccaagatgggaggattgcttgaggtcaggaggtcgagaccagcctagtcaacataacaaaaccacatctctatttaaaaaaaaaagaaaataaaaagaggctgggcgcagtggctcatgcctgtaatcccagcactttgggaggcctaggcaggtggatcatctgaggcctaggcaggtggatcatcagcttgggtgacggagtgagacttcgtttcaaaaaaaaaaaaaaaaacaaggctgggtgcagtgtctcacgcctgtaatccatatagtagcaaacttttaaaaaaaaataaacctttgttcctatttcagattgaggtcaggagttggagagcagcctgacaaacacggtgaaaccccgtctctactaaaaatataacaacaacaaaaattagctgggcctggtggcacgtgcctgtagtcctagctacttgccaggctgaggcaggagaatcacttgaacccaggaggtggaggttgcagtgagccgagattgcaccactgcactccagcctgggatacagagcaagactccatcaaaaaaaaaaaaaaagaaagaagaaagaaagaaagagagagagagggagacagagggagggagggagggagggaaagagagagagagagagggagacagagggagggagggagggaaagagagagagagaaagaaagagaaagaaagaaagaaaaagagaaagagaaaaagaaagaaaagaaagaaagaaagaaaacataacagttgaggttaaataaagtaaatttttaatttttttcacttagtatatcattactatcttctcttacaattagaaatttataaagttttttaaaatgcctacacaataatcctttaggtaaatcaacataacttaccaattaattttttattgttgaatgtttcagtttcttgaaacttttccatataatggcccgggcatggtggctttacaggtgggattatgcctgtagtcccagcactttgggaggccaaggtgggcggatcacgaggtcaggagattgagaccatcctggctaacacggtgaaaccccgtctctactaaaaatataaaaaattagccaggcgtggtgacgggcgcctgtagtcccagctactcgggaggctgaggcaggacaatggcgtaaactcgggaggcagagattgcagtgagctgagattgcaccactgcattccagcctgggtgacaagagtgagactccgtttcaaaaaaaaaaaatccatatagtagtgaacttttaaaaaaataaataaatatttgttcccatttcagattgttttcttgcactgggatcaagctgaaagtattaacaatcaaaatacttagaattttgttgatgagttaatgctaattatttctcaatctctaccacttttgggcatgagccaccatgcccggccaaaactccattttaaaagcccaatttttcacttccatttgcttcagtgtttttcatctgttaaatggagttaataacaacacctgctacatctacctctggtgattgtttttagatatgtgatgaagggctggatgcagtggctcacacctgtaattccaacaatttgggaggctgaggtgggaggatcacttgagcccaggagtaagaccatcctgggcaacacacaccgcatctctactaaaaattaaaaaaaaaaaattagcccttcatggtagcacacgattgtagtcccagctggtagggaggttgaggcaggaggatcacttgtgtgttcgctttcctagctagttgctgtggaaggagaatgctttcttcatggcctcatctgtcatttcgtgtccctctgaagaaaactagtttccactgtgtaacaggcaggcatgaaactatctaaagcacagttcagtcctaaaaggtctgagagaaccgaatgatgtactaggtgaagcagtgcattgtgggaatcacaaagcaaacagtactccagaaagacaaatatcagaagcttccccttccattttttttctttttttttttttgagacagtgtcttactctgttgcccaggctagagcgcagtggtgatcacagctcactgcagccttaagctcctgggctcaagcaattctcccatctcagcctcctgagtagctgggactacaagtatgcaccaccatgcctggctaactttttgaatttctatagtaatgggatctcactatgttgcccaggctggtctcgaactcctggcctcaagcaattgtcccacctcgacctcccaaagtgctgagattacaggtgtgagccacctcacctcggcccccttctccatatgcctccagaaacatgtccctggagagtagcctgctcccacactgtcactggctgtcatggggccaataaaatctcctgcgattgtgtatctcagacatttctgtgtctttcatcctcaccctgggaccctaaaggcagagggcccgagtgtcagtaactctggtcctcccctaaagagaaacggagatggtggctcatctaggaagtggaggagcagggggttcctggttctcaggccacgtgtgatctctgcccacccagggcctgccccagcctgcaggtattgctgtgtggtgggaatacccgcttcccttgtgcatagcctttgagaggggatcgtggcctcagcttcacgggttcctggccagggccaagcgctccttctgcagaggcctgcatgcatcctacccctttgacttgtatttccgtggcttcccctccccacctgccccccagccctccctgactggccagcccctcagtagtcctcctcggccagggagagcagcacggccttgggtgtgttcttgaaaagggttgcccagctctgctgctgctccttcctcacccaggggccatagattcagaaagcgtaggcgtcgatgagccggcgcagaggctggagggtgtaggggtgggtctcggatgacgatctcccgggtcaccgggttcacccggtggtactggtagtagctccgcactgaagccaccacagtcagagcgatcacctgaaggccacgcggagaagctgggctgcagcccccgccctgccaggccctgcccctccagcacaggactctctgggctcatttgccacgaagccttcagtggcttctgcggggccctcctagtgtcccccacttcccacttggccagcatcctcagggacggagccagtgggctgacacctgccatctctgaagccatcacagggcggctgggaggggaggggtgggtactctggaaacccgcggggtataaggacccctgggggaggagacggcttagaggtttgcacttggggagctggcggcaactgccacagggtctgggtcaggaggcttcgtaccttgaacttcccccgggggctgaagtgccgcacttcctccaccacgtactgcaggaagaatgggtgtgccaaggcctcttccgctgtgcagcagctctggggttgcaccaacaggaatcgggagacctgggagggaaggagagggtacccgagaaacttaaggcaggtcccctccagcatgtcaggagaggcggggcctccctgggcaagggagcctggcatcgcagccctgagcccaggagccagtcggccttctctctcaccaggtccttcatggtgtctgagtaatcatcctactcaggcgacccaaactggtagatgctgctcatgatcatcctcagcatcagcatctgcttctggtgccagaagggtggggagccagccagcagcatgtacatgatgacgcccgtgctccacctggacgtgagagggcccagggccacttacccagtgccaggggcaccgacccagccctgcctgcttcctccctcgcccagcccaggcgggtgatcctcctcctggcgcactcacatgtcccctccttccgtagcccggatggtcctcattcatggagcactccatgatctcagggccaggtaactgggggttctgcagacctctgcaggaacagtcatcatcaggacaggtcagcagggcgctcagaagaggaagtccaggacaggcgcagtggctcatgtttataatcccagcactttgggaggccgaggcaggcagatcacctgaggccgggagttagagaccagcctggccaacatggcaaaaccccatatctactaaaaatacagaaattagctgggtgtggtggcacatgcctgtagtcccagctactcaggaggctgaggtaggagaatcgctggaacctgggaggtggaggttgcagggagccgagatcaccccacgacactccagcctgggtgacagagtgagactccgtctcaaaaaacaaaacaaagcaaaaagtggagtcagctgaaatacattttcaagtgtaatttttttttaaagttgatgagatccttcttaataatatatgcctcatattaatggcaggtgtttttaatatagttgcttctgatctcctgagcacacccagtgtcagtgactaccctgaaacagcataccaaatgtgtgtttgtgtttgccagtattcttccggtgaaagggtccaaagcttttgctagattttcaaggagtctataattcccactgtcccctaacaccccaaaaatcttttttaggctccagaaaagaaaaaatctaaaaatgatttttaattgctaacctttagtaactgaatatgtgtatttaagcaacttaatattattcaacaatataactgtgattgtaaatacattaaattagaaatcagagagaattaaatatctattcctacttacataactcatctataaaatgtttattttactttatccttgggaaggagcaggtaattttgccacctaaattattatttaaataactctagggggaaaataagagactgcagggaaaacatgcaatgatgtttcaaaatcttcttttaggctgggcacagtggctcacacctgtaatcccagcactttgggaggccgaggcaggcagatcacaagatcaggagttcgaaaccagcttggccaacatggtgaaaccccgtctctactaaaaatacaaaaattagctgggcatggtggtgcaagcctgtaatcccagctacttggtaggctgaggcaggagaattgcttgaacccaggaggcagaggttgcagtgagccaatattgtatcactgaactccagcctgggtgacagagcaggactccatctcaaagaaaaagaaaaaaatcttcttttaaattcaaaatttaaatattaaaaatccctgtatagtaaaaactgctatgtctttggaaaaacaatcccccgccttacatgccttcaactgtatcaaatctaaaggaacaaaaattagtgatttagcgcatttaaagtaaagcatgctaaaagcttcaattaaaagcaaatgcatagctttcacaattaaattactaaggtatgtgccctaaataaaaaaaaaattacagtaaaatttgctaaagctaatttatttcccaaattactttcataatcattacactaaatcactatgaaaataaatatgctgtgcgattgtcttctgaaagtctgttcaaagttctaaacctgctaaatgtgtgtactttctaaaagaaatctgcaatatctaacagctaagatactgtaagattttagccttgtaaaaataatctgaccaaatatactcaaataccgtgaaaaaatgttcattcatgcatatttaaaatgaattttttgaagtctctcaccagtaaaaattatctttcaaatttttaacttttaaactaacacctcacttctagtcatcttgattaatttttaaaaaatcaaaacaaacaattgtgcttacaatatagaaaatgtagggagatcactttttgtcttcacatttactattttgttccaagtaaaaccttttattaaatggctggaaaaaccatttcagttatatcattgtctgcctgctttttaataggaaactcttacccacacacatatagtagtaaagcttacaaacctaccagcgaaattaaaaacccagacaaagtaatggaaaaagcctagtaaaacaagaaaaagaaaatggtaacaacataacctgaatatgaaactaaatccccaaagatttagctccttctagggttgtctttataaggttaaaattcttgcaagccacaccccttcatgtgaccaataaaattagagccaccacagaaggatgacctagtcaagttctactttgctgcattacacatgacccacatttggagtgtaataaaagacaatcatgtttcatttaaattatgtgtggtggtctttcctaaagaacacagtaagcaagtagatttacatacttttgctccagtggttagtaggtcactacgtgcaaaattttccaaaggaatttcacttaaataatttcaaagatcagcagggtgcggtggctcacgcctgtaatcccagcactttgggaggctgaggtgggtggatcacgaggtcaggagattgagagcatcctggctaacacggtgaaaccccgtctctactaaaaatacaaaaaagtagctgggtgaggtggtgggcgcctgtagtcccaactgctcgggaggctgaggcaggaaaatggcatgaacctgggaggcggaggttgcagtgagccaagattgctccactgcactccagcctgggtgacagagcaagactccatctcaaaaaaaaaaaaaaaaatttcaaagatcaataaaaatttccaaaaattttgagtaataatggttgccaacatcttgttttgccaagtaagagtattaaaaccaaacataaacaaaactccaactactatcattataatttcatgaaaggacacttgaataaagagtaaaagatacatctgagtaagtttaattttttaaaacaacttgaaattttcagaaaattgtctttatttctatttagatcaatgaaaactcttgtcatgtatcaagaattctgaggatctacctttgaaacttgtatttttagtcattcacttataaagttttcccaagatgactgatggagaaggctataaagaagagaaaaataaattaacataaaggaaagagagactagggtttgccccaacttggagcaaggtatctattgtcacaattggtaccaatgatagacatcagttctgaaaaagagtcaccaatcaaatgtgactttaagtaaagggtacaaggaagatcaaggaaaaaggaggcagataaaacttcaagaaggacatttagcaaacagaataaaaaagagatggccctcctcttattggggatcacttcctttaagagatcagcaatctggatatgaccaactcttctcccctttcctttacaaacccttgctgaattttctttgatttcagaggttaccatttctgtggcttccaaccacccactaacctccatacagggatgcaagatacattctctaaggatataagaagcacttagatggctccatactttctttgtcagaaacaggtaattactggatagctgctaagaatagcatccacttctccagatctaaccttgagacgaattatagctgactggacaagttcagctagtcttcagatttaaaccacacaatctaattcttcagatttaaaccacacaatctaattcttgttttaagtccctctaaaatagaattgttctaggactcttgacataaaagaaaggcacattttcagacatctacacttatatttttaattttaattttaattttttatcttgtttattatactttaacttctagggtacatgtgcacaacgtgcaggtttgttacatatgtatacatgtgccatgttggtgtgctgtacccattaactcgtcatttaacattaggtatatctcctaatgctatccctcccccctccccccaccccacaacaggccccggtgtgtgatgttccccttcctgtgtccatgttttctcattgttcaattcccacctatgagtgagaatatgcggtgtttggttttttatttcatgtttcaatagactctacagtttgcccaaaactacctcagaaaatttagatataagataaattgatctacagtcatgcattgcttaaaaattgaggcacattctgagaaattcatgtgtcattgtgggaacaacacagagtgtacttacacaaccctagatagtataacctactacacacttaggctctatggtatgacatcataatattatgggaatttgtcgtatatgcagtcagtcattgactgaaacatcgttatatggcacatgaatgtattttactattcaatatctaacatctttaaaaccaaagtgtggcttatattttaaaaccaaagtgtgattagcactttgtgaagcatacattgccaaagatcaatttaagtataaattttcaataggttcaccttccatgccaaaattcttgcaactctcaacccctcgtcactaccactgtcaaagaatatattgttatggagagtcacatgagagcaatacagaaagaacattaaaagaagcctaaactcacacctgcttacttcacttatttaaacattagtctttcttttcagttattcatggatatgtactgagctatgaggaaaagcaccttactctgctaaagcaccataagttgttaatgatttttaaagaaaaatttaacaaaaatattctttgaaattgctaacattttcaagacaatgtaagatacaaccaatagataaaacttctaagtgatttctttcagattcagtatgtgttattcaatgaagtagtaacaatctaatttatcaaatcatatcaaatatctattccaattacagacattccccagttggttttatcttctgaaatgtttattttcctacttattattaacataaaatattatgctagctcctggagcaatttgcgttttagcaatgcaaacattttttatatttgcataggcaaagtatggtcatgattcctctctttaagagatatatttccagtagaattctatttgtgttttcacctgggatatagtttgactcacgtatccacacagtagaattttgtatatgcagaaaaaaacttcatgatactgtaaagtttacaatttttctctgaattatcttacctgcatccaacagcactactttaaaaagccttatatggccaagcacagtggctcacgcctgtaatcccagcactttggaaggccgaggcaggcggaccacgaggtcagcagatcgagaccatcctggctaacatggtgaaacccgtctccactaaacaaaatacaaaaaattagctgggcgtgatggcaggcgcctgtattcccagctattcgggaggctgagcacaggagaatggcatgaacccggaggtggagcttgcagtgagctgagatcgcaccactgcactccagcctgggcgacagagtgagactccgtctcaaaagaaaaaaaaaagccttatatttgagacacggggacaaataaacaattccttatatctacaacataacaaacattttaaaaatatattgaataagtacatatatttaacaaaaaatatgtactggtagtattttaacataaaaattatcagtagctttgtgtatgtgtttcttttaatgagttaaaaagttcatcgttactgataatgagtttaaagtgaattaagattttatgaacaatattcactatgatggatgcttacattttttgccaaagttgctcaataaagattttgctcaaaagagataaaaagccttccttttgttcacatattgaggcttacctcaaacagaatcttgtattttaaatatttaagaagggacatttttctattccattataaggcatgttaaccactatggaaaacactatagctactttcagaacttgtctttcgtatacatgtagttgatcctttaggattttcgtctaatggtagataacacctagctacaaatgcccattatttaaaatggttttgtaatacagatacgcactgcataatgacatttcagtcaacaagggactgcatatatgatggtggcccctaggaactgaaaaattcctgctgcccggtagcatcttgatgatcttgaccctgagtaggcctaggctaatgtgtaagtttatgtctttatttttaacaaaaaaaaagtttgaagtgaaaaaagaaagaacttttaaaatagaaaaaagcttatagaataaagattataaagataatatttttgtacatctgttcaatgtgtttctgttttaagctaagtgttactacaaaagaatcaaaaagttttttaaaatttaagttactataaaagttacagcaaaataagattattaaagacaaatttaaaaaataaatttagtatagcccaagtgtacagtgttaataaagtccacagtagtgtacagtaatgtcctaggccttcacattcactcaccactcactcactgactcatccagagcaacttcctgtcctgcaagctccattcacaacaagtgccctatacacatatcccatttttaatcttttatactgtattttactgcaccttttctatgtttagatacacaaatacttaacattatgttacaactgtctatgacattcagtacagtaacacgctatataggtttatagcctacaagcaatagctagagcacataacctaggtgtgtagaaggctctaccatctaggtttgtgtaggtacactctatgatgtttacagaatgacgaaatagcccaatgacacatttctcagaatatccccattgttaagtgacatatggtgtaattatgatcttcagtaatgacaaattttttaaaaggagggcacagacatggttaccagcttcctcacacatctcttttttcgacccccacataaaaacaccacagcttgagatacaagctcaataggacaaagctacacaattcgtagtcacttacaccactctaacaaccaaaagaagaaaccaaaactccagctaatttactccctggaataggattagagaaggtaagcaagaataaattcatctacatattccttttattaaagcctgtcctttgtttccacacaatctgtaagtgaaaactccatcaaaatggttcattcaaaaaagtgtctactattaacaaagcataacaatatacatttatgctgttgtgcatagagaacattatccaaattttctactgaggagccaggagaaatttaatgaaaatgaaacaatatgattattgactacagaaagaataccttttttggagaaaaaatatatacttacttagtcagctgccctttattcttgttgttatcaactccattgtaagtcacagctgccagttttctgcttccatagttctcgcagtggacattgttagtaacatctttcaagtcctgcatgtgtgttctgtcataaataaacagcaagagtttgcttctgttaatagctagggggcataaagctaaaaaagctttaatataaattcaaaattttaccaaaacaaaaatttcagatttaaaattaacaaaagactattgttaaggaaggtagcattcatctgttttcatttacactcaaagtagaccaataaaaaataagctaacttgacaccaaatttagattccatagagattttaagacccatagcaaggacttcatgactaaaacaccgaaagcagtggcaacaaaagccaaaattgacaaatgggatctaattaaactaaagagcttctgcacagcaaaagaaactaccatcagagtgaacaggcaacctacagaatgggagaaaatttttgcaatctacccacctgacaaaaggctaatatccagaatctacaaagaactcaaacaaatttacaagaaaaagcaaacaactccatcaaaaagtaggcaaaggatatgaacagacacttttcaaaagaagacacctatgcagccaacagacacatgaaaaaatgctcatcatcactggtcatcagggaaatgcaaatgaaaaccacaatgagataccatctcacaccagttagaatggcaatcattgaagtcaggaaacagcagatgctagagggggtgtggagaaataggaacacttttacactgttggtgggagtgtaaattagttcaaccattgtggaagtcagtgtggtgattcctcaaggatctagaactagaaataccatttgacctagccatcccattactgggtatatacccaaaggattataaatcatgctactataaatcatgcacacgtatgtttattgtggcactattcacaatagcaaagatggaaccaaccaaaatgtccaccaatgatagactggattaagaaaatgtggcacatatacaccatgaaatactatgcagccataaaaaaggatgagttcatgtcctttgtagggacatggatgaagctggaaaccatcattctcagcaaactatcacaaggacagaaaaccaaacactgtatattctcactcataggtgagaattgaacaatgagatcacttggacacaaggcggggaacgtcacacacgggggcctgacaagaggtggagggctggggaagggatagcattaggagaaatacctaatgtaaatgatgagttgatgggtgcagcaaaccaacatggcacatgtatacctatgtatcaaacctgcacgttgtgcacatgtaccctagaactcaaaagtataataaaaaaaaagaaaagaaaaagaaaagagaaagagaaatgggcataggagggaagactttcttctagggcatttgagattgtcaagcccagatgacaggcaccacctttccaccttatgcctcattaatggaaacaacacaaagcccagatctaaggcagagcttcccaactatgggcctgcatctcaatcttcaccttccaggaaccaggcagtgtcttctgggctgattacttccagtttacctcattgtgatgtccaaatattatagctcccctctccatgatgatcatggaaaatatcagtggctccaaattccaattgtttcaccttagaaaacaaatctgagaatccccctaccaccaagcacagtacctggatacaacaggcactcaataaatatttgctcagccaatgcaaggataaatgaatgaaattcctcatccctgtattcatttctgaatacgtgctggtgaaaatctagctctaaacatctttcagatttagtacattgaggtatgaaaaagaaaaaataaaaggacgatgcaaacgaagtcaggagctggcacagaaagtgcaatcagattctgcttcccctgtaattaagagtgcccaatgccgctgacttaggcgatgacagcgtgcagcttgcctgcccgccctgggcgcctgggagggcgggcagccctcaggatgccgctgcacaacacgttcgccaccttatcaagaattccacagccacaggaagatttttcaccccgccataacccccgcgggctgccctgtgctgtcacatgtccccgctgctcagagagagaaagccactagggaggccctcaatggaaatattaccccctatccaggctagcatgggcttgatcgcccctgattatttctgatcactgtcactgggccaagagcacagcgaagtcaagaaagaaatggccttattagtgagaacgcagcggtatgggtaggcagtggcgtggaggacctgcttttgtgagggcagtgaagagaggggaaggagtggtgtctttatattgagatattttgagattcctgctttctccactcacttcaactgcccaaataggttctgcaggttccggaaggttctagaacttgtacaggaccgaacctacagcttctcatggaacaaacccagaaccaagaaaatctggcggaaatcaccttgtttaactcctttgaggtctagaccagaaattaaatagtgcttaatctgttactttaaagaagcctagttctaactttacctcagctcgctccctcttttgcctaggataggaagggtgggtgcaaatggtcagctccctgtaggtcagcctcttggagccctaagtttcctgccacttctatgcactatgggctttgcccagggtgggatcctcagcccagggaccttgtttgtcctccgcctcttgatgctggtgcctgctgcccagccacataccctcagattcatttttaaagaaacgtcaacagctgttaaatggcaaatgagcctttcaaagaggtgggatgactttgaaaaagggcttgaggacagcagtcgacctctgaccgtctcccctcagatgccctctccatcccacgctctctccctgtccccgacctctgctttcccagcgagcctgcctgctcttcaacgctcctccctgcccgcttgtgctgtctcaacacctcccatgttgcttggttcctaaaataacatagaggaaaacttttttttttttttttttgagacggagtctccctctgtcgccaggctggagtgcagtggtgcaatctcggctccttgcaacctccgccacctgggttcaagtgattctcctgcctcggcctcctgagtagctgggactacaggcgtgtgtcaccacacctggctactttttgtattttttttttttgagacggagtctggctctgtcgcccagcctggagtgcagtggaatgatctctgctcactgcaagctcagcctcagggttcatgccattctcctgcctcagcctcctgagtagctgggactacaggcgcccgccaccacgccctgctaattttttgtatttttagtagagacggggtttcaccgtgttagccaggaccttgaccatctcttgaccttgtgatccacccgcctcggcctcccaaagtgctgggattacaggcgtgagccactgcgcccggccaaaaatatttttttaaataaagaaaataaatcctcggctgggtgcggtggctcacgcctgtaatcccagcactttgggaggtggaagcgggcagatcacaaggtcaggagatcgagaccatcctggctaacacggtgaaaccccgtctctactaaagataaaaaaattagcctggcgtggcggcatgcgcctgtagtcccagctgctggggaggctgaggcaggagaatggtgtgaacccgggaggcggagcttgcagtgagccgagattgtgccactgcgctccagcctgggcaaccgagcaagactctgtttcaaaaaaaataaaaccccataaatctcccaaagcagttactgaaggatgacctttctatgaaagagtgttctttatattatctatttaaatactagacaagaaactgtagattagctactactgaagctcataaaatctaaaagaaactgccttttagcaatattactaaggtaatatgtgagtttttattaatacataataatatatttcagatcacatatcaagttgttttcaaactagggaattttagaataaatttctgtttcttcgaattgtctaggtgaatgtggtattttggttaaacaaatttttgtttatagcatttctatcatatataaaatcagtacatatgagataaatccacaatacatatgggatgatgtcatcattatttaataattcaagacactgaagataccctcagctgctctatggatatcctttaccaatgcagtgttcttggatatacgtggggtggcaatactctgtattgtcagtcctccctcttttcatcatgtattctatttcaaacttcctatatctgccatcattcatcttcaccacgttactaaaactcccttctgggagacaaacataaaggtgtattgttggctgggtgtggtggctcacgcctgtaatcccagcactttgggatgccaaggcatgtggattacatgagctgaggagtttgagaccagcatggccaacatggtggaaccccatctctactaaaaatacaaaaatcagccaggtgtggtggtgggcacctgtaatcccagctgcttgggaggctgaggcaggagaattgcttgaacccaggaggtggaggttgcagtaagccaagatcgtgcactgcactccagcctgggtacaagagtgagactccatctcaaaaaaaaagtgtatcattgtacatttttatcattccttacatccagaaaacccttactgttactttacaatccagcttcttgaatctccccctttgtgaataaaatgtgatattcaattactctgattcatatcgtactgacatttgcatgcaactctctgatagttcactccccttagtcctaagtctgggttttccaaaaatctcatctcccagactctgtcccttgataaattcatgttctcttatagccacaacagttacttctaaagctctaccactccacttcgggcacgtcaggcaaaataaataagcaggtgggatcaagattttacagcacaattttgcaggtaattttaaatctcaagccctatgaaggttacccaaaaaatcctataatagagaggaacattaaaaaggagaaataagatattcacttcgcaaaattactcctttgggattctagttactaaactccatcttgcagtttgatatgtatgagttactgcccagaatatacagacagtccttccatcctgtgcactgggatgatcacttccacttcttcaaatccagctaaaagcatcactgcctccatgaagcctactccagccagaattgttcacttgcctcctctctgctcatgtcctatatattacacaagcagaggtcaccaacagtatttttcatcaacagtttagagcagtgctgccaaataaaaataccatgtcaatcatacaagtaatttaaaattttcttagtagccacttttaaaataggaaaaaggtgaaattaatcaattttatttaacctgatacatccaaaacatgatcactacagtatacgatcaatataaaaaattatggagatttttttccatgctcagtcttagaaatcggtggtatattttatatttgcagaacatcacaattcagactacccacatttcaaagattaatagccgtatgtggctacaggctgctgtactatttaataaaaagtgcatatctagagtctagccctttgctctataaagtgtgatctaccatccagcagcatcagcatcacctgggatcttgttagaaatgtagaaacacagcccatctcagaactactagaagaactaaatttaacaggatgcccaggattggaatgcatagcaaagactgagaagcagtaaattagatcacatataccttgggagtcttacagaattgctattgctattcaactatgatatggcattaccccactgactaatatagaacactgtatttaaataacaatagcttttctatgaatcatgttttctctacactgtccaatgcaattttctgaaatgatgaaaatcttcgtatatgtgctgcacaaaatggcagccacttgccacatgtggctgttgagcacttgaaatgtatctggagcaaaagagaaattgcatttttaatttaattcatttaactgatgtaaacatttggcaaatgactatcatactagatagtacaactccaggagaattggttactatgtcacagtttcatctctaggagagtccttaggacaaatttggaaagttctagtcaagataattcttctgattaactgtacttcttttttttaatgttatgaagtcatatttaccatcttacactggctaagggcaaatttgcatcttacctctaaggaaggataataaaagttacaacatgtgctttgtatgtattaatattattccagcttatcatcaattaacaatactaatatccatacctgtacagtctttttagttctatgagaaggacctgggtactctggagaatacaaatctgtgaggaataatgagttgattaatgtcgactttcccaatccagattcccctaaaagaaataagggaaaatatctgttaaactcacccattttacccaaccttaaatattcaacagatgctataatccaacttgctttatgcaagtacttcttggtgagacaatgaaatgacattagaaaatatgctacaaagagtatcttgtcctcagtttcttagctatcaaattagactcatgtttccaaggattcttttcagccttctaattatacttatattcattaaaagtaatgtatctaataatttacatttttaacagtaatgtgttcccaaggaaaaacttcagtcatttaaaaaaaaatccaagttggattatgtatcactgcttcagtgaaataaagtttttctttattaatagacaataatggatgaccaaaagaaatcatgcagctacaaaaagcaaaaatctgctaatacaaagaataattaatcacaatgaacatctccacataaaattctaaatcacaaaaaatactttctaatttagccacccatcagcctaaacataagggtgcttctccataaaccagaatccaaaaaaatcttaggtaattactttttctaccacttctactcgaggtagacaggaaggaagctacggcatgatttccactctgatcacatactcttttttgactctccatgtctagtccaatatacatagtctagtgtatagtaactattacaagtataccaaaatataaatggcttcaaggtatatataacctaaggttaaaacaaattagaattcatattatgataattaacatggcacagagttaaagtatttactgttaaaaattcacttagaataataggcatgtttagcctaagtaaccgatggcacaatacttatatgtctaggaggaattctttttatattagctttcaaaagagataataagatcctttccacatggtttgggcttacccctttgacttagagcatgccactttttactagatgtaaaaatgccataaaggtctaagtcacaggaaagtaacacgggttggccacacctgattctttcttaactcttacaccttgaaggcagaaagactagaataaaacccaagcatttggatgttaccagaaatatctataatatttccttttggaaacataaatgaaaattttagtacatacaacgttttgggaaattaaaaacaaaagtatgctaattaaaatattaacactgtactcaataaatcatgtttagagggctttttttcagttttttccctttttatttgtggtgaggagtgggggaacaagacgatgcaggacaaagggaaaagagagaggaagaaaaataaaagtctgaaaggtaacacagtaaaatgtaaaatggtggctactctggggttagtacaatgagggtgagatttttttcttagtttgttatacttctgggggctgcaaacttccttcaacatgattctattattttcataagttaaaaagcattattgagtggcatcagcaaaacggcaaattaaaaagctcgaagactcattccctcacagaaaccccaaaaacaaccagaaactagttgaattaaccttacaggacctgtgaaaaacagtcaaatgtctatagcaacaaagcaaatgcccaattgagaaaaaaaaaaacatgtaaaacttttgtgacatttttctgtgatcttgtcccaccccttctgcagtttatctgggtctggaggaggcagcaaaccaactcccatttcattcccttcaaatgggcgggaagagtgcagaccaaactcgtaacattttaccctctctggtcggccagaaggactgattcctgtttacctaactggcacctcatccggtaagagaagcaatgggcgccatttaagaaagctgcaaggctacacaatatgtttacactataaggaactagaaaaagaagagcaaactaaactcaaagctagaaaaacaagaaaaaaataaagattagagcagagataaatagaagagatttttaagagtagaaatcgggccgagcatggcgactcacgcctgtaatcccagcattttgggaggctgagaagggtggatcacctgaggtcaggagttcaagaccagcctgaccaacatggtgaaaccctgtctctactaaaaatacaaaattagctgggtgtggtggtgcgtgcctgtaatctcagctacttgggaggctaaggcagaagaatcgcttgagcccaggaggcggaggttgcagtgagccgagatcgcgtcactgcactccagcctgggcaacaagagtaaaactctgtctcaaaaaaaaagaaagaaagaaaaagaaaagaatagaaatcagccgggctcagtggctcatgcctgtaatcccagtacttcgggaggctgagatgggcagatcacggggtcaggagattgagaccatcctgcccaacatggtgaaaccccgtctctactaaaaatacaaaaattagctgggcgtggcggcacgtgcctataatcccagctactcgggaggctgaggcaggagaattgcttgaaccagggaggcggaggttgcagtgagccgggatcgcgccactgcacgcactccagcctggcgacagggctagactccgtctcaaaacaaacaaacaaacaaacaaaatagaaatcaacaaaaccaattgttcttaaaaagaataaacgaaattgaccaccgataaactagattcagaataaaagagagactcaaattactaaaatcagaaataaaagtgggggctgggcatggtggctgacgcctgtaatcttagaattttgggaggccgaggtggggggatcttttcagctcaggagttcaagaccggcctgggcaacgtggcaaaaccctgtctctactaaaaatacaaaaaaaattacccggtcgtggtggcacatgtctgtaatcccagctactcaggaggctgaagcaagaaaattgcttgaacccgggcggcggaggctgcagtgagccgagatcgcaccactgcactccagcctgggtgacagaaagagactctgtctcaaaaaaaagaaataaaagtggttcatgattttcctagttaaggactggactgtttgccaccaccccaccccccgcttttttgagtaacttccccttttggaaacagtgatgaaggtttctccctttattctaaacagtgtgtgtaccttgtagtactatctgccatcaaatttctaaatgctttctgcttttttaatactctttaaaaattagcaaatacatagttatactttcagttaagattatattttttcccactggattttttctttatcttttaaattcttaacattgactatgtgaagtaatacgctgtataccctgaactcagctatgaggtatttaacatatcatgggatatataaataaattaacttccatcaattcctagactacttacactgaaattatggaccaaagctttctaattcaattcccaagtggtattaaaaccaaactgtattgtatttcaagaaattttatccacggttacaaaagtttaaaaacttatcaaacaagtgggaaaactgcaatttaaagataaatgattaggtttcctatttttttaagaccaactacaatgtgaaccataactacactaactgggtgttctctatcaaagtcaacactgcaaacaacaaagggtatcatctggccaagaaaaagataatttctgattccaattcaacacagctcctgtgtaacaggtgtttctctagttctcagctccacatttatgcttgagttatttctatgctagttgtagttttctttttaagttgcctctgggcaaagtaaacctttcataacagattgagaactgttccatttcctcaactttaagatacaattttgccccccaatatttctaaaaacaaatgtctcataatcaaaatgtaattgactgtactatttaacctccctcaaatcaaatttgattatatgtttcagagtagatcttatcttagaatcaaggaagcaggaaaatcaaagcatttcttcccctagaattgaattcaattagaaaagccaaatcaataagaccttaattattttgtcctataattgagaactttatatttaattcttagaacaatttattctgaactaaagggatttctatttccttctaaattggaagacccaaagaaacagaagcctttaacacaaacttggatgagaaataaggaaagtaaccaagaccatctcccaccttgaggctcatgaggtgaaacaaaagctcccgcttgagagagttatatgccacaggggaaatgaccctcaaagagacaagtttcattcagagtaaggaggcaggaaaaatgggtaccaaaaagtagttgaaaactcagtctgctttttctggttctgtacataaggagcttggaagttgccactccattctaagaagtaaaaaactgaacagatctcatctttaagagcagtatccaatctttaagagcagtgaggacacaaggcaatgatccagcaattgctcttcttgatgtttacccagctaagttaaaaacttagatccacagaaagtcttgcacacaggtatttgcagcagctttatttatatttgccaagatgtgggagcaatcacaatgtccttcagtagtcgaatggataaatacactgtggtacatccaggaaatggaatatcactcagcaccaaaaagaaattagctaacaagccatgaaaagacatgaaccaatgtatactggtaagtgaaagaagccagtccagaaagaatacatactgtataattccgttattataattccataattatagtgagcaagatacttgcatttttggttttcttacatatcgaattagtataagagtatgaactatgaggaataaattagataatatatgtgaaatctaagcacagtgcctggtacacattaagtgctcaataagtagttgcattatttctgtgattcatttaaggaaattagaaagacttgaaagtttgatatgacagaagcaagaatataaataacaaaatttttaaaaacacttaaggcaaaaacttggaaacaatgggaagttagcaaattccacgttaaaagactaataggtcttttggatatggacaaatcaagtgcttaaaaagtaaaatgattgaaataatatgcttaattgtcaaatatatacacagaaatttctacccagagaataaacatatttttgaaacctatggaatacttcaataagctgatcctatgtaaggctacacagaaaaataaatcaatactggaacctacagatcatattttctgaaggtagtgaaattaaaaattaacaaaaaataatgtaatccatctgcctacttacatatctctctaactcttcttatttgaaaattactcaaatacaaacaaaatgagtattacacataaaaaactaagatatgtgactaaagtattcagagaaaaacccatgcttaaaataagcctaaagaaaataactcgaccatcagtgtggttcttggtgaaactgtaaactggtacagcttttctgaagaataatttggtaatctatcaaaatttaaatctacatgccttttgacccagggtttcactttcagaaatgtatattacagaagcatttatatgtatgcctagaaatccaaggaacctaagcactgtttgtaactataagcatccatcttcattaatagctgactgtataaatcatgataaagatattttagaataccacataattgcaaagaatatgcagacaggaatatatgtacagtatattcagtgacagggaaaaacagtcacagaacagtacttatagcacggcactgtttacacacacaaaaattgacatgggaatgcctggcgtatataaaagtataaaaaaaatggcaaaagacttgcaccagtttaatgcttatctctagagacaggactggaaatgaaggcaggagaaaaaaggaaactcaccttttactaaatgtctttagaatttagtttcttaaaaataaaaatgtatattgtataaacttttctttctttgggaggctgaggggagggtaataataaaagggaatataccaagtttctaatagtgtttatttctagatggaaaaggtagtgaaacatttaaattttctttctttgtatatcagtttttctacaagaaccataaattatataatatttaatttttacttttaactctttaaaggggttgataatatgttatactacaaagaggtcaagaagaatgcctgagaacaggctacctgcaaatataatgattgggagtactgggataagagttaagagaaaaatgagtattgagtccagtaagatactacagagcaaatgaaagggaagcatcaggcgcaggttactgcagatgctgaccactacagatccagacagctgtactgcaggaattctcaatcttggcactactgacattttgggttggacaattctttattgtgaggagtgtcttgttcgttgaaggacgcttggcagcatccctggccttcacccattagatgccagttagcctccctcctccccagctgtgacaaccaaaaatgcttccagacattgacaaatttcccctggggagcatttttcaaattttgaatccccaaatcatctagcactgataccactatgcatggaaaataatgacagtgacagccagtaagttgtaaattattctgtgtgccagtattttacaagcattgacttagtcaacctttataatcccatgagattgatactacaggttgtgtatcacttatccaaaatgcttgggaccagaagcgttttggatttggctttttcaaattttagaatatttgcattgctcatcagttcagcatccctaatctgaaaatccaaaatccaaaaattggttcaatgagcatttcctttgagtatgatgtcagcattcaaagtttcaaacttcggagtatttgagatttcagatttttggattagggatattcaatctgtatcattattgttaccatttggaaacaaaatgaaataacttgctggtgccaaatagttaataaggggtaatgtcagtatttgacactaggcagcatgttctactgcctttctaaatacccactctcatttatccattaaagactctgtccccacattcccaagtacctccctaatctggttaaccaggttggaccatatctgacatgggatattttaccagtatcttcattaacaataatacttaatatttttattcaataactataagaaagacactgagctgggcactttacatgcattcaatgactgcaataattacaaaactctgcataagactctttacacaattttacagataagtaagcaaacaaaacctctgagaagtaacttgccaatgacaaatatctctaccaagtagcagagctacagctcaatctgaatggcaaatctcatgtccttaatcatactatacttcccagactctgagcagatgaaaggaacatgcttcttgacctctttgtcctgacccacttagtcttttttttttttttttttttgagaagggtctcactctgtcgcccaggttgaagtaagtggcacaatcacagcttactgcaacttctgcctgctgggctcaagtgatcctcccacctcagcctcccaagtagctgagactacaggtgcatgccaccatgtccagctaatacgtttctaagagatgaggtctcactatgttgtccaggctggtctcaaactcatggattcaagcaatcctcccgcctcagcctcccaaagtgctgggattacatgtgtgagcaccagggccactgcttttactgcactacccacaatgagtttcaaatggaaaagtaaaggataaagcaattcaaaatttagaagaggaagaagagagaaactaagttcaatagcctttaatcttgtcagactgagtacttctacctacccctggtatcaagtcccacatctgtcctgaaactaaatcctaacctctttagcaggctgagaaagagggaaaaaagaaccttttacaagatatgataatagatctatgtcctttcaagaataacactgattcagtgaatattcttctaaagtacagtcaaaacccattgagcaagctcatacagatgagatatttgtaggttattgtattgtcttaatgattctagtgtcataacacagaggttaccaaaatgtcattcaaataagcctgataaaatgcagtttatttcccataagcaaagtcaccttactcaaatcactgtgactgtatgacattgctatgggagctctaaaagcaaactattgtgtaatgagtgagaagtccttttacttggtagcagaggaaaatacagcacctgagaaatatgaaaatagtttggtaatactattcttccctggaaatttttcctaagaagtaccctgaaggtgtaaattaagtgcttccttaagtatcacatacccttaatctatctcattttttttttcaaaagtaccaataattgtgagaaagtagttgtgtaactttgaaaaagtctaggggcaaaggttatagtagtccattagagcttaaaatttccttgaaatctcttatctcagttccatcaataaatttgtcttgtgaccttgggtaaaccataacttctgtgtgtcagcgcccttatctatgaaatgcagataacagcagtacctacaaaaacacagagtggttgtgaggaataagtgatctcattagaatcataccttggcacagtggacacttcaatatcaatcataggtagttgcaatggaatatattttattactattcatgttttctcacagaaaaagaaaggaccctagtgtaactactaagaataagggtcaaaggtgaagtagacagccttaagaagggaataaacatttgaaacagggatgcagggggatggagtagaagagtaaggttggcaatttattgacactaaagggtactggcctcaaaataaataaaaaggaatgttgaaagcagtgaggctctgcctgagtttggacattaatattaatttctactcacatttagtagataatatttacttccatagcaaaatgtcagatggcctataattacaagacaaaatatagcagccttgttctaataacctcaaagtgacttataactacaagtgatcctttctcattggcattactaaagggaggaagtagtgtcattaatgcaaaagaatagagaactataatcagtcctatcaaatcaaactctacttaaacacaaaatctgtggaaacaacccaaatccagtgtacttctgcattattaagaaaacatttaagaataatagagttcagaataatatatatactggcttaagaaaaacctactcaagataaaaagactatctgtaacatttcgtatttcttcaaactaatattttaataaacacaatattttttaatgttccaaattaatgtctattttacatttattttgactttgaaatgcactatacatgttttgcaacaatgtcgttatcattccctcattttactgcagcttaagggtaaataactggattaaaaatttctttgttctcgttaaaacaaaatataatatttacaatttaaggtgttactctatgaaaataatgaaacaagagtaactagagtcagtaatacaacactgtacgttaacctaataagcaggttaaaataacacatgtctttctcatctttgaggtctcactgatgaaagccatgtatttcatcactcttcatgaatgttaaatttcaagcctaacaataaaatattcatcaaatatttgttcataaggttttgaagaaagtcacaataatatctgtttataatagctaatgtcaggtttcttcaggtctttgggattgggctcctacagtatttataataaaaggatctgagaagtcctgctttaaagataattgcttatctttgctttactcagcatctcaactttatatccgtttcttattaatctctagattttctgagactaaaagtagtagtatctgacactttataagtgatcattaaatttttatcaaataaatgaatgaggaatgcaaagatacgatgtagtctttgcccttaaaaagtttagtatggtagaagaagtaagatatgcaaacaaacaacgaacaaataaacaaggcagaactttatcaagaccatgaatgagataccccaaagagaaagaatttcaggaaactgagaaatcacaccagcctggaaaggaggtcacatttcaatgaggctttgaaagatggagtatcatttcaataagcatttcaactttctgggatatctgcagatacaaggggcaacttttaccattttgtagcaattgtatagaaaagaaagcaaaggatttttagaaacagaatctttaagtcctttcagaatgttttaccatgttagggttgaggcaagaggaaagcctcagaggagctggtgataacattgtggagcttttctatcttgttcctctaactccttccttcgtttttctcctgggttttgaaatcaattttgttcaaattcaaatcctagttcaatcacatacaagtatgtgaccttgatcaagatacttactctattaattaaatgcacagggcttgacattttaaaaagcacctcaaatgaaacctattattaagagatgagacaacagcaaactatggttcttaactaaaatacatattagtgtcatcccaggagctacttcaaaatagatgaatattccatccttgacccaaagcccagaatatctaggcaagtgtttccaggaatactttgaagaagcttcccaaaatgatttgaaaggtagataaaattaagaaattcttatgttcatgttgttctctccataaaaagaaaattaagaaattctagtaaataaaggatgacatagggcaacatgccagattacatcaacatttaaaggtggcccataggaaaggatcctaataaagcagcttcaacacaaccaggtaaaccaggaggcagcagcacaaaaagtgagggagagtttcaaggaaaaatggtcaataatgccaaataagttaaagaaaaatacaatcagaatgccttttactgacctttaataaaagtagttttgcattaaggggagaagccaaatggtgataaattaagtactggatgggaaatttaaaagtagaggtttattttttctttgcatctggctataaaatgacgaaaagataccacaccaagatgttttgccaagggagggcgctattctttgttttactttttaataagcttaatctggtgaagatttaatctgtgaagaacaggcgtccccaacccccagtccgtggcctgttaggaaccgggccacacagtaggaggtgagtggtggtgagctttactgctggagctccgcctcctgtcagatcagcggcagcatcagactctcaaaggaatgcaaaccctgctgtgcactgcgcatgtgagggatctaagttgcgtcctccttataagaatctaatgcctcatgatcagtttcatcctgaaaccatccatcacccatcccccgcccccacacacacacccacacacaccctggcagaaaaattgtcttccataaaaccagtccctggtgccaaaaaactgggagctgctggtctagactacattagataccaatcattttcaaggcatcccatacatatattgatctggagtttgctataagacaatttcatctcctcaaaatctattagtatatcctttaacatacacactgatgtacgtgctaacactaaaaggcaagctaaataggctctatataacctggccctgcaattatcttaaaagaagtttacttattctaattactgtaattgcaccagtactaagaactaagtaacaattgtgctgtgtagctagtagcaaacattccaaccagctgctcaataattacctcatttgccaattcaaacagctttcacttgctacatgtcggaggctgggaggcgctaagaggtatgttatgatctttcttgctatactcagaaataaaagcattccttatacaacccagttcaaggggacagcttcgttgttaaatcatgatgttaccagagaaatccttgcagcctactcagaatattttcatcatgatttagaaaatgattatcccaattttgtagtaaaaggtattgcctgacctaggttagggtctgcagcgtttcctaagatatataccaagtttctgtaagttcttttgctaaactgaaaagagttcaaattgacagtttagatactgtctctgagctgtccctcaatgttcctcgaaattcttcccattacctgaaattctaattgatcattcaatacacattcccccttaaaaatcaagtatttttgtgaatactgttagtctttcagatcctggaataagactttccctctaatttctattttgggcaagcattaattaagaaagaaagagttttaatttggaagaaaatagggctagttttgaattacatgaatcagaaaaagtagattttgcagaaacataccaaagggctctctaaaagtagagggcaacttacagctggccatagggcacgctagagcgtaagtaaaggagaaatatcaggaaaatagatattattttacctggatatctaacggatagaagaggggaagcaaggtgttgatttattcttgatcaggtagcatgttctatagagtggttctaagaagtggctttcaaagcagaagtgggtaggttttaactgtttgaattagataacctatagattcttttaagttcttactttctttaaatctcatataccaaaatatatcccctaaggaccaggggtgaactatatgaatcatgccagtgattatgtgaattatatctcactgatatttctttttttattattattatactttaagttttagggtacatgtgcacaacgtgcaggttagttacatatgtatacatgtgccatgttggtgtgctgcacccattaactcgtcattaacattaggtatatctcctaatgctatccctcccccgaccccacaacaggccccagtgtgtgatgttccccttcctgtgtccatgtgttctcattgttcaattcccacctatgagtgagaatatgcggtgtttggttttttgtccttgcgatagtttgctgagaatgatggtttcaagcttcatccatgtccctacaaagggcatgaactcatcattttttatggctgcatagtattccatggtgtatatgtgtcacattttcttaatcctgtctatcattgttggacatttggcttggttccaagtctttgttattgtgaatagtgccgcaataaacatgtgtgcatgtgtctttatagcagcatgatttataatcctttgggtatatacccagtaatgggatggcagggtcaaatggtatttctagttctagatccctgaggaatcatcacactgactttcacaatggttgaactagtttacagtcccaccaacagtgtaaaagtgttcctgtttctccacatcctctctagcacctgttgtttcctgactttttaaggactgccattctaactggtgtgaggtggtatctcattgtggttttgatttgcatttctctgatggccagtgatgacgaacattttttcatgtgtctgttggctgcataaatatcttcttttcagaagtgtctgttcatatccttcacccagttgttgatggggttgtatgtttttttcttgtaaatttgtttgagttcattgtagattctggatattagccctttgtcagatgagtagattgcaaaaattttctcctgttctgtaggttgcctgttcactctgatggtagtttcttttgctttgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtttaaggaagggatccagtttcagctttctacctatggctagccagttttcccagcaccatttattaaatagggaatcctttccccatttcttgtttttgtcaggtttgtcaaagatcagagggtggtagatatgcagcattatttctgagggctctgttctgttccattggtctatatctctgttttggtaccagtaccatgctgttttgtttactgtagccttgtagtatagtttgaagtcaggtagcatctcactgatatttctttaaaaataaatgagtactgcactcatttatttttaagttacaacattcacaagaaatataacaatgaaactgtcattagtgttgtgactatacttaataaaaagctaggcaaaaaaagttttgaaaagacttctgacactaaaaaagttgcaagtacaaaatttcagaataaagaacagtactttttttaaaatttcaaataagtaatcaaaggcacataaattaaaatgtaatatctttgtctaatactgaattagtaaataccaaatttgacatttaaaagagatttccgagcagctgcggacctcgccaagacaatgcagactccactgactattcctgtgcccgtgctccagttaccctggggccctgatggcctcagccttggctttgccccgatggatgctggggcagttgaagccagaggctcctgaaatccaagagtgtcccatactcaagaatcgcaggaatcccaggagcagtgggctcgagctgccctttgggaacgttacctccacagcatgctggccatggagtatcaacaagtgagcttcattcacattgtacaactatgtgcacatggctgcccatttcagaaccaccaatctggacatggccagcttctacgtgtcacagctcagctgcagattcccataggtgagcagaggtgctgctctaatgtaatgacataatttcatataccttcaagccataaagatctgtgctcatctttcggcttgggtctaagccacagtatcccaggcctcccaattttcctgagccaggaaatctgggcctcatggagttatgggcccccttggaattctgagccaagctccaatcaactctggactcctgagacctcctgggtctagtcagtaaaattctgcaactcaaggaattctaggtcccattggaaggaatgatttacctcaaagaactctgaactctccagatgtataggcctgatgccatttcctaaagtctgaggcttgggggtggggtaatacaggtgggcaaattacagagtgggaagttatttattgaagaggttgcaaagttcagccaccctgaagatactccccattgcttctctcctcctaaagaaccaacttctccaggaaaataaaagagatttccactccatactggcaaggatgagatacatatgggcattcacacactatagaaactgtattagttggtatgacattttcagttaacctcctttaccatgccatctacttctaggaatgaaacacacagagaaaaacactgcagtaatattttaacaataaagaagtgtgtgtgtggtggcagggggagactttccaggtgcaacaatgggaggtaggctaagcttatcatgatacacctataaaaatattattcagccattgaaaattagtttttaaagttctgacacacagaaatgcttgccatagcattagatgaagaaagtatacaaaatgaatatgctattacaactatgcctaagatgcagaaaatataacaaaatttaacgatggtgatgtcctcttaaaatgccatatactccttcatatttttttttttttgagatggagtctcgctgtcacccagtctggagtgcagtggcacgatcttagcttactgcaggctctgccccccggggttcacgccattctgctgcctcagcctcctgagtagctgggactacaggtgcccgccacctcgcctggctaattttttgtatttttagtagagacggggtttcaccgtgttagccaggatggtctcgatctcctgacctcgtgatccacctgcctcagcctcccaaagtgctgggattagaggcatgaactaccgtgcccggcctcatattacttttctaatcaaaaaacattttgtaacaagtcctagtttttataggaagaaaatttcaagccatatatctgaatatctgttacatcaaaaaacaggagttatctaaatatccaactacatttcaaacaaatatataattcatgttgattcaacaagaaaggcaaacatccacatataaaaaatcaggctcaaaatttcaaactaaaactttttttaaagtttattaacttttaataaaagcaatccctaagattctttctatcactgatattaaatacctgatacagtcaagggaaagcaatatactcaaaaggtttgcaaggagtagcattaatattcagcaactacaaagcaagtgcacccttcagactaaatagtcatgtgacataaaaaacttgagcacaatatttacctgcacagaatttaagaagccaagctacacatctaaaccatgttttaaaaaggaaaagaataagttatcaaccatcttttaaatctgactctcagcagaaaagagctttgcccagcaatctgtactgaattacaaagagcacacatttgccccaaatgtttgtaaccaaaaaagttcaaccaaaacagaagtccaaagtaaggattaatgaaatatttagcttattaattgtacatcattgactaccatccctgctttcccttttctgcattcctcgttttggatcttaaaactaagtcatgaaaatgcacaaataaaaatatgtttaaaattaacatttatacaatttacagatttactaggtattttacatatgtaatatatatactaagtacattcacatagacaattatctcaagccctctgtgaggcaggggtagtcactcatagtgcacagcattcctgtgtaagtatctccactctaccaccttcccacacccacaggttcttagggaaccctaccacagctcttttttatttatttatttatgagacggagtctcgctctgtggcccaggctggagtgcagcggcggatctctgctcaatgcaagctccgcctgtcgggttcacgccattctcctgcctcaacctctcgagtagctgggactacaggtgcccaccacgacgcccggcaaatttttttgtaattttagtagagacggggtttcactgtgttagccaggatagtctccatctcctgacctcgtgatctgcctgcctcggcctcccaaagtgttttatttttatttttaatatttttttagaaatggggtctcactctgttgccaaggctcatctcgaactcctaggctcaagcaatcctcctacctgggccttccaaagtgctggaattacatacatgaatgagcctggccttcttttacttttttgtaatcaaagtgcagtgtttggcttagaaaagactaggtaaggctcggagcgatggctcatgcttgtaatcccagccaaggtgggcggatcacttgaagtcaggagttcaagatcagcctggccaacatggcgaaaccctgtctctactataaatacaaaaattagcctgttgtggtggtgcacgcctgtagtcccagctacttgagaggctgaggcaggagaatcgcttgaacctaggggggcggaggttgcagtgagccgagatcatgccattgccctctagcctgggcaacaaaccgagactccatctcaaaaaaaaaaaaaaaaaaaaaaaaaaaaaaggctaggtaaatatttgttgagaaaaggaaagagattcggccaggcgcggtggctcatgcctgtaatcccagcactttgggagggcgaggcgggcggatcacgaggtcaggagaaggagactatcctggctaacacggtgaaaccccatctgtactaaaaatacaaaaaaaaaaaaaaattaggcgggcgtagtggcgggcgcctatagtcccagttacttgggaggcggaggcaagagaatgccctgaacctgggaggcggagcttgcagtgagcggagatcacgccactgcactgcagcctgggcgacacagacagactccatctccaaaaaagaaaaaaaaagaaaagcaaagtgagattcaaagtgatctgtccagggtcatacagcttgtttgtgatagaaattgaagttttaaactagactaagtatgatattcttttcagtgtgacagctgcggcactgagtattatacagtagatataaagttagtttaaatacagaaggcttattttcatggtgtgacaaaaacataagtcaaaaacgtgaataaaataagttcttttacaaaattgccaaaataaactgtaaattccaaatttatacacaatagtgagttactggtttcaagattctaatcaatcctatcagactaataaagttagcacataaatccaaataaaaactcctgactatttacatggcactttaaatgtacattactacagcatttatgcaattaaacataattagtagtgtgcattttcctggaaattcctttgagggtagaagtaatcattttcattttcatgtcatctgcttgatcagtaattcttagcacttacactgctgatgtacataaagttaattactaatcattcaattaaaatttatcctctgaaccaggacaagcatgctatggaagagctcatcctttatgttattgttgtaattatttccatctgtaacataataaacaatttatagcattctatcattaaaaacttgagttagttaagaatgaactacaaatcttcacatttgattctttgatatgcacaattagcttgtatttatcatctgcttacttaaagaattctgggcagtgcaagaaacagaagccccaaagtctaaaactttcttccttctaaatatcagcctatttgtttcaactgttagtaaatttgggggacatcctacttagtttatcaaaataatattatcaatgaaaactctgtaacacttgtacgcataggcagataattttaatttccaagctaagtttttccagagctttttatctccattacttttttctatggcagtccaaaattacaattttactaatgtttctacctttttaggcatcaaaaaaaactattctattcacatatcaattaattctatggtacagttaaatattgggttttaaacacttcaaaattacttcggctctttcttttccacatttcttcctaaaaattcagtccaaaagtcattacgtgagactgagaaaggtaggtgtccatgctggagagaaaaccacagtggcccagaacagggtattacagcctgcagaatgaggaaacgtttctaatagagcgtgagaagaatggactagcatgagatgtctgagttaaaaaggatgagggggcatccatatgagaagaatggcctggcatgagacatcacagcacaagagaggtaagcagggccactgcctcccccttaattacactaatccacctgcaattaactaatccatcacctccctcaggttcttccctgatatttttcagagaagaaagggaagaacctaaaggagatgatggattaattactcgagaattgataaagtaagtacacatatggaggataatggtatctcaccatcagaaagacaatacaaatataggagggatgaaaattagggcccctctaatgatgaactgaaattggagattgaagtgtacacttatatttttcaatacacacacacacacacacacacacacagacatatatatgtaaatgtgtgtgtctgtgtgtgtataacatacatttgttactttctgatattgatggtatattatggctatataggagaatatccttaaagaagagaaatatactaaggtatttagagggacaaaagagaagcatccgtctcaaatatctttaaaaaagttatatactgtacttgtaacttttgtttagaattgtttcaaaatttaaaattaacacattattttcagcacagtaatcactataaatgatgatgcacacttttaattatataaagtactttgtacctacaattttcaatattttaggtagataacctctttgagattctaaatatgtaatctgtctccagaatataaagacatgataaaaatctcaattatatttcagaaagtttggcaagtcagtgaacccattcaacatcccccttccctgctaaaaatttgacccacagacttcagaaccctagccactgctttaaattctcactcctatataatgaaatagaccaagaaaaaccccaagacctagatataaatacataaaaattattacttaaaatgtgggtggtttttttttttcttcacaaagtttgggccgggcacggtggctcacgcctgtaatcccagcccactttgggaggccgaagcaggtggatcacctgaggtcaggagttcgagaggagcctggccaatgtggtgaaaccctgtctctactaaaaatacaaaaattagccgggcgtggtggtgggcgcctgtagtcccagctacttgggaggctgaggcaggagaattgcttgaacctgggaggtggaggttgcagcgagctgagatcatgccattgcactccaacctgggtgacaagagtgagactccatctcaaaaaaaaaaaaaagaaaaaaagtttgagtaaaattatcaaggttggcaaatttaccactacaaaggtctttcatgggagacaggttataccttcccaatctttaaaataattctaaggttctgtagctcaatagtgaaacaaataacgatatcctggcataaaactatctttcagacaaaatccacctgctgtgtataaaaaaatgtaataattgaaaacttcctgccttgggagagaataaacctgattcgtaatacaaaaaccactcaatctacaaatgcgttgaacagaaagatggactaaatataaagagggaacttctgacctcctttggtgctagactgcctgtagtcatagctaggcaggaggtgatattattatctcatatttaaaattatatttcaggcatatgtgatacagtcacctaagaaaaagatggacccacttgacccacagtagtatttggcctccatgccctaggctaggaaagatttagaaattacccattgtggataaagaaagagcagtcttccttgccaagatgaaaactacataataaatgagtctcctatgtgagaattacatttccacccgtaaagaagttgaactgacatgtattcccttgatgcccttgtcttctattcagtgctcagttcttttaaaatttaatgttgacagactatgtggccttcacatttctgtcccaacatctagctaattaaaattaactaatgtgatatcatttttacttcagtacacctatccaatcaatcttgagtatattcaaaaccaagagaaaaatttctgtaggtctgacaagcatggctatccttacctctctgggtaaggtggctcacatctgtaatcctagcactttgtgaggccgaggcaggtagattgtttcagctcaggatacccagaccagcctgtgcaataaagtgaaaccgtgtctctaaaaaaaatacaaaaattagctgggcatggtggcacctatagtcccagccactctagaaatagctactgtagaaaatatttgcaaattatgtatctgataaggcatatctgataaggctttttctttccattgcaagggtaatggtgaggtgggaggctctggtgggaggattgtttgagtgtgggtggcagaggttgctgtgagctgagatcgtgccactgtgctccagcctaggtgacagagccaggccctgtgccccacaaaaaaaaaaatttgtaactctatgcttaaccttttccattagcagtttctaccagcaaaataaatctcttttccaccaccaccaaagatttttccacatctttgccaacacttgttctggctgtctttttaaatttcagccactctggtaggtgtggcatggtatctcactgtggttttgattttcatgtccctgatggcaaatggtgctgagcatcgttttatgtgcttattggccgtatgtttatctgccttggcaaaatgttcattcagaccctttgctaactgttttacttgggtcattttttaaataaaattattaacttgtaagagtttaacagatatgtcttatcagaaatgtaatttgcaaatattttctcccattttatgggttgtctttttactttcttatggtgtcctgtgaaggacacacacgtatgctcggtctctctctctctctctctctctctctctctctctctctctctctctcaaaacttttggaccaaagagggaagtataactgtgatttattaagcagccccattgagggctaacagcacatttctgaccactttgtatgctggtgccagccgggggtgccccagcggttgctccctggggtgtctgcttcagggctgctgcaagggtgcagggcagggctccttcagctgggaaaccatggaatagttggcagctgctttgtacgtcttgagagacaaaagaaagctcaaaatcaagagcaaacactgggtttgcactgaaaagaaatatatcatttccttgaagagaaaaattcaagatgtgaaaaatggaagcaaggaaagaagaactatgaagagaagagagattagaataccaacagcatagatcatttcatgtcccaattatctccaagttcttccaccttctgggatcaccagctgttttaacacccaaaatatatgaaagctatgtgttgtaatctgtagggtaaccgttaaaggaacaggatctataacttggcaagagaggaaaaagctaggatggtaaaaaagtctatcaatccaaaaggcaagaaaaaagagaaaaagaaacatgctggcatattattataattattgtattatttgttattcctgttaattttttactgtgcctaatttatatattaaactttttcacagctatgtatgtatagagaaaaatacatctgtggtttcaggcatccactgagggtcttggaacataatccttcccccagataaggaggtcctactgtaattatattatatgtcatattaagtatatattaattctactaggtagcagccacattatatattaattatattaaatatatatcatacagatttattttaaggaattgactcataatagaagaggctagcaggctggagattcaggaaagacttgtaattcaagtccaaaggcaatctgccagagaattccctcttgcttgggggaggtcagctttttattctattcaaatttttgatgaaaatagaaagcaaagagtatattaactatattatacaaactaaatgctccaattaaaatacaaaaattataaaacctaataataaaaaacctaaattatataatgtttaaaagagacatttttaagcttaaggatatagaaaatttgaaaataaaagaatagaataaaataagccattaaaatactagtgtaacactgatgtggaaatctgacaaagcacacaaaaaagaaaataattttaactgcaaaattttaaaatccaagcaaagagaaagcagcatatgttataattatatcacaacatgatcaagtaaggcatacttcaaaaatataacaaaaaaaatttaaacatggcccattattaggaaacatactaataaaaatcctcacgaaaaataattcaaaatctaaaaagccatatgataagcctgatgaatattggtttacagaactgattttctagaaaacaggtttataaaactggttttctttaaaaaggcaatcttggggaaataacccatttactccatttttttttttttttgagatggagttttgctcttgtcgcccagactggagtgcaatggcacgatctcggctcactgcaacctttgcttcccaggttcaacagagtctcctacctcagcctcccgagtagctgggattacaggcacctaccaccatcacgcccagctaatttttttgtatttttcatagaaatggtgtttcactatgttggccagtctggtctcgaactcctgacgtcatgatctgcccaactcagcctcccaaagtgctgggattacaggcgtgagccacctttgggaagatatccagtagtgagattgctatttgaacggcagttctgtttttatttctttgagaaatctccataatgttttctgtaagggttgtaataatttacattcccaccaacagtgtataagcattcccttttctctgcatcctcatcaatatctttggttttctgacttttaattttaaatttattttttatttttatagatatgcgggtctgatgttgcctaggcgggtctcgaactcctgacctcaagtgatctgcccacctcggcctcccaaagtgcagaattataggtgcaaatcaccacacctgactgttttctgactttttactaatagcatgtgctgggtgcggtggctcacacctgtaatccctgcagtttgggaggcagaggcaggtggatcacttgaggtcaggagtttgagaccagcctggccaacatggtgaaactccgtctctactaaaagtacaaaatttagctgggtgtggtagcaggcgcctgtaatcccagctactcaggaggctgaggcagaagaatcacttgaacccaggaggcagtagttgcaatgagtcgacattgcaccactacactccagcctgcatgacagagcaagattccctaataataataataataataatagcacatgctgttctgcagcatgaccttaacattgctcccatggtgaggtcgggtctgtgctccctccccttgaattcaagaaggtctgtgactggcagaagtgattcaaggtaggtcatgaaaggggacaccatttctccgtggtcctcctgggatgcttgctctttgaacccagccaccatgctgtgaggaagcccagatcacagggagaggccacattttgatgttccaatcaacagtcccagcacaggtttcagatgacagccaacatcagtttccagacatgggactgaagaaggctttgcgaagactccagcccagccactacgacagcatgagagacccctactgaccatcacctacctgaacccatcaactcccagaaccatgaaaaaaaaaacttttttttttttttttgagagggagtctttctctgtcccccaggctggagtgcagtggcgcaatctgggctcactgcaagctccacctcccaggttcttgccattctcctgcctcagcctcctgagtagctgggactacaggagccgaccactacccagctaaatttgtagttttagtagacacagggtttcaccgtgttagccaggatggtttcgatctgacctcgtgatctgcccacctcgccctcccaaagtgctgggattacaggcgtgagccactgtgcctggccttttaaaaaaaaaaaaaaatgagtttcactcttgttgtccaggttggggtgcaatggtgtgatctcggctcatggcaatctctgcctccaaggttcaagtgattctcctgcctcagcctcctgagtagctgcaattacaggcgtctgccaccacacccggctaattttgtatttttaatagagacaggatttcttcatgttggtcatgctggtctcgaactcccgacctcaggtgatccacctgccttggtctcccaaagtgctgagattacaggtgtgagccactgcgcccagcaagattgctattttaagtgcctaaagttttggggttatatattatgcagtaagagtaacttaaacatcctcctttccttctagctttttgaatctcttagtcatcaaacctagtctctctctgaagacctggtctgctttaatcaatgttttccccatagacccagcgagaggtaggtggagttatcttcctactcttcatggctgctcagaacccacctcccgggttctcgccattctcctgcctcagcctcctgagtagctgggactacaggcgcacctacctgaacccatcaactcccagaaccatgaaaaaaaaacttttttttttttttgagagggagtctttctctgtcccccaggctggagtgcagtggcgcaatctgggctcactgcaagctccacctcccaggttcttgccattctcctgcctcagcctcctgagtagctgggactacaggagccgaccactacccagctaaatttgtagttttagtagagacagggtttcaccgtgttagccaggatgcccggctaatattttgtatttttagtagagattgggttttgccatgttggccaggctggtctcgaactcctgatcttgagtgatctgcccccctcagccttccaatgtgttgggattacaggcgtgagccactgtgccctgttagttttcataattttctttacttccctctgtggtgggagaactggcttcagagaaagccatcctggacaggtgaggtggccccaccaggaacaggtttcaatcaggtgttttggaggcagtaatgcccatgcaccctggtgagaaggggcatggcgtgaacatcaggaaccagacttcaccctggagaaggagaggccacaggtgaggctgaaggagcagttctcacaaatgatcctgtgggcactggggccacaccacgcaccttggtgcacaagtgtcaatgtggctcagagtggggtagaggactcagggtattaaaagcatcaaggaatccaggggagagccaccgcacccaactttactttcacccacaggctgatgcagcccgaggaaatgttacgccacaaggacctcaattctacacacagaacctgttcgccaggcccttgccacaaaatgggggctgccaagccttgttagaatacctgagactcagaggaaaataatttttcttgagacaagttcttgctctgtcacccaggctggagtgtagtggtatgatcatagttcactgcagcctctatctcccaggctcaagccatcctcctacctcagtgccccaagtagccagaaccacaggtgtacaccactatgcccagctaagaaaataatttaaacatttaattagtttatttattattagttttttgtttttttttttgttttttttttttacacagagtccctctctgtcatccaggctggagtgcagtggcacaatcttagctcacagcaacttctgtctcctgggtttaagcgattctcctgcctcagcctcccgagtagctgggattacaggcgtgtgccacaacacccggatcatttctgtagttttagtagagacagagtttcaccatgttggccaggttgatctcgaactcctgacctcaggtaatcctcctgccttgtcctctcaaattgctaggattataggcatgagccactgcactcagcctaatttaaacattttaaaatcttgtttaaattttgaaataaaatctcaagttggtttttaaaaaactctgtccgggttgtgatgactcacatttgtaacttcagcactttgggaggctgaggtgggaggatcgcccgggagttcaagacagcctgggcaacatagggatacccagtatctctaaaaaaaataataataatacaaaaattagccaggtgtagtggcaggtgtctgtgatcccagctactttggaggctgaggcagaaggattgcttgagcctggaaggtcaaggttgcagtgagctgagattgcacaactgcactccagtccgggcaacagagtgagaccctgactcaaaaaaaaaaaatagtgcttagtgccacatgccaggaaccgcaatgacaacaaatcagaaggttgttgagtcagggcctaccaagagctggtggggagtctgactgtagggaccctgcccttttccaaaaggtggaggtgcagagaagctcataaggatcacggcttctcaccctggccctgaatccactcacatcagcggctctctgcacagccaaccggacagctcacaccaataaattaaaccttcttatttcttgctgggcacagtggctcacacctgtaatcccagccctttggaaggctgaagtgagaagattacttgaggccagaagttcaagaccagcctaggcaacatagtgagaccctgcctctacagaaaattaggtgagagtggtggcctgtgtctgtggtctcagttactcaggaggctgaggcaggaggatctcttgagctcaggaggctgcaatgaactattgcattactgcactccagcctggaggacaaagcaagaccttgtctcataaaaaaagaagcaagccagcaggtctaatccagacgtaagaggagggtattggccaggcacggtggctcacgcctgtgatcccagcactttgggaggccgaggttggaggatcacgtgagaccaggagtgcaagaccagcctggccaaatggtgaaaccccatctctactaaaaatacaaaaattagctgggcatggtggcacacacctgtaatcccagctactcgggaggctgaggtataagaatctcttgaacctgggagacggtggtggcagtgagccgagatcgcaccactgtactccagtctgggcaacagagcaagactctatctcaaaaaaaaaatacaaaaattagccagatgtggtggcacatgtctgtaatcccagccagatgcgaggcttaggcaggagaattgcttgaacccaggaggcggaagttgcagtgagccaagatcacactgctgcactccagcctgtgtgacagagtgagactctgtctaaaaaaaataaaataaattgaattaaaaagttttattaatttgcaatactgagtttgcaagaagagtgaactgtggtatggtgaccagcacacagtattttagagttcacagcgtgctctctgggaaactgttttagccaaagttgtggcatcatctctgaccactcactttattcaaaagacctggctcaaaatgactatttatggaaatcaactctagcctcgaaatacaaaaccaatgtagttctaaaggtattcaaatgaaggtaattaagtttattaaaaagcaatgaagggccaggcacaatgtctcacgcctgcaatcccagcactttgggaggctgaggcagcagaaggatcaattgaggccaggagtttgagaccagcctgggcaacatagtaagaccctgtctctacaaaataattttattttattataatttttatttttggtttttgtttgttttgttttgttttgttttgttttgttttgttgagatggagtttcactcttgttgcccaggctggagtgcagtggtgtgatcttagctcactgaaacctccacctcctggattcaagtgattctcctgcctcagcctgcaaagcagctgggattataggcgtgcaccaccacacctggctaattttttgtatttttagtagagctgggtttcaccatgttagccaggctggtttcaaactcctgatctcaggtgatctgcctgcctcggcctcccaaagtactgggattacaggcatgagccacttcccccagcccaaaataatttttaaaattagctggacatggtggtttatgcctgttgtcccagctactctagaggctgggatgggaggatcgcttgaggccagaagtttgaggttgcaatgagacaggattgcaccactgctccccagcatgagtgacagggagagattttgtctctaaaatggaaataaaggaagcaaggaagggcttctcctccaaacactaccacttcatcttgggcagttacatgattccaggaaacatggaaaatctaccttgagtacctttttggatgtatgctaatgggaaaacaaatctcattaattaactcatagaacggctaagaggaaagaatcttaggggatgtgtggtttcactccctaattttaaacatgaggaaattgggtaccaaagagatgaagtaactcagcaggtagagagagaagagcctctcttaccacaaggggtctctcattggaaaatgggcaaaacttgttccctgcctgcattctccaagatcgtagccaacatagaatagaagtgtctccacttcagaggacaactggtttgtcctttgccttttacacccctttcagcaagcagtatttctcagctttgtgtttgtgcaaactcttgagtagcacaaactcctgagctaagagacactccactctgtttgcaattgagggcaaaggctgggatgcttgggcacagctccaggctcctttcccagaagtctggggtggcagaaaaaaaaagaatgtatttttcacacactgagtagagatgtggctcatcacgtagaggtaaattgtttttttcttgagatagagttttgctcttgttgcccaggcgggagtgcagtggcaccatctcagttcactgaaacctccccctcccgggttcaagctattctcccacctcagcctcttgattagctgggattataggcacctgccatgacacccagctaaattttgtatttttagtagagaaggggtttcaccatgttggccaggctggtctcgaactcctgatctcaggtgatccagccgcctcagcctcccaaagtgctgggattacaagggtgatccaccgcgctcggccttagagttggtattttataaagaatagaagtttacatagctcacaattttagattatggaagtccaagagcacgccattgacatctgatgagaatcagatttccacatcacaaaatggccaaaggcatgaggatgacagaaggtgaacataagagagcttacttttataatagacccaatttcctgccagctaacccactctggaaacaatgacattaattcattcatgagagtagattccctcaaaacctgatatcttcttaaaggtccaatttataattttataatgatgacagttaaatttcagcatgaattttgaagggggcattcaaaccatagcgatgcgtttttattagataattaaattatttgatatttaaaaaattattgatttgccatgacttttaatggcaaaaaccgcaattacttttgcaccaacaaaataatgtctttggttttcttttcatgctctcttttcttgtgttttctagtttttttttttgcttttgttattatatgctttgattcccatttcttttctttcttttgttttctttttttttgttttttttttttgagatagagtttcactctcattttccaggctagagtgcaatggcaccaactcaacctccatctcccaagttcaagcaattctccttcctcagcctcccgaatagctgggattacaggcacttgccaccacatctgactaattttgtattttagtagagacggattttctccatgttggtcaggctggtctcgaactcccggcctcaggtgatctgtccatctccgcctcccaaagtgctgggattacaggaataagccactgcgcccggccgcttgattcctttttcttttgtgtgtatagtacaaattttcatttagttaccaagagatttacataacacatctcatagatataacactctagcttacgataataacaattctacttcgatgcatagaaagactcaacaggtttactctcttcaatacacgatttatatcgcactttacattttttatattgtgtatctcataataaattatttaagctatatgtattttggatacttttgtcttgtagcttttatccctaagttaaaagtaattcatgcaccaccattacaggtgtcattagtattttattcatttttctccacttatacctaaataatgatataatttaattccaatatttattttatatataatctcacagtattctaaaaaattatattgtttttgctttggaatattattttcttgtgttcatatggttgtattgtagatcttatattttgtgtaatagcaataatatattaataacataaataactttacctagtatcttttaaatactttaaaagcttccattttcattagacttttactaattcttctaatgtatttttttgtggaaatttactactatacattgtatgccaataattaaaaatgccagattttcgtaagttcatagtcatatttgaaaactgtagttatttaaagaattattttctgatacatctatgctaatattccatattttataggtcaacatgttttatttttgtttttaagtccattatactgcatttttttcgtacaggtttcttttgatgattaaattgtatttttgtttttaacattacatttatgatgtggaaggtaattttcattcggtattatttataaaaatgtggtgtttaacagggctgggcacggtggctcacgcctgtaaccccagcactttgggaggctgaggcgggcagatcacctgaggttgggagtttgagaccagcctgaccaacatgcagaaaccccatctctactaaaaatacaaaattagctgggcgtggtggtgcatgcctgtaatcccagctccttgggaggctgaggcaggagaattgcttgaacctgggaggtggaggttgcagtgagccaagatcatgccattgcactccagcctgggcaacaagagtgaatctccgtcttaagaaaaaaaaaatgtggtgtttaactcaaatataaatccctgggtttcacttggagcaaattttaaaaaacaagtataagtcagatatttcttgtttttgtttgtttgtttggatacggagtctcgctctgtcacccaggctggagtgcagtggtaggatccaggctcactgccacctctgcctccaggttcaagcaattctcatgcctcagcctcctgagtagctggggctacaggtgcgcaccaccatgcctggctaattttttgtatttttagtagagatggcatttcaccatgctggccaggctggtcttgaactcctgacctcatcatccacctggctcaatctcccaaagtgctgggattacaggcgtgatccaccacgcccagccccgtaagtcagacatttctattgcctataaaagttacttatgtgatatttgcgtgtataaatattgatccattttctttattagttatcttgtttattttttttctcaggtggttgtcagtgttctattgtctggatgagtagtcagaaaggcagtctaaaattactgtctatttattgtttgaatctatgttattgtgtgagaaaaacacttgatatttgaagtaatttttgaaaaatgcaactattttttgagagttgtaaatatttgtgattaaaaacataaaattaccatcttaaacattttaaagttatatacttaagctatatgtttagtacttttaagtatatttacattatatgaaacagatctctagataattttatctttaaaaagtacaatctaatgttcaataaactgtcttctccttctctcttttccgcgtctgaagaacatcactttactttctgttttgtctgtctctttttggctatcttattttagtcaacatattttttcctgcgtctttaattttaacaaataagttattctcctctcagttcagattcatcaggaaattgaatcatatccagaagaattaaaactaagagactaatatgtttgttaaagcaatgcaggttgtcatactaataaaccctacaatttcaaaggcttagcaaaataatacattttatgcacacaccaccttcccctttggtttacttctggttaaaaaaacttcttcatgattatttggagattagatttttttctaaattttctatccacattctcctgtttctaaagccaatagatcaaaaaaagatgcaaagaagacacatttgctttttatccacacatcacttccagtcactatgctgagcagagtcaaagtgagcagagctcagaatagcagttttctggcaggacagccacttcttggcaaaaaatgacacaataaaagcataaatctttcatggaaagctaacatgttttcagcaaattaagcatatgcacgaataaaattcttgtggtaaaataaagattcattttgttgattcttagtaagctcaggtaatagcaaataaaaaggcagcaaatatagagcaaaaaaaattatttgaaatagaaataatgtggattaagatattctgtcaattaaagtaaaaatatttttatctcatactaatcatcttacctatagtcgtataatatcaaatgctaccttttattaacaattgtacttcatataagtattccatttatatcacccttcttcactgtttcaatgccttctgcacttcatatcagtgaaaaacaggctggctggtaccaggaaatggatgtggtgctattgctactttaagagtaatgatgaagagcacttgtctgaattggtcccatgtggcaaacactgttatatggtctaaagtaaacacatttattattttcttctaaatttactgatgaaatacaattctcagctaaggaagacttgatctcattcaaatacattttgtgaaatttggttgacatttcagtgtttttgacttaaatggcatattggaaatttctatgaatccaaatagagtgttatacacgaacagtcttttattaaaaacctttctgggttgggtgcagtggctcatgcctgcaatcccagctactcagaaggctgaggcagaagactgacttgaacctgagaggcagaggttgagttgagccgagatcacgccattgcactccagcatgggcaacaagagtgaaactccgtctcaaaaagaaaaaaaaaaggctttgtcttaagattcataaaatttcttcataatatagaagaaatgtgttaactatgttcccagtaatcaactctgaacactgagcattctcagtttccagtattcactctgagtcattcagaaaaattggtatctctgtaaggagtcagaaaaatgtgtttggggaagggtcacaacattgcacataaatgctttctacctgcacctgttaggatcttaatctaattggtctatcatttgcatggctagatagttactggatctaatcatactattttgtgttttgcagataatgacatctgttacctataagtttcatacaacaatttgctcagctgaaacatgaatcttttgctaatttacccgaaattgagggactagatttgcaatttctaatctttcaatgttagagcaaagtagagaagagtaatgtgtgtatgtggtatgcattttcttacttaactattaaaattcttctcatattgccttggacactttagacagccacccaaaaaatattctctactcctttttttagccaggatattagatttcaaaaggtcaaggacttaataattgggctaagccaaaatcttgtctttgcttctttcaaagagcatggcaattatgccaagccattgaaagatgtggatctgatgacttttgatttcaaatgctttttctaattgtttgctctaattgtcttattgtgttaatctaaaagagaacctatctacataacaacttatgcattcacgaaatgttcatgttacgatgatcaaagttcaatattgtagtatagaatagtagaatagtctaaaattagaaagtcagattattattaataaattcattatttttttcaacattttccaatgttgaaattaaagaattggcaaggctttttcatgataagttcaattctaggatagtactcactggtctgcatggtatttttttcctttttttggcaggaggggatggagttttgctcctgttgcccaggctggagtgcaatggcatgatcttggctcactgaaaccttcacctccagggttcaagccagtctcctgcctcagcctcttgagtagctgggattacaggcatgcaccaccatgcccggctaattttatatttttagtagagacggggtttctccatgttgatcaggctggtcttgaactcacaatctcaggtgatccacccacctcgccctcccaaagttctaggataacaggcatgagccaccgcaccctgcagctatctttgtcatgaattatgtaaatccgagttaccagaatggtgcagaagtgctaatgcaatcagaatgaaaatgaatacggccttgttggtagactattggtatcccagaggctgatcatttacttcagctgtgtagacattgcttcataacgccagggagccctttcaaccaagttatctttatttcccattgatgaggtcatgttctggtctctgtttttcttaagctgtcccagatgaggggtgattatttcttgcataaatgagatcccttctttttcctctgcaatgagatcctcctattctccttattgaaagtaatatgttgaaggcagaaatggagacaatatacaaatatatatcttgccatgtggccaccataaacactttatgacattgcttaccaagaagtttgattaatttcagggaagcagggatgttttctatgatgtgctctttctcttaaagcacctctgattaagtttagcctaatcaagataatctctcgtatgataaaaaggaagccaatacattagtaatataaatacatgaatactgttttgccacagtcacacacattttgtgatgctcaagagaaaaggattacacagcaggtgtgcactgaagtgggaacctgagggtcatctgagaattttccctacccacctgaatagatttctaaaatcacctttcagttgcttttgctgtctttctaagtaaacaaagatatcatctgcaaataataattaattgaactgcttttcaattgtattcattaaaataattatctttttctggcttatatgaagtatttcttatttgtaatatacattcacatatatacaaatatatagcaatacaaatgtatccattttcatttttgttaaatttttaagaatggatgttaaaggtaacttcttttctgtttgaagtgtttttattgttttattcaagagtattatctctggagttaaagttgatactgttttaatactggttttgctattgtgagcaagttatttctctctctggctcttttctttttttttttttgtaaattgaaaataatagtgacacctttgttattaagttactttgtctattagtccattctcacactgctgaagaacacaccaaagactaggtaaattataaaggaaagaggtttatttgactcacagttcagcatggctggggaggcctcaagaaccttatgataatgggagaaggtgaaggagaagcaggtatccttttcactaggtgacggagagcaggaaaaattaccacttataaaaccatccaaactcatgagaactcactcactatcacaagaacagcatgagtatcattctgcctctggccccttccaaatctcatgccctttttatatttcaaaaccaaacatgctttcccaacagtcccccaagtcttaactcaagttagcattaacccaaaagtctaagtccaaagtctcatctgagacaaggcaaatccctgctacctgtgagcctgtaaatcaaaagcaagttagtaacttccaagatacaatggaggtacaggcattagacaaattctcccactacaaatgggagaaattggccaaaaccaaagagctacaggcctcatgcaagttggaattccaatggggcagtcattaagtcttaaagctctgagatgttctcatttgactccatgtctcacatgtgggccatgctgatgcaatgggtgggccctcatggccttgggaagctcctttatggactggaattgtgtgcctctggcttttctaggtgcacggtgcaagctcatggtgaatctgttatttaggggtctggagtatagtggccttctcacaactccagtaggcagcttcagtggggactctgcatgagggctccaaccccacatttcccttctgcattgccctagcacaggttatccttgagggctctgcccctgtagacttctgcctgaacacccaggcatttttatacatcctctgaaatctaggcagaggtttctagagctcaactcttgtcttctgtgcacatgcatggccaatatgacatggaagccaccaaggcttgaggattgcactttctgaaggaacaacccaagctgtactttggccccttttagccacagctggatctggagcagctgggatgcagggcaccagccccaaggcttcataaagcagtggggccctccctgggcctcgaccatgaaaccattttttcctcctagagttcctggcctgtgatagaagaacctgtctcagatctttgacatgacctgaagacattttccccattgtcttggctattaacattcagcttctctttacttttgtaaatttctgcagtggcttgattttctttccaaaaaaatggggttttatattctacctcatggtcaggtgcaaactttccaaacttttatgttctgcttccatttaaaaattaagtttctcatctccatctgagacaacctcagcctggactttatcatctacatcactattagcatttgggtcaaaagcattcaacaagtctctaggaagttccaaactttcccatatttttctatttttttctgagttctctaaactgtttcaacctctgcctattacccagttccaaagtcacttccacattttcaactgtctttatagcagtgccccaaactacctgtattaattttctgtattagtttgttttcacactactattaagttactaccagagaatgggtaatctatacagaaaggaagtttaatttactcacaattctgcattgctggggaggtctcaggaaacctacagttatggtggaaggcaaaggagaagcaagtaccttctttactaggcagcaagagagaggcagagcagaaaaaaacaccacttatataaccaccagatcctttgataactcacttactatcatgagaacagcatgggggaaaattacccccatattccaatcacctcccaccaagtccctcccttgaaacatggggattacaatttgagataagatttgggtgggataaaattttacagtaacgaattcaatacaagtcacagaatatagatttttttgagaatctctgaggtttccaggtttctctttaattatccaccttattaaaataatcttttttgtttcaatattgttcttctgttctgaaaatgcatacaaacacacacaaacacactcagttgctacataactttcttatatgtgtgtatatatatatgtatatatattcatttatttttttaatggtgtctcgctctgtcatcctggctggagtgcaggtctgccaccttggctcactgcaacctctgcctcccaggaccaagcgattctcctgccccagcctccctagttgctgggaatacaggcatgtaccaccacgcccagctaattttttgtatttttagtagagatggggttgcaccatgttggccaggctggtcttgaactcctgacctcaaattatctgccccactcagcctcacaaagtgctgagattacaggcatgagccacagtgcctggctgatatatctttagagtaatatatttgtatatataactctatgtaaatcaaaactaaaagtctgtttttgtttgtcagcagagaggccacatgtacaaaaaatatacaaaacaattttttaaaaatatttaatcaagactcagaaatgtatattaattatactcatgcaatttttatgaccataaaatgaccctatggttagtaataattcaattgtacatattaaaataaaactgtataatgagcttgtaatacaaaggataaatacgtgctcgagttgaggaatacctcatatacgctgctgtgataattaactaacgtatgcctgtgttaaaatatctcatatatgccataagtgtgtatgcacactatccacccacaaaatttttttagaaatctaaatagggtaaaaaagaatacaaatttgatctatgagaaaaaaattattctacttatttgcagtttaaaccactggcaggacaggcatggtgacccacacttgtaaccccaccaatttggggcactgaggtgggtggatcacctgagatcaggagttaaagaccagcctggccaacatggtgaaaccccatctctactaaaaatacaaaaattagccaggcgtggtggaatgtgcatgtagtccctgctacttggcagactgaaggcaggagaatcgcttggacccaggaggtaaagtttgcagtgagccgacatcatgccactgcactccagcctaagcaacagagcaagactccatttcaaaacaaacaaacaaacaaacaaacaacactggcaaaaaagagattactagagatgtcattcccctacattaacaaatagcacattgttaccatcttttacttagaaccttaagtaaaatgggacccattaaatctgatgacaaattaacacttcattcaaagcacaatagttttaacacattaaaagcaactttgtttaatgaaaaaattaagatgacacataatctttaaaaaatttttaaatttattgcattttattacataaacgtacaattgataaaaaacaatctctcctatctctgatgaaacaactgatcaaatactttcacaaacaataggaagagtcaacatgacggaatctgagacttgagttacattattatttgcttttcagaaactatttttttatagaagaaagaaacatacctcgaaggtaattatgaatctcgaaaaaaactacttctttaacatgtatatggtgttagctttggatctcttttacactgaaccctctgatttagtgtaatgtatgaagtttcagtgccttcattctttctactgtgacccctcagatgtttatatagacttaatttttgatttaatatgttttccccatttactggttctgcaaaaatatttagtacaaactggtgttttctaagctgtaggttttgaacaaatgtttttcacattcattacatgtttagactttctccccaatataaattctctaatgttcaacaacgtttgagcatcttctcagatcttcaaatttttcctttaatataaaatgtgtacaataaaatctgtaatggaagtaaaggtacagcaatcctctttaagtttgtatgtttgtcttcagaataactggtctttactttaaaggcctatattttccaaaaggtctttttacagtaatcacatttataatttttttttgagacggagtcttgctctgtcacccaggctgtagtgtagtggctctatctcagctcactgcaacctctgcctccccggttcaagcaattctcctacctctgcctgccgagtagctgggattacaggtgcacgccaccacacccggctagtttttctatttttagtagggatggagtttcaccatgttggccaggctggtcttgaactcctgacctcatgatccaccgaccttggcctcccaaagtgctggaattataggcatgagccaacacacctgacctataatccctttattaagtataaactttctgatattgagtaagatgtgacctgatattaatggcttttcacattctttgtatttgtacaatttttctctagtataaatgctttcctgtaccataaggtgtgagaatttgttaaaagttttgccacattcttcatatttgtaggagtcttcttcagtataaactatcttactaccataacgtgtgactaccatttaaagtccttgctaaatttaacacatttctagagtctctcaccagtatgatttctcttttttagaaaagtttgaggtgtgcttaaatgctctgtcacagttttatgtaagcagagtttctctccagtataaaattttttagtgagtaagcatggagaaccagttaaagggtttgccacatttttttctacaattgcagggtttctctccaatatcaattatcttacatttattcaggtttgaggactttttaaagacattaccatattgcttattgcagggtttctcttcagtattaattctcttatgtataataagggttcaagactagttaacagctttaccacattctttgcttttgtagagtttctctctagaatgaatgatcagatattatgtaaggcctgagatgtgcttaaaggttttgtcactttttttttgtttctagggtctctgtaatataagttctcttaggctttgggaggctgacaaaggtggatcacctgaggtcaggagttcaagaccagcctggccaacatggtgaaactctatctctactaaaaatacacaaatcagccagtgtggtggcacacgcctgtaatcccagctactcaggaggctgaggcaggagaatcgcttgaacctggaaggcagaggttacagtgagctgagatcatgccactgcactccagcctgggtgacacagggagactccaactcaaaaaaatttttttaaaataaattctcttaggtttattaaggtttgagggttggttaaaggctttgttacatttttttacatttataaaatttctgtccaatatgaattctcttacgttcaattaaggtttggaactggttaaaggcttggccacattctctacatttgtagtgtttttttccagtgtaaattattttatgtattataaggcctgagggtggactttgccacattattcacatttgtagggtttctctccagtgtgaattatcttatgtttagcaagacttgaatgccacttaaaagcttggtcacattcttcacatttgtagggtttctctccagtatgaattctcttatgttgcataagggttgaggagcaattaaaggctttgccacattcttcacatgtgtagggtctctctccagtgtgaattctcttgtggtcagtgagggttgaggataagctaaaggctttgccacattcttcacatttgtagggtctctctccagtatgaattctcttgtggtcagtgagggttgaggataagctaaagactttgccacactcttcacatttgtagggtctctctccagtatgaattctcttgtggatagtaagtgctgaggagcgcctaaagtcttggccacattcttcatatgtgtagggtttctctccagtatgaattctcttatgtctagtaaggttcgaggataagctaaaggcttggccacattcttcacaggcatagggttttctctagtatgaattctcttatgtctagtaaggtttgaggaccagctaaaggctttgccacattcctcacacctgcagggtttctctccagtatgaattctcttgtggtcagtgagggttgaggatacgctaaaggctttgccacattcttcacatttgtagggtctccctccagtatgaattctcttgtggttagtaagtgctgaggagcgcctaaaggcttggccacattcttcacatgtgtagggtttctctccagtatgaattctcttatgtctagtaaggtttgcggaccagctaaaggctttgccacattcctcacatctatatggtttctctccagtatgaattattttatgtgtagtatggtttgaggagcagttaaaggatttgccacattctttgcatttgtaggacttctccctagtatgaattacctgatgttgatttaggtgtgaaagcatgcaaaatgatttgccatatttgttacatttgaaatgtttctttccagtatatcttgttttatctctattggaatttgaaaatttaccaaagactttgacatatttatgagtctgaaatattttgttttgggtagttgacaaacattggttaacttcactataacctctttgggcacctcacattcacccacacttttacagcattttttaaattgtaatttctcatgtccacattttccatatgttcttggtattactttttggagtgaatctttgatgccctgctctggctgaaggtcttgggtgaaatgggaatgcgtaactgaaagacacaaaaagcacaagttactccactttctggactcatataaatgtattctacacatgaaatatataaaattacacaaggtacattagcaaaatgccatatcaaaataccacaggccataattccttcatagatgtataaatgtaacaaaatcatagtgatcaaaatacctttgttggaaatttataaataaagtaagtgtgtgcaccatgtgagcacgatgtccagagccatatagagagaaaagaaaggtctgctacatttacccaacacagcccttcctcatgcccagtagaagaacatagtgcctttaataacagctttaagtcttctgagctcaaaagtgaatgttacaaccgcagaaagactgcagtatgatgggtagaagataggtgtagaacgtagttactgaccactaagaagaaatatgaagaagtcttttaattgaaaaataaatacaaattgcagacaaaacacatcctgagaacatgtttgtgagaatcccagaatctctaccaaagacaattggtgtcatgctatgagaggaaggagctgcattataaagatcatgaaaggtagttttatgttagtgtctaaatctccaacaaagattacaatgtatataaaacatgaggacaacatggtccaatcaaaaaaatcaaaaattttgaaaaagcaactataaaaataaagatgtacatcttgatttttaaaatttaagataatccatattatgctcaatgagaaaaatggaaaaccagacacctaaataaaataagaaaaataagaataccaacaaaacttgcaataataaaaataaacaaggtggaggtaaaaaagaataactgaaaaaatttaaaagtaagaaaaaagtacgtaaaaaatgaagaagctaaacaaacaaactaggatatacacaaaaagatccgcaacacaaatttaagcaaagtttcaaaagtcacaaaccagaagataatcttgggagctgcaagataaaagtgaagtattatttataagcatagtcctctgagacaaccagtgaatttgtaaacagaaaccttgcaggtcagaaaagaactgtgtaaaatggtcaaaggctgaaaaaaattttcatggtgagaataataaaaccagaaaaatgtactacaacataaagaaaaataaaactcttccagaatgaataaatgctggaaaagcacataatcattgtatgtgccctacataaaatgctgaaaagaggtctttccacttaaaacaacatgatgaaaaatatatgtaatcatatgaaaatacataactttctgaaaaacatatgcatatacaaaaagtaaaattctgtggcattattgtgatggtgcagaaaatacttttagttattctttaaaatttgaaaaatataagcataaaaaacataaaacataaaaagatataattagcaacatcaataagaagtatagggtagatataatgaggacaaatttttctatgcaactgaagtcatttttttttaccagtttaaaatatactgttgtaacatttaagatgttttacagaatctccaatgtagcacaaagaaaaaatctttatagacacacgaaagcaaatgagtcaattactagcatgagacaaagattgatattatataatggtaaaatgagtccatttactaggaatctataattattatgtctatctacatgtatatgcatatataacatcagggcttcaaaacatataaagcaaatattgacagaaatgaagcaagaaataaaatagcaacacaaaattataaacattaagacctccttttcaataataaataaaaaatttaaataaaagatcaattaaaaaaactgaaaacctgaagaatattatattgtgtatgaatttattttgcattgctatagaaaataacctcagactgggtaattcataaagaaaaagattttttgattcacagttcagtagactgcacaagaagtatatgccagcatctgcttctggtgaggatatgaggaagcttacaattatagtggaaggcaaagaagaaccaaacatgtcacatggtgaaagacgatgtgagtgtgaggtggaggagccaggttcctttaagcaaccagctctcatgtgaattaatagcgtgagaactctatgattgtgccaagtcattcatgagggacttgtctccatgatgcaaacagctctcattaggccccacatccaacagtggagattacatttcaacatgccatttggagggcatctacaccatatcacaaaccaaataggctaaacagacatgtacagaactctccagtcaaaagcaagtagatacacaatattcttatttgcacctggtgcattctgttagaacacataagtcttggtaaatttcaaaagatcagccaggtgcagtggctcacaggtgtaatcccagcagtttgggaggccaaggtggaagaatcacttggggcaagaagtttgatactagccttgggaacacagtgagaccctgtctctacaaataattcaaaattagctgagcattgtggggtatgcctccaatgccagctgctcagtaggccaaggtgaaaggattacttgagttcaagaggttgaggctgcagtgagccaagattgtgctactgcactacagtctgggaaacagagtgagaaactctgagtcaaaaaaaaaataagaagagcaaaatcatacagtatatgttttctaacccaaactgaataaaactaaaaagaaaaaaagtaatactggcaaatcaaaaatacatggaaataaacacactcttcactgtattcttgcacagggtcaaataatttaaattaatttaatattttttctcaagggccaacatatttaagtgatgacttaatttgttaagacccacagtggtgaacaaatttaatataatctgtatcaaaattccaaaagtatatttattcctgaaatattgtttaaaatttttaaattttattatgaaccaaatctagagaaacacacatgaaaaacacagaggcactatacttcataatttcaaaacataataaaaagctgcaataacaataactatgtggtattcacaaaaagacagataaagacatgatagaacaaaatagaaagcccagcaatgaactcttctgtgtatgaccaaataatctgcctcaaggttgccatgagcagacaatggagaaaatataatcccttcaacagatgatgttgaaaactggacatctacattgaaaaaaatgaagttgaatggtttaattgcatcacatacaaaaaatattttaaacaaagtacttagactaagaaaaacctaatgaaactcttagaaaaaaagtatagtgcaaagacatgacattggtcttggcacattttcttagatatgccatcaaatgcatgcgcaacaaagaggagaacagaaaaatttaattgggctaaacttcaaaatttctgcaatcaaataaaacatttaatagagtgacagtgtctcccaagaaatcggtgacaatatttgaaaatcacatgtgataagacttaatattgagaatacataaactactcctagaactagacaacaataattgaattacttgatttagaaatggacaaatgagccaggtgcggtggctcacacgtgtgatcccagaactttgggaggctgaggtgggcagatcacctgaggtcaggaattcgagaccagcctgaccaacatggcgaaacccatccctactataaatacaaaattagctgggtgtggtggcacatccctgatcccagctactcagggggctgaggcaggagaaacatttgaatccaggaggcagaggttgctgtgagctgaaatcgtgccattgctcttgttgcctaggaaacaagagtgaaactccgtctcaaaaaagaaagaaatggaaaaatgattaaactaaattttaataaaaaagatatacaaaggggaagaagcatttgaaaggttgcacaaaattaataatttatagaaaaatgcaaaacataatcacaaaacaaaatcaccttacatcaattaggatggccactataaatttttttaaaacaccaactgttgacgatgtaaagaaattgaaacctatgtaagttgttttttatgagaaaaaagatacagccatcataaaaacatcataagcattctttaaataatctaaaatgaaattattatataatacagcaataccatttatgagtctatatctaaaatatgcaacacagtaaaatgaaggcataaaaggtaccctgcttgcatatccccccacagcaagtgcaagtggggggataaccaagcctctaaataaataaatacatataaaaaattaaacaatttgtaaaaaatttgtaaaaactttaaaatatatttcaaggctatagtaataaaaacagaatggcatgtgcagaaaaatggatgaccaccaatgaaagagaaactactattctcacacatcttagacatgatgcaaaaaaaaaattttaatggtttagagttttccaaaaatatgcagatattagtgtgtccccaaaagcaatggcaaagcagtcagtttgcgcagtccctgataacctttaaagaaaactttggctcacactgtgaacctgaagaaagattattgaagcagaagtggaatccttagagactttaacagcatgaggcaggaggtgtccctatgtgagagcaaaaggaaaaaatgacttgagcttctcagaaactcttttcatcaaaggacagctccccagaccacattttaaggactggctgcctcctttatttgtgtacctctcatctgtctcatctgcttcatttgctctcacctacctgggcgtttggctaccatctcatttctctttatattctgggactctttattttgctccagacaggtgatcaagtctggcttagagacagcaatacctgttttattaagaaaaaaaagtaacatagatcatgctgaattctttaattaccaaattagtattatgcttagaggatataatagaaaattctagaaaattaatattgattcataatagaactttctaaatattcagaaaatattttaaatttgtaggtccttaatttcactactcagtactactgaatcaaaaattggtggcagcaactgaattctaatgtgtgggcaacgatcttttatgccatggcatttttggaattcccactaacctagagcaaaagatacataagctcaggaaaggcaaaagttctggtcaagataaaacatcttgaagaatttgttctacagcaatgaatccccaagattttcttaaaattggagatctaaaattcattcatgcaaagcagaaattaccaaaaacatcttagaaaagagaaaagcaatatattaggaattatgtattgaagttatcctcacccagggagaccaagtttctgtagttctctaacatcacatgtctatataaattccgctgagcacaatccaggcattgccattcctccagagagaattctatagctatgtctctgaatgtcaacagtccctggaaaacaaacaaacaagcaaaaccactcatgaacacacaagcacttaccacatggccataggcagagatttttatttgactcaagttaaaaaagagagtaaaaagaagtggttctcacttacaagagtgactaaaattattcaataagataatttttaacactgaagtattctctaactctgagaaaagaggatagcataagatccacaataccactgtagatttgatacttttctggatgatacattataaaattaagggcatcaacatggacatgtctttttcttttcttctttttttttgagaccgagtctcactctgttgcccaagctggagtgcagtggtatgatcttggctcagtgcaacctccacctcccgggttcaatcgattctcctgcctcagccccctgagtagctgggactacaggcatgagccaccatgactggctaatttttgtatttttagtagagacggggtttctccatgtggacctggcaggtcttgcactcctcacctcaggtgatccacccacctcaacctcccaaagtgctggaatggtaggcatgagccactgcacctggccggacatgtccatttttgagtgctatatttacatcatatagaataagttgtgtatatttctcagatagaagagtcatgatgaattggaagatacctctcaagtcttagtatgtgcaataactaaagatcttgtgagattttgtttcaggagatttcggaggaagtctgaatttctgaatttttagcaagctcaccaatgtttctagcctagtaagaatattttgtcaaatatccagtaaatggcagagtttgggtttttcccagtttctctcacctgtaaataaagataagagccttcatttttaaaagacaaatataagcaaaagtcatctaaaaggaaaggacagcttccagattaaatgcaacggtttatgcacttcagctagtaaatctcctaagtgtccttaataattaagagaataagaattaactctagagtggaaaaaaatgtcatagagatcttgaaccaagtgaataaaattgttatcaactttattaggacacatttttattatgtgctgatgcacacacaacacagcatcactgctgtggcatttctctcctctcagaaaagtaaattataatctacatttaattttattatatatatatatatatatatattttttttttttttttttttttttttgagacagagtctcgctgtgtcacccaggctggagtgcagtggtgccatctcatctcactgcaacctcaacttcctgagttcaagcaattctcctgcctcaacctcccaagtagctgggattacaggtgcatgcaccatgcctggctaattttttttttttttagtagagatggtgttccaccatgttggtcaggctggccttgaactcctgacctcacgtgatccgcctgcctcggcctcccaatgtgctggcattacaagccaaagccattgcgcctggcctaaatttaatcataaagaaacatcagttttatgcaaagttgaaggtgcagataacttccctgttctgcaatttttattagtaattttaaggagtctttccttagcaccctggaaagcaagtatctcctaacagttttttcagaactttctgtataataaatgccaccctgtttaaatgagcattttctaaacgctgttctgcatggaactaatagagcacacagatgaaacctcaatataacatgtttcacttttcactaatctccaaagacaacggtgtttccccaatagaaatcttgagtatccacaccttctaatgttcaacagctacaatgggaacattttatatatcgtaggtcataaatttgtggtaagaattctgcatgatatacaagaatccaagatgaagagaaatgtatagaatgctatggcatagagaaaacaaatatttttttcagaaccccttgactatcataaaaatcacaaaaaatagttgaaacaaactcattagggatcaacagcacgagtagagaagtaaaactttgcaagttctgaacacaaggcattccaaaaggcagagtggacactgcgcttgatctgagacatgctcacctgagaaaaagtgatttgtttcttttcctcctctttctctgaaatgtattttcagataagatgctctggacatatcaaacctgcatcttgagaatatgactttaaagtgcaacctattcacctgctaccaccacacacacccacgggcggaagaccgagacttgcagaaaacattcacccatttttgttgtttataactgaaaagatttaagagcaatgagagaacaatgagcttctccacagctattaaaatataagtttctttgtctctgccctcccctatcagaaaccagcaattttctttagagtaatgggaacatgaaccgcactgacctcttcctaccaaactgaaacagggcaggcagtgcagccttcctttgaggcaaaggttgaactaaactctcctgaatgtatcttgaacccctcaagtttataaatcacttggtaatcttggccccgctctatgcaacgtgattctgcaggatccaaaagggtccaggaatgggcttttacagcaagtcccctgtaaatgctgattgtgctttcccagacacattattagcattagcaagagaaagcaggcacagcagagtcccttacacacaccacatttgtcacaatactaatacttctgctacaaataaaaacaaccaatttccaccctgaaatgctatatttttgttggcttttttaagtttacagggacaacagaagacagcaacgtctgagtgaatctgcacctgggaaacctgtacacatgtactaataaaacgtttactaagcaggtactgtgtgctcaggagcatgtcacagaacactgcgctgggaataacacattttgtgatttaattttcatagcaccctgggagttggtactaagtgctgaataatttttagcatttagattaagagcacagcatttttatttcttcttatctttctcattaattttaaaaagaaaatgtatagaataattcaatacaaaaaaaacatgtgaaaggatgcatttacataaaaatggaataatcagcttccaaatggctattttggaaataatgaaattaaggcagaaataaaatttttgaaactaattacaaccgaaatacaacataccagaatctcagggttagagctaaggcagtgttaagaataaaatgcatatcactaaacatccatatcaaaaagttagaaagatctcaatttaaaaatctaatgttacaattaaaagaatttcaaaagtaagagcaaaccaacttcacagctcacaaaagtcaagaaataaccaaaatcagagccaaaatgaagaagtttgagacataaataactataaaaagttcaatgggccacgcatgtgctgtggctcgctcctgtaatcccagcactttgggaggccagggcgggaagatcacgagttcaggagtttgagaccagcctagccaacatggtgaaagcccatctctactaaaaacacaaaaattagctggccgtggtggcacatgcctgtaatcccagctactcgggaggctgaggcaggagaattgcttgaaactggaaggcagaggttgcagtgagctgagaccgcaccactgcactccagcctgcgtgtaagagtgaaactctgtcttaaaaaaaaaattcaaaggaaccagaagttgattcaatgtaaacataataagatagataaaacactagactgatgggaaaaaaagaaataattcaaataaaaacaattagaataaaaagtaaaaacaaaaacaaaaacagatgcttgtgaggttgtggagaaattgaatgcttatatgctgctggtgaaagtataaatttatttaaccattgagaaaagcagcttggcattttttcaaaaacctgaaaacagaattaccattcccaatcccgcaattgggaacatacccagtgaatgtaagtttttctaccatgaacacacatgcacgcgtatgtttattacagcacgattcacaatagcaaaaacaagaaataatcctgtatgtcttcaatggtagactggataaggaaaatgtggtatgtaaacaccatgaaataggatgcaactataagaaagaacaacatcatgtactttgcagcaacgtcgatggaactagagaccgttatttttagaaaactagtgcaggaacagaaaataaaaaactgtatgttgtcacttataagtgggagcaaaataatgagaacacgtggacacaaataagagaacaacagacactgaggctcagttcagggtagaggatcagaggatgaagaaaatcagaaaacaaatctgttgggtactatgcttagtacctgagtgataaaataatctgtacacaaaaacttcatgatatgattttacctatacaacaaacctgcacatgtacccctgaacctaaaataaaaggtaaaaaaaaaaaaaaaaaatcggctgggtgcggtggctcacacctgtaaccccagcccattgggaggctgaggcaggcagatcacctgaggccaaaagttggagaccaacctggccaacatggtgaaatcccgtctctactacaaatacaaaaattagttgggcctggtggcacacacctgtaattccagccactcgggaggctaaggcaggacaattacttgaacctgggaggcggaggttgtaatgaggtgagatcgcaccactgcactccagcctggaggacagagcgagactccctctcaaaaaaaaaaaaaaaaaaaaaaaaaaaagcatttcttggaaattactatcttgaagaaaatattcaagcctaggcaaccacagcctgccaattaatctctgatgacataaccaagaaatttttacctggatctcacaaataaactacataactgtaccaaaccaattattgaatctggtttgcttcgtcatgaaacttataacagacttttcttcaagtctctcccatggatcacaacccacaaaccatagctgggcactctatgattcttgaatcacactttgatcagattctcatttttagagtgactcccgtacatctctaaaaggaaaaatgaggaactaaggaccccaggaccacagctctttccactcatgaatcttgcaccctgagtcaggattctcccctgatgactttcccatccctgtacaatctgggtgagatgaggcgctgggagtgcagagcaaaccagagaggcctccagtccagggtaaagccactgcagaggaaaaagacagaaatcccagggtcccaggcgctggcccaggcaccatcttgcggctggaggggacgagagccgagctgggccaaagacgatttgggtcgtcaggctctggagctgactgcgagaaagtctgggacctgctacagccactttctgccggttccaaccagcccccacccctctctcacgatgacagacccagcactcaccatttcccggcttccagggggtcccggtcttttagccataaatctgcagatacctgcaggacacaaggacacataggcttggcctctaggagcagaggacacagagcagtgaagagaagaactgcagctctggacgcagaaaaacacaaaggacccgcaaaattacggaagtagcctgttctttccagctgcatgcctgattggacagtttctagaccacggctcctgattggataaggtttcaggccccacccttcatgccctgagtgagggaatatttgatcagacactgggctgagcgaagcaaaaataacagcctaggctgcagccttcacaggcagggcttcttccttgatctgagccaggccaacttcagaggatatttgcatttaaccttgtgtataatgtcatatgcatttataaatgatatataatatttattcataaattgaaataatgacaattattttaaaatttaggattttatgcccttccttgctgcggatcctttgcagtgatatggtgtgactttctggctccacccaaatctaatctcaaattgtaattcccgtccatgtgcggtggctcacacctataatcccagcactttgggaggccgaggcgggcaggtcactagttcaggagttcgagacaggcctggcaaatacggtgaaaccccgtcaatactaaaaatacaaaaattagccaggcgtggcagcgtgcctgttagtcccggctactcgggagactgaggcaggagaattgcttgaacccagggggtggaggttgcagtgagccgagatggcgccattgcactgcagcctgggtgacacagagagacttcctctgaaagaaaaaaaaaattgtaattcccatttgtcagggcagggaccgggcaggaggtgattggatcattggtgtggattatcctcatgctgttctggtagtagtaagggagctctcaagacacctgatggtttaaaaatgtggcacgtcctccccggttctctctctttttccaccatgtaagatgtgccttgctttcccttcaccttctgtcatggtcatgaatttaagtttcccaaggattctgcagccatgtagggctatgattcaatttactttaaaaaaaaaattacgcggtttgagctatttgtctgtagcagtgtgaaaatggactaatacatgcggacagcctgagatttcagaagggaggcaatcctctgcagtaaaatatgagccacatgtaaatttttaattttctagtagccaaatgttaaaaaaaaaaaaaaaaaaaggtggggccgggcgcagtggctcacgcctgtaatcccagcactttgagaggccgaggtggggaaccacctgaagtcaggagttcgagaccagcctggcttacatgatgaaacccctgctctaccaaaagtagaagaattagctgggcgtggtgacaggcatttgtgatcccagctactagggaggctgagacaggagaatcgcttgaacccaagaggcagaggttgcagtgagccgagatcacaccacagcaccccagcctggtgacagagaaactctgtctcaaaataaaaaagaaagaaacaggtggaataacaggtggaattgattgcaacaacttaatcagcccaatatatccaaaatattattattttaatatgtgattactatgtaatggttaataaagcacatacatttttgaagctaaatctctgaatgtaatcttgtattttacctttctagcacactgaagttcacactagccacattccagcaccctgtagctatgtcagaggcgtctgaagcagagaaactgcatctggaataggtgctgggtaaaatggggctgagacctacaggactgcatttccatgaggcccggctttctaagtcacaggataaatagaagattggaacaagatccattttacaaagaccttgctgataaaacagtttgcagtaaagaagccacaaaaatccaccgaaaccaaggtgggaatgaaagggacctctggttgtcctcaggaatcactacacgctaattataatgcattagcatgtgaaagacattcccaccagcgccgtgacagttaacgaatgccatggcaacatcagaaagttaccttacatggtctaaaaagaagagaaacactcagttctgggaattgcccacgtctttcttgtaaaactcatgaataatccaccccttggttagcatatactcaagaagtaactgttaagtatccttagttgagcagcccacattgctgctctgcctggagagtagctattcttttattcctctactttcccaataaatttgcttttgctttgtactgcagactcacccaaaactctttcttctatcttttttttttttttgtctttgagacagcatcctgctctgtcacccaggctggagtgcagtggcgccatctcggctcactacaacatctgcctcctgagttcaagagattctcctgcctcagcctctggagtagctgggattacaggcatgcgccaccatgcctggctaatttttttatttttagtagagattgggtttcaccatgttgcaaggctggtctcgaactcctgacctcaagtgatcctcccgcctctgcctcccaaattgccgggattacaggcataagccactacccctggttctaaattatttcttgtacgagatccaagaacccaatcttcatttctgaattggggccatttctggaagcttcttttcagtgaattacaaaaggatgatactaaggaaacccgcagctcaaaggaaatagactgaattaccaattggctaactttttgtaagtggtggcatacccgggtaaagaatggaatcgggttagtagcccaatttagtggagttagagtgtctcctaagacagataagataaaaggtcccttttaataaaaggcaagaacacttgaaaaacttgtgtttgaggtgcaacttagaaaggttagagtctttcctaagatttagggggttagaggcccctctcagtaaagtccctctcagttaagattagatttggcattatggaatattaaccattgctgtctttgtgtttgtttgtttttttgtttgttttgagacagagtctcactcttgtcactcaggctggagtgcagtggtgagatcttggctcactgcaacctccacctcccaggttcaagtgattctccttcctcagcctcccaaatagctgggattacaggcgcccaccaccacacctggctaatttttgtatttttagtagagacagggtttcaccatgttggccaggctggtctcgaactcctgacctcagctgatccacctgcctcagcctcccaaagtgctgggattacaggcatgagccaccgaaccaggccttatctttgtattaagttgccttgcactttttgctaatggctgtggctgacagaattaggtgagtacagaatcatggaacatgtggagatttttcctccctaaagtgggaaacttgagagcagatgggactgcaaaaaagattctttcacaaccaacaagcggccacctaaacttttgattcggtgcaatgcttgggtctttctctggctttcctcagctcctcacctttcctgccctgccataggcaatctctctctctctctctctctctgtctctctttcctttcctatcttttctgttactctaggccaccatcttgcgcagagatcacatgttgaaacttctggtcagaagtccctgaaacaggccaggcatggtgactcacgcctgtaatctcagcactttgggaggccgaggtgggcggatcacctgaggtcatgagttgaagaccagcctggccaacatggcaaaacctcgtctctacaaaaaatacaaaaattagccagggtggtggcagacacttgcagtttcagctactcagtgggctgaggcagggagaattgcttgaacctgggaggcagaggttgcagtgagctgagttcatgctactgcactccagcctgggacacagagcaagactcagtctcaaaaaaaatactcccaaagaaacaaaaaagaagtccctgaaacaaacaacaacaacaacaacaacaacaaaacaatggatgaagtttccctcttgttttatgttcttgggagcttgaccttgtagccatgtggcagtattttctcttggtttctaccatccagcatacataaattttgaaatttatgttatacttaactctaaaaatgatcttgagcagttaaaaacctttgcaagctcaaaattggctgctggaggcttcttctgggagactccaacggagactgctcagtgctgtagctcagtagttgggctttgctgtctcacagtggcagcctgggttcagggttcaatttctagcttaggagatgagtcctttctgatttgatatctgtgtgaacatttgttgattctcttcccctccatgaaacattttggattttcctttctctgagctacctttgaagattctagattttgtaaaaactgctttgccacctttttgaaaataccttgtacacttgtggttaggttcttaaccttagttaaagcttattggtttcaggaggtggaggtttcagtgagccaagtttggtcactgcactccagcctgggcgacagtgggagactccatcacaaaacaaaacaaaacaaaacaaacaaaacaaaaaaaggcttatttgtttcacctgtgacattatgttagtaaagttcaaaagccagaaatattggcaatttggcatggctaaagtcaagcaatgagagaattaaatacatgttttcagaaagagcatcatggttaaaagctggcttaattattattattattttatttatttattttgagatggagtcttggtctgtcactcaggctggagtgcaatggtgcaatcttggctcactgcaacctccacctcccgggaatcaagcaattcccctgcctcagcctcctgagtagcagggattacagacacccaccaccacacacggctaatttttgtacttttagtagagacggggtttcaccatgttggccaggctggtcttgaattcctgacctcaattgatctgcctgccttggtctcacaaagtgctgggattacaggcatgagccacaacacctggcccaaaagtcagcttaattaattgcagatattcaagctccaacagctagaagtccttagaaaaaacagaggaggtgccacaataggcattttgggagaaacatctgttttcttcatgaaactccaggaattggaagtggatagatccctctcaaagtctaaggctctgttccatttttgctttgcattatctgatggtttttactttctggggtatcagaaattacttcacgttacgaaaaaatttagatatgtaataagtaggtaggaaatatacattcagggatggctaatggcagctatggggggatacttggctttttgcatatttgaatcagagaagtgtgctcttggccacctagaaggcatggaaatgtccccgccccccactgacaggtaagatgccaatgggagatgggctgattccctctttttgggatccaggttctagtatgaaaataggagtcttaatttgcggggtggggggggggggcgcaaatctgttttgccttccagctgtgcctacttattaagctgttgaaattgcttagtttttgctttcctggtcctatttatcctatggatccatcttaaagccagggtggtaatccaattgagaaactgacaaatgaaaaatcttacaggtacttgatcttcttccagctgtgtatttatatgtgttgtgtgtgtaatatgaaggagatttgattaattggtttaaaaataataagagctcaaatcaaatattttatcagaaaaatagaaaccatggtgtattttagtttacatcactttagtaatcattgggaaataaaaacagttttacatgctaggtatgtaaaaaaagtcaaatgtgttttcagtaaaagattacaagaagtcatgggaatgtagattacttttgtcctaaattaaagggtcaaaggattgttttaaattagataaaacagagctgaaggattaaccaagttgtgaaaagttcgtaaaaatttacatctggtaaaagaaattctgtgtgttaacatattggctaaagttaaaggggtattcagttttttataaattgaacactggaataaaagtacaactggttttctttagagcactactctgctctttcacaaaaattgtaaagtattataaaagggttataggaatcttaccttattgtcaaactgattaagactagatagatttgtctataaggttttattaagaattaggtttgacatcaatagtacattaatgcaagggtgagatttagcttttcttcatgaacaagattttcatgtaatattttaaaaatgacatatttttgtctgcccttttgaataaactggagcaaaaggaaaggaaaaaaagattgtgtggaaagtgaagtcttccctctattagtgagtaaaggtttttgtctttttaaaatttttgagttatcattttggttagtgagtgacttatgataacctgggatttgatatttgacaaacctttaaaaaatcaaattataaattatgtatttttcttacctaaatatcttttagatattaggtcctctaaaatacaaaaatgacatttggcttatttcgtataaaaatcaaacaggaggaaatgtcagaaagcattgtcaggccgggtgcagtggctcacacctgtaatccgagcactttgggaggtcaaggagggtggatcacctgagatcaggagttagagaccagcctggacaacatggtgaaaccctgtctctactaaaaatacaaaaaaattagccaggcgtggtggcatgcacctgtaatcccagctactcgggaggctgaggcaggagaatcacttgaacccaggagacggaggttgcagtaagcagagattgcagcattgcactccagtctgggcaacaagagtgatactctatctcaaaaaaaaaaaaaggaaagaaagaaaatattgtcaaatatgaaatggtgtttggttttccttgggctgtatttgtataaatatgttattggtatgtgattcaaaaaaagggaaaattcccataattccaatataacttagtgtatgttattaatagtaataattgttatgtaaaatcattgtatgcaacagaagtaaccaaaatctgtcaattgtagctttaatagtggctgtcctaagacttctttgtcatccacagacaattgttgtcttgttttaacgctctttgaaaggtgatttataatcaggtttaggacgttgacaggtgctcttaaatgcaggtttctgataactttggaaattttggcaatagaataaagaaaaaactttcagaactctcatggagagctgaaatgttcatcaatatcaagcagaacaggagataactgcgtggagtgaactaatgtaagactaaagtaatctttttgactttgcttaaaatattggtgatccattgttttgtttttcagagtcctggaaacttttattttgagctatttacagcttttagcaattgagtaaaatatatttctgtaaacaaaatttggagcacatttgtttctatctgttttctccagaatttggaaactatttgtgagtattcttaacttatggcaatataatttgtataagtgcaaaataatgttttcttctgcaacaggacactgttggagaaattagttattttgccaaggctttggctggaatgacgtgctttcctttaaggaatcaaacttgacttatagagccaataaaagccccttgggaaaactggctttatgccttgtctacacagtccctatacagggttcctaacctggggtaagtaaataatgtcactttttgacaggttcatgagccccaagttatcccgtggtatcaaaaaagaaatttatgcaactcatatttgagggtatagactcatggctggctcagctttaaaaagtcttatctgagattcattttatggaacagtttcatcaaatccaatttttaaaacctatgtaaaaataattattcttgctgcacttcgtacaaataatcaggccaagtataataaagcaacttggtcataccatgatttgtctttagtaaaatggcagactggggagagtaaaaaattatactttaagaactatggtacatctgttattaaattctagatttatctgttgttgttgaacttttttttgaaagaagttgaacctttgaataagccaatgacaagttctaaaattgaggcagtaataaatagcctgctaaccagaaaaacccaggaccagatgttttcacagcctaattctaccagaggtacaaagaggagctggtaccatttctcttctgaaagtattccaaacaattgacaaagagggactcctccctaactcatttagtgaggcctgcatcatcctgataccaacacctgaccctggtggcgctggtggtagtgcagcatgagagggagtggggatggggtttatccacgggccaggggttagaggattccctgggcagcacactgcctggctccattctcttcattttagatatattgggagggtttgacacacagagaaagaggagacccatctcaataaagtgtgtgaataggggacggaaatcaaggaccaatctttggaggaggactgcttgtatctaactctgagaacagactggggcggcatgggattggaggagaggaaggagcctcttaagagaaaggccccaagaggctgggtccctgctccctcccttccccacaaggccccttgagcatcttccacccaggccctgtgagtatcctgtccttccctctgtgtctagaaaatcaaagttctccaggagatgtagccactccaggtggctggaaaaaatgactattttcagcccaaggagcaattttgggtctgctttcagacaatgaagtggttaagtgagaatgagagaagaggacccagtaaattagcagaggggaggaaaagacttttttgtggccagctacagagagcctgtggccatagctccctggccagtgtcaggtcctgttgcatagtgacccctggggcacaaatattccagctgggcaggtaccgggagggagacctgaggtgtgactcctggtagcctcacagctgccttaatgtcctgcagctacaaccatttctgccagcggccgcccctatcccagcaggccagcagctcatccagcacctgtagtgtctgaggctccaccagaatgtgattcaggacatcagccctgtaccatccttgacctagagagtgagccccagggaacaacctcgatgtgggtggcaacttagctccatggtgtctctgttaccaaagaccaattgctcctgctggttgggattagatcccaggacctctgcaggtgatgtgggtgagcatgaggcaggcaccccaatatttgatgctctggggcttaacacctgcacaacaggcaaatggcacccccacttggcagacaccccagtgaaggtcaaagcagccctgagtggggaagactctgacccagagcctggagtcccaccagagaattctcaaaccagcgtctaaaaactcttcctcaaaatggctagggttcagtatttgcagctttgccaacccatgtcaattgcaatgactcaaatctgcagttgcagcgtgacagcagcctcccgcagacaacctgggaatgaaggtgcatggctgcaatctcatagaactttccttacaggcactgaaaactccaatttcaaaacatcaagtatgattcttcttttggtttgttcgaccatttggaaatgtaaaattcatccttggctcatgggagacaggaaagcaggcagggacaggctgcaccttgatgacctctggcagaaatgaagctcagaggaggagatgacaggagggggtgagcccagccccctcacagctgagatttaccccaggaggggtccctgccagcaccaccctacttatccctcatcttggcttcaagagcagttcaggtgaagagcaggggaacagaaaagacctcagcaacgaaaaggaaggagatgcagggttgggcagccatgtggatggatggcgctcaacagtgcatgctaccacagccattgttttttattttttatttattttttattttttgagacagagtcttgctctgtcgcccaggctggagtgcagtggggtgatcttggctcattgcaacctccacctgccgggctcaagcaattctcctgcctcagcctcctgagtagctgggattacaggggtgcaccaccatgcctggctaattttgtaattttaggagagacagggtttcaccatattggccagactggtctcaagctcccgacctcgtgctccgcctgctttggcctcccaaagtgctgggtttataggcatgagccactgcacccagcctaatttttatatttttagtagagatgaggttttgccatgttggccaggctggtcttgaactcccgaccacaggtgatccactcgccttggcctcccaagtgctaggattacaggtgtgagccactgcacccggccaacagcagccatttacaccaagttgagcaaggcatgaccatccccagggggaccatggtgggggctctgtgggatagaggacatgctgtattctgcacttatatggacgctccacacagcagtcattacagaaaacacaccgggtaaaagggcagtatacaaataggacaccagtactggccagttgggtctcactggtcagtggggtaacgaggtccaggtgggcccacaaggtgtggctggtggtcggtttctgtctgcaggaagcctgggacccgtgtctaacagaggaggacccaggctggagtgaggaagtcatcagagtcaccaggtgaggggtcagagctggaaacagagcaggcagggagccctggcctctcccagtgagggctgagaagctggggtgggaacacaacccatgggcagatgcacacaagtggtccctgggcccctgccggtgcccagtgactgcccagttcctagggagccactgaggcctgagacccagggacacaccacctgatcatcacccccaggcctttctgccgagaccagacaatgcccagtgcaggcaggtggtctgggattggagtctggggcaggggtgcatgttcctacctggcaggtgccctgacctagacctgcctgagctggctgcaccatcacttgttattctgcctatgtatggcctagattcaaaggtccagctgtccattctggccacaccattccctggctcctctgccaggcccaattgtgcctgacctacctaagccagccctacctgcccagtgatcacaagaatcctgccagccagaaggactcacttttttcccctgaaatatccacaagagcctgtcttttttatttatctatttatcgagacggagtcttgctctgtcacccacgctggagtgcagtggtatgatctcggaggagcctgtcttttgcaggggccacagctcagggccagctttctggaagccccagagtcagatgtactcctgtcctgacttccagccttccagtactggctatcatgtcttttggggaccactcagcactgggagctgcctgaggcccccacatggcagagaacatgctggtcatgacagcctcagcccaagaccctggcccaagagcaacagccagttggttctagtgtctggatggtgacaacaggtgaagccatctgcacaaatactgccttcaacctggtccagtgacagactaggggagccacagagcagcccccaggccagccctgcccagtgtttccatcagtgtggcatgaaaaaaggaccctgtactcagccaaaagctgagccctgacctgcccacccaccctgcccacgagggactctgacttcaggcagaggcaggcagcagagctgtcaacttctgtgattctatcccagggcccacaaggtcctcaggagacccaaaaggagctgagctgggggagtcagggaggggcctgctgagtgaagggcagcgtgggcctgggcgtgagtcggcactaagagcacatggcctggctcccactggagaggaggcagcaggggagagtcctgcagagccctcacacactccactcagctcccaggtacatgtagtgcccataagcctcccaggagacccagaaatggttctttcttggtcaagaaaagaggcaaccccacccatacccacacaggccctgatgcccacacacatcagagaacaaagcttttgtgcccagggtggggcaaagggggaatatcccctccttccccctgtggatcccataacacttgctcctcctggtgctccacccccaccccacagggtgctgactgcaaccaaagcgccccatggaaagaacagcccatggatggagcccaagaggcgctatgtcctgaacgggccgtgctgggtctaaggtgatatttcccaatcacagagtctctaactttgccacccactggccctgtgcttccgcttcccttggtggcccagggtaacaatcccactctgaaggctggaggacccacagaggcaccacccccagttaaatggctgcattgtgaaaggggatgcacaagagacatttcctgccttgggtctcttgcctcaggactgatgtgcatcaggccacggccaggccagcctgctggagagggctgcgttccctgtgctctgtgtggggaatggtgttcacagttctgggtcactaccgttgactcccccaagacacgggggcagatgtgctccattatataagccttgggtcaatcccagagaatgagcatcaaattcactcctgtctgaagctggctgccccaaggcatttgggttttggggtgagataagggtctggagtcagcatcaaagtgttctggttttggaaacacatgaagttctctgcagctctctgaggtacaggaaatggtgctaggtctgtgctttaaaaaagcctaagaggagggggtgcctggaaggaatcctgaagccaagggtaagggtttccacctttcctacctccccaccagagacattccacaaagtctcatgacaaactcagaataggaaaaaaaaaaaaaaaaaaaaaaaaaaaaaaaaaaaggaggcggggtgaaggaaagtggaggggagggagggggtaataagagattacaggggatcatctggcccaatcctgaaacacccctgccatatgatgccctatcagtcctctcagacagctgaggaatctgaggtctggaggaggcgcctagagcctcgacaggcagctggcagcctggagcccctgaggtccaggcagattccgccacaagcctgagccagaggcagcgggaccccagttcattcacttggaaatcactcaagttgactgggccactgcccctccccagaccctcccctttcccttgtcaggcaacagccttcctgcaaagctgccaggctagggatgaggatgcctcggtccccctaggaattggctgtccccagggtgcaggtgcccggcagctgcccaccaggccacttctctctgcttactgcctggagcctggagcgcatgtgaggagcaggtggctcacggagcgcttagcccggccgcgtactgtaggcactgcattatgggtaccatggtacccctgcaggttagggttggcatacccttccccggctgaccccacaaacccttctcgaagacccaccacattccacctgaccttgacagccaggggccccacagccctgggacattggcccgctaccctcctccttgcgttcagcacccctgggggggagacccattagctcgccaggtaggaaagcagggtgggggcagtggtgacactagagggtgtcaccttgttgtgccgagcactggcgggggctggacatgagctcacacactcacactcaccctccaaagtccaacctcttgctttggccaaagctggccagaaactagggcctggggacagaggagatagacgtctccgtgccggcttcctgcagtgtccccacggttgggtgtcggttctgcccctgcaggtgccacatcaactgctgcacccaggtggctccagccgccatcttcaggaagcgggggcagcaaaaccgggcactggccccacagtgccactcacacctggcaaccactttccacccaggcgcccgttccgcctcctcaaagcctcaacccgctgaacccaggcctttgccttgtgctggctgagtctttcttcacctgctgctctccaggagctttgaggaggcgctggccacaggggtcacagccaggcagagcacaatggtgcaggctgagacgcccaaggcggagaggggatcttagcatctttaactggtgccctccactaccggaaggcatgctgccccccaggcccgtctatggcacccgcagaaggagggttatgagaagcaggctgctcattataactccagttctgggccccttagacgtgggatagagggggacaggcagagctgggatgtgactgtaatggagatgggtctgtcgagggctggctgggagctccagcctcctctctccttggcagggggcctgaggcccatccgcagctctctttgactccttttattctgcagaacacccagaccccagccttctcatgggaatcataagacgcatgaggcccagggttctttctgcctcttcccaaccatggtctttgtatttcccccaaggagtgtctaactccttgaacagaattgcggcccagagatctgtatgctgtagtcattgaaatatgccaaggttctagaaaagcaaccacacaaaatgaagtgcttaatatttctatgttaaatgaatgaatcccaaccagaaccttcttagatatctgaatgggcacaggaccccttttccagcactcagggaccctgatctgtctctataactgatggcgactagctggaaaaaagaccgtcacactttctttaaaatggaaaacagattattaatttgtcttgatgaataaaacagatttgctttctatgcgctattttaaatacagtgtaaaaaacgtggcaaagcctttattgttcacactttactcaacatcagataattcatgctagagaaacactatacacgtaatggatgtagaaggagtttgatttaaaatataaaccttagaaataaccagaattcatacggaattcttccatagggaaacttttcagatgcaataaatgtgaggaagtattcaaaaatcaagtctaaataaacatcggagaatttccacgagaaagtacaaaggcactacaattttaaaactttacattaaacaagaatatctaatatagagactaatctaaagtcaaaacaattagataatttatttgtatgtttcaatgaagcaacggctttgtatttgaacaggtataattatatatcaatggatactcgttttgtattgtcattatttgctttttttttttttagaaacaactattattgatgtaattcaactttccattcagttgaccctgtccctacattcctagtgtttatatgaaaacatgtgacctactgttgctgcatcagagctgggagaggccattctacatgaatttctccatggaaccttcatggcaaacgtaaaattaagaaataaaaacaaaaataaaactgccaggcactgtggctcatgcctgtaatcccagaactttggaaggccgagtcaggtggatcacctgaggccaggagttcaagattagcctggccaacatagtgaaacctcatctctactaaaaatacaaaaaattagccagacgtggtggcaggcacctgtaatcccagctacttgggaggctgagtcaggagaatcgcttgaacccaggaggcagaagtttcagtgagcagagattgcatcattgtactccagcctgggcaacaggagtgaaactctgtctcaaaaaaaaaaaaaagaaagaaaaaacaaatttaaggagagatcctctttgtggtttacttaaagtctgcatgagggaggtgttctggaagttattcttctctattaaagcaagagtgaaaaatcctgaatttctgaaataaataattttaccaatcatctctccttgaaggataaaaaagctggccagtctattaaaataccagtgtattatagtaaaagtttaaagtcttgaatatcattcagtgtgataattttttaaaaaattacagataccagagaaaagtaaagataacacctccatgagaggattttaatgtgttttaaatcaatgtttcctaaataattaaccttagtctttaaaaatggagaaaggaagtatctaagataattacatcagagaaaaaataatgcttattcagtgtttgtgactgtattttcaccaagaagaatatagtggattttggaatgccttacttagactatgtgtgaacttagttttaattaataaactaaatggttttcaatgttttgacactgatgtgcaataaatgaaatggtatcctgccaccaatgttaaactattttctttaatcaagataacaatatactattgagtaacacagtgaaatgacttatttagtaatcatttgttcagagaacttaaaacaaataatttggtgactattgttgtcaaaagttttatttcattttttttaaccttttggtaactacaggaagattatgccagttatgataaagatcatataggaatgtggttggccaggtgcagtggctcacacctgtaatcccagcactttgggaggccgaagcaggtggatcaagaggtcaggagttcgagacctgcctggccaatatggtgaaaccctgtctgtactaaaaatacaaaaattagccaggcatggtggtgcacacctgtagtcccagctacttgggatgccgaggcagaagaatcacttcaacccgggagacggaggttatagtgagccaagataatgccactgcactccagcctgggtgacaaagtgagactctgtctcaaaaacaaacaaacaaacaaacaaacaaacaaaaaaagatataggaatgtgattggaagccataatttctgaattttaaattattatttataaaaatttactgaatgttggctgggctcagtggctcatgcctgtaatcccagcactttgggaggccgaggtgggtggatcacgaggtcaggagctcaagaccatcctggccaagatggtgaaaccctgtctctactaaagataaaaaatattagctgggcgtggtggtgtgcctgtaatcccagctgcttgggtggctgaggaaggagaatcacttaaacccacgcagcagagtttgcagtgagccgagatcacaccactgcactccagcctgggtgagagagcacgactctgtctccaaaaaaaaaaaaaattatcatcaaaaagtgggcaaaggatatgaacagacacttcttgaaagaagtcatatatgcagccaacaaatatgaaaaatttctcatcattactggccattagataaatgcaatcaaaaccacaatcagataccatctcatgccagttagactggtgatcattaaaaagtgaggaaacagcagatgctggagaggacgtggagaaataggaatgcttttacactgttggtgggagtgtaaattagttcaaccattgtggaagacaatgtggcaattcctcaaggatctagaactagaaataccatttgacccagcaatcccattactgggtgtatacccaaaggattataaatcattctactataaagacacatgcacatgtatgtttattgaggcactgttcacaatagcaaagacttggaaccaacccaaatgcccatcaatgatagactggatgaagaaaatgtggcatatatacacaatggaatactatgcagccataaaaaagaatgagttcatgtcctttgcagggacgtggatgaagttggaaaccgtcattctcagtaaactaacacaagaacagaaaacgaaacattgcatgttctcactcataagtgggagctgaacaataagaacacatggacatagggaggggaacatcacacactggggcctgtcaggcgggtgggggggctaggggagggatagcattaggaggaatacctaatgtagatgacgggttgatgggtgcagcaaaccaccatggcacgggtatacctatgcaacaaacctgcacgttcttcatccatgtccctgcaaagaacatgaactcatccttttttatggctgcatggtatttcatggtgtgtatgtgccacattttctttatccagtctatcattgatggacatttgggttggctaccattcaggacataggcattggcaaagccttcatgtctaaaacaccaaaagcaatggcaacaaaagccaaaattgacaaacaggatccaattataggttttaaataccacattctgatcacttaattgaggtgagagaaaaataatgcaatagtccagagcatcagatcaggcagtcagcactgtggcagatgtggagacagattaaacatgatgatggtgtccttcttagagaggtaaatgaggcctattccaaatatatgtgtgtgtacatatatatatatatatatatatatatttatatatatatatttatatatatatatttatatatatatatttatatatatatttatatatgtattaatatatatatttatatatatatttatatatgtatttatatatatatttatatatatttatatatatatttatatatgtatttatatatatatttatatatatttatatatatatttatatatatatttatatatatatatttatatatacacacacacacacacacacacacacatatagcagacgcatttgaaatttggggtagaaattgaagtgagctctctgtaatcactctgaggtcttaggatagctagctacaagtggtgtcatcacgtgaacaaatgtgacagagatgagatggggacttgggaaatataagtttctttttcttttcttttctttctttctttctttttttttttttttttgagacagggtctcgctctgtcacccaggctggagtgcagtggtgtgatcgcagctcactgcaatctctgcctcccgggttcaagcgattctcctgcctcagcctcctgagtagctgggattacaggtgtgcaccaccacgccagactaatatttgtattttcagtagagacggggtttcaccatgttggccaggctggtctcaaactcctgacctcaagttatccacccacctcggcctcccaaagtgctgggattataggtttgagccaccgacccggcctaaattgagacagctttagaatgttaagcagtgatagagtttggatgagtttccccgcccaaatctcacatcgaaatgtaatccccaatgttggtggtggagcctggggggaggtgatcggatcgtgggtgcggatttcttctgaatagtttagcaccatccctcctggtactgtcctcccaatagtgagtgagttctcaggagatcttgtcatttaaaagtgtatagcacccccgttgcctgctttacaagctcctgcttccccttccaccatgattttaagcttcctgaggcctccccagaggtagatgctggtgttttgctttctgtacagcctgtagaaccgtgagccaattaaacatcttttctaatcaattaccgagtttgaggtgtttcttcatagcaattcaggaacggattaatagagtttatttgcacaaacagcaatttatgaatcagagagcaccaagttatggtttctttggaggctccaaggagggtcttgtaaaaaaggtttttgtaaagggcatcagaaagaaaaccaaattcaatatctgattggttacagttatatattgcatttgcacccatcaggtggaaatgtcttggtcgtgtaatgagagctttattggcagcttgtggttggttaagcctaattttattttctcaaagttagtaatttacaataaattcctttgatgtagttaggtttccttaggaagaatcccagggcagcatggccacttcagtgtaagtgccagctattgaattattttaaccctccacagagggcctggttttcctcgcatttttcaaatgtatggcaagcagggtctcaaatccatgactgttctcccagcctaactgttctaggccctgtggaaaattctaactttccaattcctttcccacattcccaaatgccaaccgttcttctccaaatcacaacattatcaactattagtcttttatttagttttaaaacagacacagcattttaattgtttatttttgtttcacggcgtggtggatggctcttctaaaaatatgtgtctgtttgtgaacatttcacatgacagggaagcaaagggtaatcacctgacactctgctgtgacaagtcttcgcgcgtctaattttccctaggcacacacaccttaccagaatatctctgggtgaaggtttctttttggaacctttgcagggtgatgtgtcctcagccactgtcctgttttttcctggttctgaatactacaaccgtctggggatgacccaagatacccacaagagccatgtctcttggagtgtctagtaaatatcagtccttctgtcagcttccagaggagagtctgagatattgggtggagcctctcagagaagcagctggatgtcctcatgctgagagcagtttcctgatataccattcctctaaaaagctaactgcttaaacattaaaaaaatttttccctcagacccagcttttattcctcgcagacatattggtggtcagccaatcaggtgctggtattgaggggaaaaggcgcaaatgcatctttccctcttgtttctctcacgcttgtgaaaggagaatatccctaagtagaagtaaaacccaccctattgaggtagtgtatgaacttgcaaagccaaatacacatcagacacacagggagcaagtgcattgtcttctgagaaggtggtgatcaagttctttagtgagcaggatgtggggaggagattctctcaagtgattgatacatgaatccaatatgtctgtgttccagtgtggtgattcctcaaggacctagaactagaaatcccatttgacccaacaatcccattactggatatacacccaaaggattataaatcatgctactctaaagacacatgcacacgtatgtttattgtggcactattcacaatagcaaagacttgaaaccagaccaaatgtccatcaatgatagactggataaagaaaatgtggcacatatacaccatggagtactaggcagccataaaaaagggtgagttcatgtcctttgcagggacatggatgaagctggaaaccatcattctcagcaaactatcacaaggacagaaaaccaaacaccacatgttctcacttacacgtgggagttgaacaatgagaacactgggacacagggcagggaatatcacacactggggcctgtcagggggtggggggctgggggagggatagcattaggagaaatacctaatgtaaatgatgtgtcgatgggtgcagcaaaccaacatggcacatatatacctatgtaacaaaccttcatgttgtgcacatgtaccctagaacttaaagtataataatgaaaaaaaaaatgtctgtgttccagtcagcaccgcctctccaggtgttcatcaccttgaatatatttgttcagttatttcaacttccgcctttcattaaccatatactgtatttcatcattagagcttgaaagataaaaaaacacaaatgttttctaagagaaaaacaggtagatttgagagaaaaaaatcatattccattggttaaaaattctcaggtactgcttttattttgcagagtgagcgtagtaagattctgagttctgttctgttttagcatgatttcagacagagtcgcaggacttggttttgggaatgctaccttggaaaagaaatagagaaaatgtctctctctttatgcctgcataaaaataaatacatttctacaagaaacttacagattaacacatgaattacaaacattcatgaaaacgccagttacactcttgtgcagggtggagaacttgtgacagttggtaactcatttttttctagatgaatttctacttcatagggaatatttttatatatatgataaagaagtatttgccactatgcatacacctctttgctcagctagcatataacctaaagcaatatgattgtctagtacaagcttagccagtgaatcagtagcatttttgttgagctacaatgaatacaacagttgcatctgtaattttttccaaggttataaaaatattttaagtcatgtgttcatgggaacaactcaccaaggcaaaagcatttttccagtaaaatgcataaagctgttttcctgaaagccaggcagataattagcagatttcctccaaatggagtcttcatctaaaacagattggtggccaagcttggggaaaagtttgagagaatttgtccagtgctgggtttcttcggagctgtgtataaatagaggggtgaccaaatatcctaaaagacattgcccttcaacttagcagcacaggtagtggccaagaaaacctaatatggttccttccaacaggtttgcagggtatctgtttcttcatagaaatctggtttaaaagaaaaactcaaattttatgattgtatttttgtatgattagtattaaaactaattttaagaaaaaccttataaataggtgtatctaatctcaatcaactttgacaatataagacttctataaaccttttataactcttttaactcttttctctttttttattctctttctccaactttttatatccatttagtttatctctcttttttattttttgagacagagtctcactctgtcatccagaatggagtgcagtgcaccatctcagctcactgcaacctctgcttcccggattcaagcgattcttctgcttcagccccctgagtatttgggactacaggcgtgtgccaccacgcccggctaattttttttttttttttttttttagtagaaaaggggtttcaccatagtggccaggctggtctcaaactcctggcctcatgatccacctgcctctgcctccaaaaatgctaggattacaggcatgagccactgtgccctgtcgagtttatctcattttctttggcttttattctttcaattttatgcaacctttaaataaactctaaactcaccaaaattgccttttaagaaaaaatcacatcctcatgtctcctttttaaaataaattttttcaccaagaaacacatcttattttctttgtacactctatgtagaattgtttctcttcttaacaatagttttagttatatcttaaccagaattttaattcttagtaattttaactcatagtgaaattctaagaagtaagcaattttaactattagtcatatactaacaatttatgagtacatattttatgattttttagaaacgtaggattttaaatggaaacatctttttttttttttttgagatggagtcttgctctgttgcccaggctcgagtgcagtggtgcaatctcggctcactgcaacctccacctcttgggctgaagtgattctcctacctcagcctcccgagtagctgggatcacagacgagtgccaccatgcccaactaatttttcgtatttttagtagagatggggtttcaccatgtttgccaggctggttttgaactcctgaccttaagtgatctgcctgctttggcctctcaaagtgctgggattatagccgtgagccactgcgcccagcaggaaacatcttttaacgtggaacaggatgtatttacttacagatctaaatatcttttgtttttgtgaaataaacctttaagaaaactttataaataggtgtatctaatctcaatcaactttgaccatacaagataagatttctataaaccttttataactctttttctcttctctttctccaaatttttatatccacttagtttatctctcttttttattttattttttttatttttagagacagactctcactctgtcgcccagaatggagtgcagtgcgccatctcggctcactgcaacctccgtctcccggattatatatataaatttgagatggagtctcactctgacacccaggatggagtgcagtggcactatctctgctcactgcaacctccacctcccgggttcaagcgacttgcctgcctcagcctcctgagcagctgggattacaggttcccaccaccacacctgggcaatttttgtattttcagtagagacggggtttcacgatgttggctaggctgctctcgaactcctgacctcaggtgatccacccacctcggcctcatttaagttaatttgatatcatgtagataatatacaaacacgtagatagacatatacatacatgtagacacaaaatatagcttacacatgtatgtatctaaaagccctagagatgcaggagttcattgtaaaagagtagagcttcagacctgagagcaacctgtccacccacaactcttggggctccatgaggaaaaatagaggtaccctgccaaagacggagaagcctgtggtgctttatctgtgttcttcaaggggtccaaggctgctagaagtttcctttaggttctctcacatggtaccaaaaggtcgcaaaaggaagatgagatagatagaagtaaacagaagagttaattctagaaaaggccgtttgagaagatttaggtttccaaaaagccagtaaagttttacattatccttggcaaaaatcatgtgagcaagagaagagacagagggagcacacatagttagcatgagtttagggaaagaggaattgagttgactgagaagcttatataaaaaaacccacaggcctcaaattaatatatacataaatagcctgaatatcagttataagtggacttttgactgtagagctcttaaattttttaaaattaaattttagccaagtaaatagcaaacattacttgtttttttctttctaaagtttacatcaagatgaaattttggaggtgggacatttctgtttactggaggtctagggtaattactatttaaagctgtttgtcttcggaaatttttagtaaatgttttctatcttccaaaccacagtatatggttttatttatgtcaggagagaaggttaaatgaaaaaaacaaaacaaaacatttctgtcacactctaaatatgaaccaaaattttaaattaaaggcgtacctgaactagtgactcaaaaccaacacaaataaacatgtgtgagaccaaatccaagaagtcatgcatggctttaactaaagctccaaagagagcacaaaaagcgtagcttttccatgattaaaacacctattaaaaacagcttcctgcaaatggggtgcaatctacattttcaggccacatattctagtgtctcaacttctcagtttaccatcaacccacaaaggccagtcagaagatggaaagcaatggtcggtaaaacagaagaacaaaaaatttccatggggtagaaaaggttccaaatgtgtactccaaaagtccgagagtcatacaaatgatagaaaacaaataaattcatcattataaatgtttcttgcctaagctagaggtactaaccgagaaataaaattttgagggtgagtctaaaaaccttcaatttttttttcaatttgatttcagctgcaatgctgttttgctaattacctggatgttaacatttcaaatacgtggtaaggtttacatctttgagggactgagaaaggcctgggaaaggttaaagtatgtgttgtaaatcctgcagcaaagtcaagcaggcaatttgagcatgtaaagggttttcttgaggcagtgaaagaagagccctctgaaaatgttatgtagttattatacagttaatagttattcaacttggtctttaacttgtctgtggctggatgttgtttatgggttacactctaattcacagtttcagatgtcatttcacaatgtctaaaaaatatgacctattgaatgtctactttcatgaagttactgacataattttgcatccaaaattttaaaattttaaatatttttctatggaatttgaaaataatatgtatgctctttatactacttaataatgctatccatttgttcatataataactaatcaaactgtcttaaatgttaatgaacactctttatgtttacttatttgttgtatataaaaaaagtttattttttgacagtttaatgtcacctaatattatttttaatgtttcaatttctcatttacatgaatgtttgtgttgtttattttagtcttacaggtgttatttaaactgtctgtgcaaatgccttggaatagtgcgtaacacatcgtgaattctatgtacgtgttcagggctgtttcatcacattttaatctgtcatacccttcttcatttaccgtcattttgtgtttgtccttattcaaattatgtttgtgccttgacttgactacatattcatggaagagagaaggtagactcagacttccatccggattaagcacaaagttaactaacatatcttcttagctcactttagatagaatattatatttgttttataatataaatatgaattttaagtactgcatgaagaataatcttccccatcttacaaaagaagatcatcagacattggatcattcatgaattacccaaagctgtattctctcaacaattctttttattcttacatcttaacctccatgaaaatctagaggcatgaagtactagaaattagaaacaaatttgcagaaaagcacaaattctcaaaattaatccaagaagaaagagaatatattaatatacttataacaggtaaagacattgacaagattccttcccagaaaaaaggctcagatagcttcactggtaaattctactaaacatttaatgaataattaataccaattctacacaaacacttgcaaaatgtaaaagggaaaagaaaacaattcatttgttgaggccggtattacccagtaaacgaaaccacatgaaagcataaaaaaaaaaaaatgagagaccattattcttcataagtatagacccagaattttttttttgagatggagttttgctcttgttgcctaggctgcagtgccatggccccatctcagctcactgtaccctctgcctcctgggttcaagtgattctcctgtcagcctcctgagtagctgggattacaggcacccgttactatgcccggctaatgtttggtattttttttagtagagacggggtttcaccatgttggccaggctggtctcaaactcctgacctcaggtgatccgcctgccttggcctcccaaagtgctgagattacaggcatgggccaccgcacccagcctagcagtctttaaaaactctagaaaactgaattcagcaacacataaaatgttagacaaaatgaccaagtggaattatctcactaatgcaaatatcagtcaatgtaatataccatattaatagaatagaggacaaaaccataattatttcagtagacacacaaaagcattggataaaatccattactcattaacaataaagcctccagaaatctaggaatagaaaaatctgcttaacctctcctacagggcatctataaatctttcacacattccagtaaaatataatagaggacatattggtatgtcttactttatggttttaaaaattaacaacgcataataaagataatgtatttacctagaaaacaaacacttttctaaaaacgtttctattgcatgtgataaaagtggaaattaagataaaaaagagtagtactgttgagaatgactaggatttggtatcattaattttcttattagcaattaaaatagtatcaacaattctaacaagacacaggtgcattctccccagcaaaaaggcatgatgatcacataaaatccttatgttatacataacagaaagtattttatatttgaaacatatggcaacattgtcataactacattctactaaaaatgttgcacaatacatactccaaaaaattagaactttccttggggacatatggtttttctaaagataattgtgttcattattctgataagcaattcctccaaaggtaaatgtggctatctgggattctgggaatatcctgaaaagttacatgttctaaaaatagttccattgaaaaaaaacaccataaagcctagacaatgtagcaagtgcttaactgcagagtttagttctaagtgctaaagtaaaaaaaaggggctgggcatggtggctcacacctgtaatccaagcactttgggaggctgaggtgggcagattacttgagttcaggaggtcgaaaccagcctgggcaacatgatgaaaccctgtctgcccctgaaaatacaaaaaaaaaaaaaaaaaatagccaggcgtggtggtgggtgcctgtaatcccagctactcaggaggctgaggcaggagaatcgcttgaacccgggaagtggaggttgcggtgagccgagatagtgcaaatgcactccagcctgggcaatagagtgagactccatctcaaaaaaataaaacaaagaaagaagcacaggcagcagaaagaagggaggatgagacagtccatctggcagggtgaggcttcctacaataggttgataataataggggcatcatttcttgggtttttacagctctcaggggtagatgtggtgccacactagaatcaaagtaagggagatgaacctgaccagcctaactaaagccaaaggcctcaaggttctgcaaatctaagaaaaatgagatagaatatgaagcctgcagtcaaagtgagataaatagggaagctagtcagtccgtgccttggctgatttgggaaggaaggccaactgtactgatatgttggggtttgaattgacccggagtttttatagagaaaaatttaataagttaatttaaatgttttcagattcatgtagagaagaaaacaaaaattccaagacaattttttttttttgaggaaaaaaccctcaacccaaaaaactgaaaatcttatcagttcaggcttgtcaagtataatcacacaacgtaatttttttaaatatgcaaaataaaggacacaaaaattaattttgttcaaaaataacaacaatcataaaacacttgtaccagtagacttcaaggaattccgagcagacgtacagaaaatatgtaagctaggcatggtggcgcttgcctataatcccagcattttgggaggccaaggcagtagaatcacttgaggccaggagttttaggctagcctggtcaacatagcataacgtaatttctataaaaatacaaaaataaaaatatatacatacatagttaaaatatttagataaatataagggatatgagcaaagtaaaaaataggagctaaagtataagaaaaagaatgagctaacaatgccaggtgcggtggctcacgcctgtaatcccagcactttggaaggccgaggcaagcagatcacgaggtcaggagatcgagaccatcctggctaacacgatgaaatcccatctctcctacaaacacaaaaagttagctgggcgcggtggcatgtgcctgtaatcccagctacttgggaggctgaggcaggagaattgcttgaacccgggaggtggaggttgcagtgagccaacatggcgccactgcactcaagctgggcaacagagcgagactccgtcaaacagaaaaaaaaaaacatagatgtcaggacaaggagaaaaatgagtggaaaatatgcaagtcagaataagttaaaaatgaaataagagtgctatgtctaatggtttgttgttgttgttgtttggttttggtttggtttggtttttgaggtggagtctcactctgtcgcccaggctggagtgcagtggcacgatctcggctcactgcaacgtccccctcccgggttcaagcgattctcctgcctcagcctcctgagtagctgggactacaggcgccggccaccacagcccagctcatttttgtatttttagtagagacaggtttcaccatgttggccagtctggtcttgaattcctgacatcaggtgatccacccgctttggcctccgaaagcgctaggattacaaatgtgaaccaccgcgcctggccttgtctaatgattttttgaacaaaatagggaaaatatggcatgcttaaacattttgaagaactaataaaacatcaaccaaggaaagtacaaaaaatatctaaaaacatcataataactaaaaagcttaacaccaaaatgatttaaaatcattgaaatataaaatgtgaatcaactacaaagcaacaagagatttttaacccatatttggcatcttcatagaattcacaaatcaatggatattatgttcaaagttctgagttaaaatatctgtcaattttgaattgcatccctagttaaaaattttttaagatcaaagataaaatgtaaaataattcatataagtaatacaaactaagtttacttcagttatttacttgtttaataaacttattaattacattagtcattacataaataaaatgctgcttcctattgtgaaacatataatttgtgaagcatataatgttcaaaattttgtctctaaaacaggtaacattttgaatgaagagaacaaaaatttaatgattggtataaaaataaatttcaggaaaatgaaaggtttgtatgatgacataattaacataatagaaaggacagaaatctcaatatttgtttttacacattttggagggaaagtaaccctgagatattaaagtgcagaaaataatattaattatattcttgagttttcaaacccctctttccttggtacttacagaacatccagcacaggcccaggattccctgggtgtttctgccaaggagactatccagcggaattaaagcggaaagccatgtgcacaaagatggatggatgctcacctctaagagatcagtgggtgcaggttgcagagggagttgggtgagtgcagtttttagagggagttgtgtgggtgcaggttgcagagggagttggcccttcttggaggtccagggaggggctacaggcaccatccttgaagtgggtcctggaactccactgagccctcctgcctacaggggccttagagggtcctgggggaggccagcctgggtgccctgtcctgtccgtggcccctgagtcctacctcacccgctagctttttttttttcttacagaggaatcagggtggcaaccccaatgcagccttgctagaggaaggatatcaaaagtgtcagggtgatgggaatagcattaaatctatgaattactttgggcagtgtggtcattttcacgatattgattcttcttatccataagcatggaatattttttccatttgtttgtgtcctctcttatttccttgagcagtggtttgtagttctccccgaagaggtccttcgtgtcccttgtgaattgtattcctaggtgttttattctctttgtagcaattgtaaatgggatttcattcattatttggacctctgcttgtctattattggtgtgtaggaatgcttgtgatttttgcacattgatttcatatcctgagactttgttgaagttggttatcagcccaaggagttttggggctgagacaatggggttttctaaatatacaatcttgtcgcccgcaaacagacaatttgacttcctctcttcttattcgaataccctttatttctttctcttccctcactgccctggccagaacttccaatactgtgttgaataggagtggtgaaagagggcttccttgtcttgtgccagttttcaaagggaatgcttccagcttttttgcccattcagtatgatattggctatgcgtttgtcataaatagctctcattattttgaagtatgttccctcaatacctagtttattcagggtttttagcatgaaggggtgttgaattttattgaaggccttttctgcatttattgagataatcatgtggtttttgtggttggttctgttaatgtgatggattacatttattgatttgcatatgttaaaccagccttgcatctcaggaatgaagctgacttgatcgtggtggataagctttttaatgtgccactggatttggtctgccagtattttattgaggatttttgcatcaatgttcatcagggatattggcctgaaattttctttgtttgttgtgtctctgccaggttttggaatcaggatgacactggcttgataaaatgagttagggaggagtccttctttttctgttgtttggaatagtttcagaaggaatggtactagctcctctttgtacctctggtagaattcgactctgaattggtctggtcctgcctgggctttttttttttttttttggttggtaggctattaattactccctcaatttcagaacttgttattagtctatttagagattcaacttcttccgtgtttagtctcgggaggatgtatgtgtccaggaatttatccatttcttctagattttctagcttattttcgtaaaaatatttatagtattctctgatggtagttcatatttctgtgggatcagtgttgatatcccatttatcactttttattgtgtctctttgattcttctctcttttcctttttattagtctagctagtggtctacctattttgttaatcttttcaaaaaaccagctcctggattcattgatttttttaaggcttttttcatgtctctatctcctttagttctgctctgatcttagttatttcttatcttttgctagcttttgaatttgtttgctcttgcttctctaatgcttctaattgtgatattagggcattgattttagatctttcctgctttctgatgtgagcatttagtgctataaatttccctcttaacactgctttagctaggtcctagagattttggcacattgtgtctttgttctctttggtttcaaagaacttctttatctctgccttaattttttttatttacccagtcgtcattcaggagcagattgttcagtttccatgtagttttgtagttttgagtgagtttcttaatcctgagttctaatttgattgcactgtggtctgagagactgtttgttatgatttcattctttttgcatttgctgaggaatgttttacttccaattatgtggtcaattttagaataagtgctatgtggtgctgagaaatatgtatattctgttgatttggggtggggagttatatagatgtctatttggtctgcttggtccagagctgagttcaagtcttgaatatccttgttagttttcagtctcattgctctgtctaatattgacagtggggtgttaaagtctcctactattattgtgtgggagtctaattctctctgtaggtctctaagaacttgttttatgaatctgggtgctcctgtattgggtgcatatatatttaggatagttagttcttcttgttgcgttgatccctttaccaccacataatgcccttctttgtcttttttggtctttgttggtttaaagtctgttttatcagagactaggattgcaacccctgcttttttgtgtgtgttccatttggttggtaaatattcttccatccctttattttgagcctatgtgtgtctttggatataaaatgggtgtcctgaatacagcacagtgatgagtcttgactctttgtccaatttgccagtccatgtcttttaattgggggcatttaacccatttacatttaaagttaatattgttatgcgtgaatttgatcctggcatcatgatgctagctggttatttcacacattagttgatgcagttcctcatagtgtcgctggtctttacattttggtgtgtttttgcagtggctggtaccagttttttcctttccatatttagtgcttccttcagaagctctcgtaaggcaggcctggtggtgacaaaatccctcagcatttgcttgtctggaaaggattttatttcttcttcactaattaagcttagttaggctggatatgaaattctgggttgaaaattattttctttaagaatgttgaatattggcccccactctcttctggcttgtagggtttctgcagagagatccactgttagtctgacaggcttctctttgcaggtaatctgacctttctctctggctgcccttaactttttttcctttgtttcaaccttggataatctgatgattatgtgtcttggggttgctcttctcgaggagtatcttagtggtgttctctgtatttcctgaatttgaatgttggcctgtcttgctaggttggggaagttctcctgcataacatcctgaagtgtgttttccaacttggttccattctccccatcaatgtcaggtacaccaatcaattgtacgtttggtcttttcacatagtcctatatttcttggaggctttgttccttttcattcttttttctctaatcttgtctccctaccttatttcagtaagttgatcttcaatctctgatatcctttcttccacttgatcaatttggctattgatacttgtgtatgcttcacaaagttttcatgctgtgttattcagctccatctggtcatttatgttattctctaagctggtgactctataataactgttggttattacagcagttcctgtagcctcttatcaaggttcctagcttccttgcattgggttagaacatagtcttttagctcagaagagttttgttattacccaacttctgaagcctacttctgtcaattcatcaaactcattctcctttcagttttgtgcccttgctggagaggagttgtgatcatttagaggagaagaggcatcctggtttttggaattttcagtattgttacactggtttttcctcattttgtggatttagttacctttgatctttgaggctgatgacctttggcttgggtttttgcgtgggggtcctttttgttgattttgatgttgttgctttctgtttgtgagtttttcttctaacagtcaggcccctcttctgcaggtctgctgcagtttgctggaggtccactccagaccctgtttgcctgggtgtcaccagcagaggctgcagaacagcaaagattgctgcctgctccttcttctggaagcttcgtcccagagggggcactggcctgatgccagctggggctctcctctatgaggtgtctgttgactcctgctgggaggtctctcccagtcaggaggcatggggatccgggacccacttgaggaggcagtctaagagctcgagcgctgtgctgggagaatcctccttttcaggatctgctgctgtcttcagagccagcaagcagaaatgtttaagtccactgaggctgtgcccacagctgccccttcccccaagtgctctgtcccagggagatgggagttttatctataaccccctgactggggctgctgcctttctttcagagattccctgcccagtgaggaggaatctagaatggcagtctggccacaaccgctttgctgcactctgttgagttctgctcagtccaaactttccagcctctttagcactgtcagagaaaaactgactactgaagcctcagtaatggtggacaccccttcccttaccaagctcaatcatcccaggttgacttcagactgctgtgctggcagtgagaatttcgagccagtggttcttagcttggtggcctccatgggagtgggacccgcttatcgagaccacttggcgccctggattcagtcctctttccaggggagtgaacagttctgtctcgctggggttccaggtgctactggagtatgaagaaaaaattcctgcagctatctcggtgtctgcccaaacagctgcccagttttgtgcttgaaacccaggcccctgtttgtataggcacacaagggaatctcctgctctgtggattgcaaaaactgtgggaaaagcatagtatctggaccggatagcacagtgtctcaccacttcccttggctggaggagggagttccctggctccttgcacttcccgggtgaggtgatgccccaacctgcttctgctcgccctccgtgggctgcatccactgcctaaccagtcctaatgagatgaactggatacctcagttggaaatgcagaaatcacccgctttctgcattggtcttgctgggagctgcagactggagctgttccaagcaaccccactttctctctttttgctcctcaaagtcactaaggtcttaagagctaacactgaagatcaactttgtatttgtatacatgttttattacagaaaatttaaaacatatacaaaataaaacagtataatacaactgttacccaggctcaacaacctgtgccaagtttgttttatccatacttcaatgcattttcttcccagactttattattatttttttctgaaataagatgtgtgctaattgaaggtaaaatcttggctgagcacaatggcttaagcctgtgtaattccatccttttggaatgacaagacaggaggctcacttgagcgtcagagtttaagagcagcctgggcaacatagtgagaccacatggctactaaaaataaaaaaaaaaaaaaaatgaggcatgatggtgcatgcctgtattcctagctacttgggatgctgacatagcaggatcccttgagtctggcagggtgaggctttagtgagatgtgattgggcagctacacacaagcctgggtgacagtgagactgtctcaaaaaaaaaaaaaaagaaaggtttactcttaactgtacctttttaaacatcagtacacatatataaacaatttttcttttaagaatagaagtacccaagttaataatcattaacgtgaacccatttgttactcagactttatcttttaattagtttttcttttttaaaataagatgtgagctcattgaaaggaccaatcttggccaggcatagtggcttgcatttgtaattccatccctttgggaagccagagctcacgagtttgagaccagcctgagcaacgtaacaagacctcactggggcaacgtagtgagacatcatctctacaaacattttttaaaaattacttgggcatgatggtgcacacttgtagtcccagctatttgggatgctgacatgggaggatcgctcgagcctgggaggtcaaggctgcagtgagctgtaattgcaccactacactccaccctgagtgacagattgagacgctgagaaaaaaaggtacaatcttaactgtacctgtttgacacatcaatacatccatataaacaatccctttcgtaaaaataaaagtaccccacttaacaatattgatatgcatgggaattacctatacattttttatttcttttagtttggatttttattgaaaggaaacacctagaaacattacgtaaaatctagattttgaaaaaaatagacctgaacttggtttgagaatttcaaaatagacatgagttttgtctgagaatttgtctttctaacaacatacagatcttacagcacatggtagatacaaggactcttttatctaaaataaataaaatttgacgaataaacattttaaaatttgacctgtggctaaaggatgaatcaaaacacctgtgcaatgggttatctgtagaagtatattttaatgacaaactattaataaccaaaaaagttataataatttattaactaacatgagcaaaattcctattatggtatctatgaaaatgctttcttagagtaaaatattctcttatcttgcaagggcactggttaataacagcaaagatttggaggtcaatgtctcataaagtaagtagcagacccctttcacacccatagctggccttcagagttatcgaaaaaatggtcatttacacaagagcagataattttcttaggttctattaagtttatatgttaatgttgttacaaaatttaactcagttttctcataagattatctgacaaaattttatatgttataatatcacaatatattatgtaatatcatgtaatataataaaattttgtcagatacggtgtcatatatataatttgttatttcataaaacatatacaaaaaaacaaaattttatgttatgatatcacaatgtattataccatatattatatatgattatatatcatgtattatattatgatatcacaatgtattatgatatatatcgtatgtataatacatgatattatatcacaatatattatgacatcattatatattatgtctgacatatattatgtcacagtatattatattatataatatattatattatattatattatattatattatgttgcattatatattatattatatagtccagctaattgacatggcccagcagactgcccagggcatgaactacctccatgccaagaatatcatccaaggtgatctcaagtctaataacatttttcaacacaaagatgagtgactctcgtctggccacagtgaagacagagtgaagcagggcccagcccttggagaagccttcaggttctgttttgtggatcgcagctgacctgaaccccttcagcttccagtcggacgtctatgccagtgtggctgtgctctaaaatctcacgactggctcactgccttacagccacattggcagctgtgaccagattatctttatggtgggctgtgactcttcatccctggacctcagaaaaatctccagcaactgcccgaagccatgtggtgcctgctgtctgactgcctcatgttccagcaaaaggagtggctccatttgccccagactctcaccacaatttttctgctgcaagggtcgctccccaagatggaggggaatacctctaaatcgtccttttatcaaacccaagctgatgagtttccttcctgactactcaacacaggctgtcttgagcctgaccttactcccagccactagggagccaatctgagcccgccatgccaaggagccctgcccaccaacgaatcaatgttttatctctgtcctgaagttgcatcaggatctcatatcccccaccctgttagatgagggggtcctgatgtgctttcccagttcctctaaaattggaaaactcttaaagattgagcccctgcccccctccatcattttattttttggcttagaagatacctctaaattgggggaactccttcatctctcatggctaaaatttgtagcagggatttcactcagaacctctatgggatttgtgcctgatgtgacttccactggactttggggttctcaacacatcatgtattttgggggttccctttttgtcctctcctccattcaaggactactgtcttacttcattaaaatacagagaattttgctgaaaaaaaataaagtgtttcaaataaaaccttcccaacctttgcctctggggaaaacataattttattaaattatttatgtatgtatttgacctctgctctaaaaagagacactactcacttcacacaaggctgttagttatttaaaaacatccttgaaaagattgtccaaatggaagcttatataagatgtaaaacaaattaaccaacaggtctataaaaattggctcccaacagagtacaacatacacttaaaaatacagaaatattggtacaaccattacagaaacactgtgaagctttctcaaataattaaaatagaattgccatattatccagcaatttcacttccagatatataaccaaagaaaataaaattagtatctaaaagagacacctgcccttctgtattcatagcagaattatttacaatgacagagacatgcaaacaatctaggtatccattaatagatgaacgggtaaagaaattatggaatatttatataatggaatattattcagccataaaaaagagaattctgccatttgctacaatacgaatgaacctagaggacattaggttaaatgaaataagctagacacagaatgacaaatactgtttgatttcactcatatatgaagccaaaaatgtcaaagtcatagaaacagagagtccacagtggttgctagggggtggtggctggcagaaatgaagacacggtgatcaaaacttttagatataaaataaacaagttccggtgatttagtgcacagcatggatgttcacgaatgttgtcttaggctatccctatttctgtaataaaatactttagaacaggtaatttatatagagtctaaacttacttctcacagttacagaggctgagaagtccaagaccagggcactagcagatacacataatatagtacctgctaattacattaatttgataattgcaccatatatatgtatgtaggtaggtattggagcttcacattttaaccttatattcattttatgaaaacgttgctcctgtacaactttattctgtctttccctcctagtttgggtactaatgtttaaatctacatatgttacaaacacaacagtttgtagttatctgcttacataattttatttttttaaataagctgaaataagaaaaaagagcacttgtgtatttacaggtttgttttgttaaacttcttattattcattatgttattgtaatccttcactttttctgacgtacttttttaaatctttgtagatacaagttattatctggaaagattttcttagcccaatatatcttttcttgaacccactttctctgtgctgtaattggcaaataaattaaatttctttatgttatagcactgaagatcccattacaaacaatattacacagttgcttttgacaatcagataatatgagaaaaaaatttcttatattgccttaaatatttgttacatttactagtcctctttgtcttttgggggcattaaaattatctgggattacttgcattcagcctgaaaacttatttttattctttctcaaatgatctgtctgctatcaaaaaattgcctcagcttttatttacctgaaatgtcttttttatttatttttaattgatagtttttctgaggataaaatttttagtggacattttttcatctttgagcattgaaatatgtatatattcttagaagttgaaaagcttttaagaagaaaaaaagttttgatctgagaatgttcagtgatttgaggaattcagaagggaaggaaatgctttctgatgagtgagccacaagtactctatgagtatagataatgtgcaccctacatgggtgtgattgtggatgtatggaagtttcagatacgtataacttatttgttgtaagataaaatgcttaggctacattttaaagaatttatatgagatagtccaggttaatcaggataaatgggtaaaattaaaatgataatattggtaataattttgaccgtgcaataaataatactgatgataggatatctattgctttttcagatatataaaatatgatccctcttcaccattaagacgaccatagtccacttatgacactattaaaaattgcccttttttcccaagctggtattggactcacagccaacaccttcctccttttcttctgtatctgcacactccctctggactgcaggcctaagcccactgacctcatcacctgtcacctggcccttgtccacttagtgatgctcctcactgtgagcttcttggcatctctggacctctttgagtcacagtattttcagaatgacttcaagtgtaaggtattcttctacatgcatagagggatgagggctctccatctgcaccacctgcctccggagtgtgctccaggctgtcaccattacccccggcacctcctggttggcaagaattaaacagaaattcacacattgcatctttcacttcttggggttctcagtttctttctcagtagtaacctgccttcctccactgtggcctcttctaatgtgaccgacagcaatgtgccaagtatcagtaaatactgttcactttcttacataagctacatcatcaggagtctgtctttcatgctgccactacttgcagatgtcttctttgtagcagtcatgttgctctcaagggcatacatggtaattcttttgtccaggcatcagagacaaccccagtaccttcccagcaccaacctgtctgcaaaagcctccccagagaaaagggccacctagaccattccgatgctggtgagttgctttgtgctcatgtattgggtgggcctcatcatctcatcctcctcaaccctgttatgggcttatgactcattcatcatgggtgtccagatgcttatgggcaatttctatctgttagcccttttatgctaattagttctgataatagaataatcaaaattttgcataatgtgttatataaatatcatagatgataataaattatgaaaataattatctgaaaaacagatttggacatcaaataattcaagaagcaggtgattttatatattattttattacacttttatttcatctaaatacttttgaaaactatgctgccaagaacttggtggtttctttaaagtccaccgtcatagtcccctgtgtccacaagtttcttatatttaattttgatcccttaagttttatataagacaacttttctatcttcttgaagtgtacacttaagatgctcctgttggtagataaaatttctctttgtgtgtgtgtgtgtgttttacttctgaaggttatttagtttacccttatttattaaatatatgctagctatgtattcagttactggttgaacaataatttttcagcactcttaatatttccttctcagttttctggctctgcctgggctgtggagatttcactctcacatgtgtagattctctctctctctctcatggctttgaagtttcttcattctctttggtgttatgcagtttgacttatggtgttggatatctttctttattgctttttctttttttaatttggtgacggaatcttgctctgtcacccaggctggagtcttggctcgctgcaacctccgcctctcgggttcaagggattctcctgcctcaacctccggagtagctgggatcacaggcagctgacaccatgcccggctaagttttttgtatttttttgtatttttagtagacacggggtttcacctggttggccaggttggtcttcaactcctgacctcaagtgacccgccctccttggcctcgcaaagtgctgtgattacagatgtgagccactacacccagcctctttattgcttgctttcaggcacagtgtctcttttaggcacatgtctggtttttacttttagaaatttgtaaataattatttattagtatgacttattatttgtatgaattcaagtgaaataattgtgctttattctttgtcattctattcttcacatatgtataattacattcatattactattattttgtttctctttcttttatttggttatattcgttctgctcaaaatttcagttcattaatccagttcactaattctctcatcaacgtagtctaattttataattaactcacatatcgtatattaaatttctttatgtttaaattattccatttctatttgactcttttccaaatttcctcattcagtttatagtttcctgctctttcaaaaattatttggatatcatcttttcctcaattgtttttacctaaacatttaaaatatttaaatttaatattttatattaatatgtacaaatataaatatatttataatacttttaaaatttaaaatattacaaatatatttccagtatgcaaagtttatgtgatatcaaatttcttccaaccgggccaggcacagtggctcatgcctgtattgggagggagaggcaatcccatcacttgaggccaggagttccagaccagcctggtgaacatggtgaaaccccatctctactaaaaacacaaaaattagctgggcatggtgaggcatgcctgtaaccccagctactcgggaggctgaggcaggagaatcacttgaacccggaaggcggaggttgcattgagcctagatcgggccactgcactccagcctgtataacagagcaagactctgtctcaaaaagaaaaatcttctaaccctttttcctcgtagcttattttcttctgtgcttcatactttttatttattttttattttttacaataggatccggtttattctgccttggcagggtgatcctgagagtggtgggtgtcaccctctcctgggcagagggaggggccgtgggccagtcaagccaatggtaggagaagcgctggtgaggggtggaatttggggttcaggggtgtaaccccaagaatgcagtgaaaccaggccgaggcccagaggcagctgtggtaggccagggcagggtggaaggcagtggactgggcccgggccgggatgacagggccaaggactcaggccacactggcaccccgggaggcggggcgcagtgtcgcatgacgtagaaaatgaatcacaggcccagggctcacaataagcacatggacaagtgggcacagactcacaggccagatggacctccagccacggccgggccagactcgtggacacaggcgcagtgtcacgtacagaccacggggagacatggcactaggggacaaatggacgtgacaccacaatgcacagggcaggccacagagctcgagggacgtgggcaggggccttttggcatttctgcgctggaatcatgtgagacaagggtggtggccgctctggaggtgcctggggggttccctcattacccctctgggcttagtccatcctccacactgttgtgcagcttctccacctcctggtagaggataaatactgttacccttatccctggtcacatccagggagacgcggtccagcggcccaggcgggggacagtgccgttctagaggtccttgagcccctccttcctcaggatctgcagccataggccggtgtgttccgcgtttgtgctgctccaggccccgcatccggtctcgatcccatccagaggagcgtttcccaagacactggctgcgcccacaatggctccgaagaccccagcgaccagcgggtccatgggcttgctggggttgtcccctcggtaccagctgtgcagggaggtcaggaggagaagcagacggcctggttccagccctgctttagcgtgggtgccatgaggccccggtgagtccccttgttctcgcacaatctctctaacctggtgggagactcctctgcactggaggtctgggaaggtctggccgtggatgaacttcaccttgatggtgtccatggaacatacgaccaccatggcctcggccacgccagcgccctggccgcaccgcagccagcgctgccgtcaggccgtccctgggcatcccgcgtctggctgctgtggaactggaacattcagaacccaacgccgccctggagacaagagccgcagagcagggagccgaggccgcggtgccggcccgggacgccatgaccgcgacagtgcgcacgcgggatccatgcgcggtgcccggctggtgccagcgctcgtccggctgcagctacgacctcccgcgctccgtggggagcggacgcccatttcaatgccgccggccaggccgcctgctggtgtcgccttccccggagcctccgctgggccttcccggacgcggcgcggcgtggccacggcgggcgggaggcgggcgcccgctgtgatctgaagtcccagcctcctaaactccgcactgggaccttaatttggttttaacacaaatgaagatctcactaaagataaaaagggatgtcttggcttctaatttttgttaaaagcaatagcatatgttgtataggatagtgcattggggtaaatcttttttttattatttttattttttcatcagcccactgacattgaaaggggataggttttaggttattgacgagcagttttctctcagataactgccttagtataggggtttgtggtcatgttgatgagagggtaggctggggttaaaagtcgttatggcagtaacaaccttctgaggaccaggaaattcaaatccctctcatgatactttgctaatatctcccgagtttgctgtgccttccctttgtgcctcttcccacacgtggtttcttgcacttggcccagctatattccactgttttgactccatgcttcttagcctggtggcagtggtgagggagtgaggagatctctaatgttctgaggaagcctcagacttagcactgtgaactggggtgtggggttactgaccgttgaagagtttcctgcccatcctgtacatgcaatgccaggacaagagcacattcctgtccctccttgtccatggtaggggaaacgtgctccttctccatgctcttaactcccagttgaagtgggccttgaacagtgccctgtaaattaatggtttcttttctttatgggagatgcatctgtgcagaaatgcgggtgttggccttgttccttcaccctcagttccatgagcttttccccagtgccctttggctcaggtttggatgctctttctctgcagattaggcctcatgttatataggagagatgtgagggctgtgtctccagagttgcagtagtggatgggatagtggtccctccccatcagcactgtggggtaagcatcctcaggattctaaccccatcttccctgacaggccttgtagggttcctagaaaaattatacacaacggtataaaccctacgtctgtagactccagggtttctcattctcctcacccacccacacacagccaccaggaactagttcaaaagttctggcttaattttaccagtttacatggtcttcagggtacacataaaagcctggagcctgtgtgacctgcaggctttctgcatcccctgatgttgggtttgtagtctgccctgtgacctcagttctttaaagggctcaggagaaaccatccattcatttgaagtttctccagcatttttgtttgtttgtttaatgtgtaggagcaactctttgtcaggtctctatatctacaaacttaactcagaaactaatatttttaaatatatttcttttctatcatacttttagtgctcctctacctatgctaattgttcttcagtattttttatatttgtatgtctttatctattttaaaatcaggtttaattccttcttaatcaaattaataacttttcatttatttccctacgtaactttcttttcagacgtttaaagtattgctgtgtgtttcaagtggaggaggtcatattacaactgacatttgtccttgactactggacatatcacaccagccctgattgcagttatacttgaagccagatctacccttaacgtatattcattttactattcaataaatattaacttatcatgaatggtatatattgttacagttgtaggtttatggacctgaatagacaataaaataaataaaacccaaattacatggcttcagggggggtataactttttattaagtttttagttaaaacatttttgcctttctgtgatttgcaactttgagtgattgccttgaaaaaggaaccagagttgaaactgaagtagtaggtgttggtgagattttgatggctaagagcatcgggctcattttgtaactgaaggggaaattagaacaggtcaccagttccatctgaccacaatgcagttggaataatcaccatggcaacccatgacttgtattttaggggagaagaattggaaataaaatgaccaagcataaagctgacccagtctacatggatctttgtctttaaaacatatctgcaatactcatgtaggcagtgtataaataacttgtcagaaatatcgtttatgccaaggttcttcttgaattttcaggattttgcttctccagtagtgagtgtgttactgagcaaaaggggctttctatccaaaacactagaacccaaaactgtggcactgggtttttctttttaagaaaaaaaaaaaaaagctgctccttattataatttttgtttatattataattatgtaagtataattttaattttattataaatttgctttattataatttttatttcagtatcacttacagtacaagtggtttttggttacgtggatgaattatatagcagtgaattctgagattttagtgcacctgtcacctgagtagtttatattgtaccaaataggtagttttttcatccctcatccacctcccactctctgcttctgagtctccaaagtccattacatcactctgtatgcctttgcatacgcatagcttaactcccacttataagtgaaaaataatagtattttattttccattcttgagttatttcacttaaaataatggcctcatatcccttgccctgaaattaacagccagcaggggtgtcctcagtatcaaaacaagtcgaccacacaaagccgtcaaagactccaggaacccaggtccatggggtgcagccctgcaaggtggaaaagctgaccaagtcttccttccagccaaatctggaagaaaggccccttgcctggagcagtgttcctggtacccaggcctctgtgggcatccctcagcacaaagaccctctccaaggggcatgggccggcccttccaggaccaccagcccagctccagaagcccatgggtcatccccaccctcacctgactgagctgtccctgaggctaaggcccagcagcatgaagagacttccacagaaaccagggcaataggctgctctctggcggcactgggggctcagggtctggctagcctgtccctggctcaagtcacatgcctggaaattagggttttctcctctgctcttagcatctcctgggtaaaccaataattaccctccttcatgtctcaaaattcacatccatgtaaaaggctctggtgagggtgacatttccaggaagccacagcccatgtcaaccccctgcaaagctgtgaccttgtccgcgggcaggtgaggcggcggagttctcccaaaagccggtgaactggcgctctggctggagagcgcggagggcggcagcacaatggacagcgtctgggacctcaggccagttccacagcagcctaggaaagcaggcggctcctgtgctggaggaggcgtgatgctctggagggaaaccgagctgagcagcgagaggtggggtgaggctgagacccgcccgatttaggcaaagatgaggtgcacttcgcagcgtcacactcttctcactgcccagccccgacttgccccttaagtccctctctggactcactccccttagccagggatggcacagaatcagtggccagcataggtttggaagcagagaggtccacacggcttgcgcctccctccgggactgctcaccaccccgcagcccggcgcttgctgggactgtaggccggtagccctgcgaccaacagccgaaagcggttaagaaactactcccagaatgcctggcgaggcgcgcaccacgcggccccttcctccaggcattcgcaccaccccccactcccgttgcatgctgggattgtagttgatcgcctgcgatcaacggccggaagcggctaaaactactcctgcctgcataccccgcaggagcaaaccgcgccatgtctccctccagggatccgcaccgctcacaatcctgtttagtgctgggattgtagtcctgcgagcctacgactaatagctgggtgcggataagagactacagctccccccattcccagcaaaggtccctcctccaccgagctcctccaggcttccagtgcagttccgccgtgcggagggaagcttggctgttcacaaacctctcctgcccgcgaggagacagcttggccagggcggctgatctcaccttgtcattgtgacacggtgtctccccaacgtgctggcttcatgacttgtgcccagagtttgattttccacagaccaggtagaggccaagagcctctcacagactctgcagcagggttgctatggtaacgcttgcgcccccgccccccccagcagccggctcgacaccgccctttccctctgaagggccactcgttttagccacgtcctcttattgtccctcccctggccacaccccttcagacatgcgtagtgctccccttggtccagcgcgggaagctccctcgtgagtgtccgaaactattagctcactcactgcctcatgtgaaggtacccagtctctggtaacctggcacttcccttttgaaaaccacctttttctctctctctgggctgccacgaatccccctgtactccccagatgcacctgttggaccccgggctggctgcatggcccacacctgggtcaggcctcgcacaggggcgctcctgccactataataacgatgagaaaatgtcccaggggaaaggcctgaccctgctgcatccagtcaggaaactgccacggggaagggaccacctaaactactttgcgagccacatccaccacttctttgtcccccacccaggctggttcccaggccttggggtcctagtgtagacctcccggccataactaacacaggtgcaggaccagagagcgccttggttcctcccaacacatgaggaagtttgtgtggtgaggtttggacagtgtctttgtttttgctctgaatagggtgccctggaaaaatctttacctcttattaaatactccctttggaaccacttttaagactttgccgatggaacttaacagtgatcatttattgaatccatttttctattcgcttttttagattaactcttaagtactccacaactacacgcttttgaaactggcgttggcatagcgttagttctgtgcagggcggacgcagcaggacagaatctccctgggcatcttttcggagcatcaattttactgcaaaattttgaaaaaacaaatttaattgatttccaaggtaagaaattaaaccttgaaaaatagactaaagagtcatctgcacctgacatatcagactttctgcaggaagaaaactctaaggagagcatattgtccattattataaatagtgaaaatgagaaatcatagcaagtcccttgaaaaccctgccctgccagttttctaatagggccttggtatggttttatgtgtattttcttttgaagtgtgctcatcttttgaatatacaaatttgaggttttgaccaaattttgcaagttttcagctatgagttgtttatttgctcttgtatcatatttaatttttctgtctctccctctccttctcggactcagtcattccacaggtctctaaggagcttttcattttcttcaaacttgtttcactcttcagattggatgatgatgatttctattgctgtcttctgtttctactctgtttataaactcaaaggtctttttaatttttcatttcattatctctgtatcccattctttttataattttcatttctctgtaatggagtctcgccgtgtcacccaggctggagtgcagtggctgatctcagctcactgcgccctcctcctcccaggttcaagtgattctcctgcctcagcctcccaagtagctgggactacaggcacacgctgccacactcagctaatttttgtatttctagtagagatggggtttcaccatgttggccaggatggtctcaatctactgacctcatgatccacccacctcggcctcccaaagtgctgggattacaggtatgagccaccgcccccagcgtttctggtgttttatcagaggagcaaaacctgaggtaattcagattctgctctttgttatcttctaggagttttgtgagttttcctcctatataggtctatgatccattcttagtaatttctgtgaaagttgtcaggtctgggtttagggtttttttttttcttcttttctcttgtatgtggatgtccagttgttccagtactgtttgttgaaaaagtattgtttctcaattgaatttcctttgctttttcctcaaagataagctgactatatttcatgggtcaatttatgagctttatcttttgtttgattgatctgtttctctattattttttaccagtaccgtgttttgattactgtagctttatagtagtgcttacagttgggtagtgtcattcctataactgttcttttaaaatattttcttggttattctgagtcttttacctttccatataaactttagaatcagtttgtcaatatccacaaactagctttgtggaattttgattgggattgcactgaatatgtagatctagttgggaagtactgacgttttaacaacgttgaatccctctttacttgaatgtggattatctctccatttatttagatcttctttgatgttttcacagttttgtagttttcttcatatggtttctatatttatatttattttcttatatttgtacctaaagaatttcattgttattggtgctagcataaatgtcactgaatttttaaatttcaaattctaattacattactgatatataggacagtaattgacatttgtatattaatcttatattgtgcaaagttgctataattgctcattaaaattggttattctaagattttgttttgtgatctttttgtatttctccataggcaattatatcatctgtgtaaaaagactgttttatttcttccttcccagtctatgtaccttttctattcttgtcttattgcattacctagggcttatagtataatatcatataggaatggtgagaggagacatctttgccttgctcctgatcttagcaggaaggaatctagtgtttctacattcagtatgaggttagatgcaggtttttttttttttcttgagatgtcgtctcgctctgtcaccaggctagagtgcagtggtgtgacctcagctcgttgcaacctccgcctcccgggttcaagcaattccttgcctcagcctcccaagtagctgggacaacaggcacgcaccagcatgcccggctacttttttgtattttagtagagacggggtttcaccatgttggccaggatggtctcaatctcctgacctcatgatgcacccacctcagcctcccaaagtgctgggattacaggcgtgaggcactgtgcccggccaggtgcaggtttttttaatagacattatttatgaaattgaggaagttttcctctatttctagtctgcggagagtttttctcatgaatgggttttggatattgtcaaatgatttttctgaatgtactgatgaaatcttatctttttaaaacttaatatgatgaactaattttttttaaagacagagtcttgctatgttgcccaggcttagtttgaactcctggcctcaagtgatcctccctccttggcttcctactgcattaggattacaggtataagccaccacacttagcctaatttattttcaaatgttgaaccagcctggcatgcctgtaataaatctcactgggttgcagtatataattattttttacatttttggacttgatttcttaatattttggtgaggatttttgcatctttcttcatgtgagatattgtcctgcatttttttcttgtaacgtctctgtctgaatttgacactatggtaatcctggccccattgaatagtttgaaagtattcactctgcttctgttttctggaggagattgtagagggttggaataatttctcttaaatgtttgcataaatatactagttacctcatctgggtctggtactttctatttggtaaggttacttatcattgacccaatttctttaatagatgtagtactattcaaattgtctgtttcttattgtgtgagtttgggtaggttgtttctttcaaagaatttgtctgttacatttgggttaccaaatttgtgggcaaagagtggtttataatgtttctttattattctttaattcttcatgggatcagtaatgatagatcctctttcatttctgaaattaggactgtgtcttctgtctttttcaaccaaaactaaaaaggaacgttttaaaaagtgaaagctatttttgataaactatctaatttcccatgatctgcaactgtgggtacataggaagtacatggaaacagatgtttggcagagcttgccaacaaattcttttctgcatcaagaaggcatgcctctcagcatgacactcttaagaggcagaaatgtgacaaaagaaggatgcgatctgctcctggtgaagagccacctgactctccctcagctgcacatagtggccttaacgtgcatcttgctagaaggggcatgcaagccaggggctgccagccaagccatacaggccaaggacagtttcaagtctgccttttatttcatcgaactgttgttctagtaagcagctagagttttatgaacactgtaaactctttatcatatttctttgctatttctggaggatttgttctaggagtcctcttggataccaaaatgcatggatgtataagttctttatatataatggcatagtatttacatataacctatgcatattctcctgcatactttaaatcttctctagattacttttaatacctaaattgttgttatgctgtgttgtttagggaatagtgaaaagaaaaataaaattctgtaaatgttcagtacagaaaccttattaaaatatttttgattcacatttgttgaatccaggaatgcagaaataaggagggacagctctacctatgtttggagtccatgaatgtgtcatcttgctgtgtttgtaaatagaaatttatttcacaaaatgactcaactgcttcttcactaacatgttcaaaaacttgcaagaagcagccaggcatggtggctcacacctgtaatcccagcactttgggagacccaggcaggaagatcacctgaggttgggagttcgagactagcctgaccaacatggagaagaatcgtgtctactaaaaatacaaaattagccaggcacggtggcgcatgcctgtagtctcagctacctgggaggctgaggcaggagaattgcttgaacccaagaggtggaggttgtggtgagccgagatcgcaccattgcactccagcctgggcaacaagagcaaaattccgtctcaaaaaaaaaaaaaaaaaaaaaaagagagagagagagaaaagaaaagaaaaacacttgcaagaagcaaaataagaattgagaaaggggaaagatgatgactgagagttggaaggttgcacattttcacagaaaagtagaacggaattgtaacaagcactctgataggaaatcatagtttatgtctcgcaactgtccctgaaaaaatacaatggttggcagaaaagacaagaaatgagatagactataaattaactggagaagagaaaaaataattcccagaagtaaattgtcaacgagtttgaaagcaggtaaaatgtaggtgcattatccctactctttctgaataattttacaaccttgtgcaacaggagcttctgtcactgcagaaccagggtcacctgtggaaaatccttgctgaagccatctccctgtctgcctgtccctcaggcccaggagtcatgagtcctttctccaataagtcattcagttggctggcagcaaaccctggtaagattcttcaaggcagctactttttatcttagattttaacagaaactcatgaagaaaagtcttaagacctaaactcccaagtcccttactgtatcattttgagtattaggaaatcagtcagaggtcttttcagcatctctgaaatcacaatgcaaaaatagccccagcttcataaggccgattcttggtatctctgttctgcaaagtagggtaagcaagatgccacaaaaggcaggttgaatgcagcattatcctcactccaccaacagaactatcatactttaagtaacccagcaggtctttaaaataaagaaattataaaacataaggaaaaactttcttgagaggaaaaaatttacaaatcagaggaaaatcttctagaacttttacatcttataacaaataaatcatatgctttattgttttcctctgagtacatcatcagtacttccataatacttctaatttttggcttgaaaacaccagttgcttaaaaaaacacagggacacaaaacaaaatcccagaaatgtataattattttttttaagctgacaaaggagtaacacaccactgacttctcagggaaaagctttcaagcaaagcagtcatttctggtggggattatagaagagggagttatcatggtgagatggtggaactaatccagaacaagccagatttttagtattgacaaagggatttaatcagttgcccaggaatactcactcacttggaaatcaaacttccatcattattcttggaagaatttctggaacttcccctttggaaacaaatttttatcttcaaaaataccagacaatagaagaaaagaaatgaaaaaggaggcagaggaagatgaatcttgcttaggcagggactgaaagggaattcgtggccataggccacatttttcagcgcccactgtgtgacggctttccccaggaccacacgtgtgccactgaacaagaagagtccacagggaccttcaccttattcctccccaacatcaaaaccaaaatggaacaacctaccatgagaatatgagtatatatcacaacttccattacatttaaagcatgcagagtatctaattgcaaattcaaacagtggaaaaacaaatctacttgcctcctggccacagccttactcttttaagagaatgtggtctatgctttctaatcccatcaccagggataaataaccacaggtttgtgtgacatagaaccacctccatgcagaggtaaatatgcatttattttttataaaataagaattatactctgtacttttataccatacttttagaatataacagttcttatgatcattttataattatttgaaacaacctccgtagctatataacattaaatcaaaagaacatttcataattttaccattttcctattggacattgagtttgctctcatgaagtttatatttgtgtgatgatttgggggaagtttctcggcctcactagattgaacaccttgtgatggtggtcactgttatattcttttttatttttattttttgagacagagtctttctctgttgcccaggccggagtgcagtggcatgatctcggctcactgcaacctccacctcccaggttcaagcgattctcctgtctcagcttcctgagaagctgggattacaggtgcacgccactatgcccagctaatttttgtatttttagtagagacgaggttttgccatgttgaccaggctggtcttgaactcctgacctcaggtgatccccccgcctcggcctcccaaagttctgggattacaggcgtgagccaccatgcccagccctattcttatttcattaaaatacctgaaacatatcaggtatattgcagcatctgttgaatgaatgaatgaatctctccttcaaatcttggctaaagtctgcctcatccacaaaagttcctgaccctcacttcaatcataaacctctttctcttctataatttcccatgtagctgtttgtttgtttttttttaactccctggcaggaaaaagaggaaacatgctatttattgagcactattctgagtcagggactgtggtaaatacattcaagaagaaagcatcaaaagggctatacgtcagcctagacagtgtgccccagagggtccttgactgaacatttggtgacgagcatgttgggcatgtgctctaggctgaggtgcagctcttatgccacagactgaccctggatcaattatggctcaagtcccaccctgaaatctctctttcccatttctaggtttgtcaaggaggacagaaactcagagcaccctgcacttggggatcggcactaggagctgctctctggatggggagatgggagctagcagctcacaatggggtcacaaggtaagttccaaacagctctgtcacagagagcgtcagcagatcgcaaagaaagggagcatgtgaaggagaaagccctgagtgatgtcacagctcatttctgggcaaagggagaagaaattagcaccctgaggcccttccgccttattaacccattgcacttattctcagaggctcctgccaaaaatagagacattattccacctccacctcctcaaattctaagccagaaatatgtgtgtgttatcattcaacttatatcattttttcctccttaaatgatattttcaccactaataaatttatcaaaattgtacttcacatgtgtaatacagaagaaacaaggcttccttcaacactgaattaatgaaaaacaactcaggatatttacttttcttcacaccataaattttgaagagctttttcgttatgcactgtgtgttacaacatatgtgcttaagcagtcaagcaagtatctcatatctgaattggaaagctttagagtattgacaaagaagatgtatgtatgtatgtgatgttgctggcctaagacaggccactgctactgcacacagagcaactgtatgttaacaactgctgtgctaggggcgtgtcccctgaagttagtgttgctagcatggaattgaaaatatttatgagtctcagacatggcatcacggtgtttgactattattacattagttacttttagtcactgttttattacaacattttaatgtacatttgttcacagtgtaaagaaactgaagtttttgtttgtttgttttttctttgtttctgtttttgtttttaacttttatggttgtgtgcccatgggcccccacaagaggtctctgtttgatctcatttctgtgctagtgatatttctaggagtccaataatatggggcatgttataatataccttttagaatgaagaaaaagtggttacgtatacattctcctacatcaaaaaaaggcgcaagagctggcaggtttctttgggttatgagaaacccattcctagtttgagtatgataccgtggcccattcaatgaatgtaatggaaaactgctacttttaaattgggcacagaataatagaaggcctgcaaaaagtccagagtgcaatgcaagctactttgccacttgtgccatatgactgcagatgcaatggtttttgaggtgtgactgggagataggaatgctgttgtatctttgataggttgctatacataaagcctggtgtaggtccttataattttggagcagagccttaaaaccttctgcagataattctttctttctttctttctttcttttttttctttcttttgaggcagtgtctgcctctgtcaacttggctagagttcagtggcataatcatggttcactgcagcctcaacttcctaagtgcaagcaattctccagtctcagcctcctgagactacaggtgcatgccaccacattccatggattttaaatatttttgtacatatgggggcttgctgtgtgtgcccaagctggtctcgaaatccttgcctcaagcagtcctcctgccatagcctcccaaagtggtgggattacagttgtgagccaccacaatcagccttaccttttgaaactattgtaaatggaattgtttcttcatgtcatgttgagattgttcattgctagtgtatagaatttttattaatatttttatattattttaaatcatgcaatcttaactcatttattatagtgggtatttgtgaattttcttttttcttttcctttcttttcttttttttttttttttttgagacggagtttcactcttgttgcccaagctggagtgcaatggcgtgatcttggctcactgcaacctccgcctcctgggttcaagcaattctcctgcctcagcctcccgaatagctgggattacaggcgcgcaccaccacgcctggctaattttttgtatttttagcagaaacggggtttcaccatgttagccaggctggtctcgaactcctgacttcaggtgatccccccgcctcggcctcccaaagtgctgggattataggcgtgagccaccacgcctggccgaattttctagaaagttttatatacaggatgtcatctgaataggcttccgatctttatctgaaggtcatgaatttatttttgttccatgatatttctggccaaaatctccagtatactgttaaaatagaagtggtaaaaatatattcttgtcttgtttccaaactaacgttctcaaacccaagatttcaacattatgcatgatattagctgtaggtttttaatagatgtcttatagcaggtgtaaaaattttgcttgtgtttctagtctagttagggttttttcataaacgggtctagatttgtcaaatgttctgtgtttttcagaatgatcattttgatattttattgttttattaagctgtattatattgactgatttttgaatgttaaatttgtattgtgagatacccctcttggtaatggtgtccaataattttcatttgtggctacatttattttgttattatttttgtggatttctgtgtcaatatggataagggataatagtctatagtctcgtagtgatttttcctgacttttgtctgggcaatactggcctcatggaatgaattggtaagtttcttctgttattcagttttgttttgttttgtttttttgtggggcagtcaactaaaagacctggttttaactcattattaaatatttggtcaaatttacaagtgaaactatctactgagcttttcttcatagaaaaagtttaatctctaattgttttggttctattcatatattctacttattcttgaacttactgtaataacgtatgcatattatccactaatcaatttctaatttgtagcatactatctttttatattttcattgcaataaaaagtaaagggaagaataatgtggaaagacaaagattttggcaatccatgtttccctagtgtctcagggtcctctgttgtagggaggagattattgtacttgttgtacttaatactcacatatgttcatgaagtagatgggacccatcatctaaagtaaattagagaactttgcaaaatgtaaccaaaataaaagtttgtgcctacctctcttttaatcaatatttagacgggacaggaatataaatttcaagaaaaacaaatacatatttcttggaggctttgttgatttctttttactgtttttttctctaaacttctcttcttgcttcatttcattcattttatcttcaatcactgataccctttcttccagttgatcgaattggctactgaagcttgtgcattcgtcacatagttctcgtgccatgggtttcagctccatcaggttatttaaggacttctgttaaccggttattctagttagccattcgtctaatcttttttcaaggttttcagcttctttgcaatgggttcgaacttccttctttagctcagagaagtttgatggtctgaaaacttcttctctcaacttgtcaaagtcattctccttccagctttgttctgttgctggcaaggagctgtgttcctttggagggggagaggcactctgatttttagaattttcagcttttctgctctgttttttccccatctttgtggttttatctacctttggtctttgatgatggtaatgtacagatgggattttggtgtggatgtcctttctgtttgttagttttccttctaacaatcaggaccctcagctgcaggtctgttgaagtttgctggaggtccactccagaccctgtttgcctgggtatcagcagcagaggcttcagaacagcgaatattgctgaacagcaaatgttgctgcctgattgttcctctggaagcttcatctcagaggggtacccggccatgtgaggtttcagtctgcccctactggggggtgcctcccagttaggctactcgggaggcaccctgtccgttcttgaggaggcagtctgtccgttctcagatctcaaactctgtgctgggggaaccagcactctcttcaaagctgtcagacagggacatttaagtctgcagaggtttctgctgccttttgttccataactatagttattaataatgtattgtacacttgaactttgataagaaaataaaactcaaatagtctcaccacactaggaaaaggcaactaggtgaggtgtgagggacatgttaattcgcttgattatattaataatttcacaatatataactttattagaacatatatgtaaggtgatacaacttatacaatttttatttgtcaatcatatcccaattaaaatggaaaaattaagtgtaaccaaactaatgtctagccacatgcaaattttatttagacccatttaaataaattctagattttcaatataaaatccaaactgacataatttttacagaatcaggaaaattctaatgaggaagcatgatattaaagatataattgaatagtcataatacctaatacccctacataataccataatatccctacttattaaagtaggggtaaattaaaatattttcaaaagctaaaattttgagagatttgattaccaacaggagcttaagagtaccttttaagaaaaaagaaacatttactaatatgaagttaaaatgaaaattaaagagaaaaagatttgatatgagaatatcaatttatggtagatattgaacttagcaagctataaagtccttagtaatatcagcttcaaaagtattcatatataattttaaaaggtgatcttatacacattggttaaatcagataaaaaatgagctacttgagcagtttaaataatagcagatgactatttttcagaaaacgtttttcatcaatagcttgttaaaattggtggcacatcaattacaattctgcagaatacttttttttttaatcagaactaatttgtcccagtggaataacagtggcatatgcattgagcacaagcctccggaaattcaggacaactgggtcatacacccataacaggattgaggatgttgaaataagaaggttcataggatacatgaccacaaagcaactcataacagcaggatggtctgggtggcccttttctctgaggagattcttggagagatgctggtgctgtggagctgggattgcttctgatttctgaaaaagaggatccacatgaatgcacttgagagcagcataactctgacaaggaaggcatccctggataatttcactccctgatgatgaggttcatggggaaaagtgagcagtgtttactgacattcaatagatcagtctgagtcacatttgaaaaatacacagtgaagaagattaggctgctactaaaagacaaattgaagaaccaaaaaagaagaaaaacattggtaatgtaatttgtaaatttatgtttaaaccttgccaaccatgagtttctgggactgacggtgatggcctggagcacactcaagagccaggggggacagagggagatgcctcttatcaccctttttgtgtaaaataatagcttacatttaaagccattcccaaattcagtgattcaaacacaacttgaggaaaaaaatccactgcagtaaggagcattagaatatgactgaggaccaagtggcagatgatcaagtcatggaactttggcctgggatccagaagaaatgtaaagatttgaaagaaaaaaaaaatggtattgatgaataatccaatgccaactcgaaaaataaaggcacttgttaatgataacataagtaaaaattgttttcatcttaatgacatagaagaaacatttttgtatgtctggaagaaacaatatacctcacatcatcaatgttcattctaaagtgacattatcccaatcatcattatttttattttgctcatttattcatcattaagcttatctcatatgaattcttgacaatcttcattattcatcattaaccttatctcatatgaattcttaacaatctaccttctgtgttattttgtacagtaaataatatatacattacatgttgttttggttactataactctgtagtataatttgaagtcaggtaatgtgattcccttagttttattctttttgttttatttagtttttttctaggtcttttaaggtttcatatgaattttagaatttttttcttatttctgtgaagaatgtcattggtattttgataggaattgcattgaaactgagattgctttggctagtatagacattttaacaatattgattcttctaatctataaaaagcaaattaaaaaaaaattttgtgtcctcttcaattttttaaaaatcagtgttttatagttttcattatacagatattttacttctttgattaagtacattgctaggtatttcattttatttgtggctattttttcttcagtttctaatgttactcatttctgtctcatacctcattagattggcctttaatgtccatatttttaccaacattgtcttcaaaattatttacatattttctaagaagatgaaaacttcctctgcagttgtattttcttcctgagccctcatcagaattcagcttgattacatatttttaatatgcacttccaaactctttgatgcctttatacatcattcagttccaaagctgcttacacatttaggtgtttattatatcaggaccccacttctccatatcaaaatctgtattagcatcctttagatgctatagtagaataccatagacttagtagcttaaacaataggtatttctttcttgtagctctggagactgaaaagtccaagatcaaggtgccagctgattcaattcctcagcgaactatctcttccttgcttgaagatagccaccttccctctgagttcttgcatgatagataaaaagcatgctctggctgggcatggtggctcacacctgtaatcccagcactttgggagggcgaggtgggtggatcacctgaggtcaggagtttgggactagcctggctaacatggtgaaaccctgtctctactaaaagtacaaaaatcagctgagcgtggtggtgtacacctgtaatcccagctacttgggaggctgagacaggagaatcgccaccatgtgccaccatgcctggctaacttttgtatttttagtagagatgggttttcaccatgttaggtaggctggtctcaaattcctgacctcaggtggtcctcctgcctcggcctccccaagtgctgggattacaggcaagaggcaccatgccagccagagttggttcttgattttaacatcccagttggcaaactctgcatgttgattgttgaatacttttatatttaatgtttctaaattttgttttctacatgtctcatttttttctttccttaactgctttcttttgcattaagtaaatacattttatcttacattttaatatctatatggcttttttctttgagttatttaattactgttcagactaggatttaatacatacattttaactcatcagaatctgcttcagatttctttttttactagaagcatctatttattgcacagttccaggttctttccaaataagccacagcccagtgctttattcagacatacgtactgtccagccagtttggaagaaggaaagaaaagtcaggcacaaataaagacacagaagtgttggggaagtgcactagaaaccatttatttcatttgaaatgacagaagtttgagaggagggggcaaacaaataagatctaataagttagctggatttgtcaatgataacatagtgatagtagctgattatagagtgtaccgggttggagaaagcaggaagacatataattgcaaacatttgaagtctgcagggcaggtgttgagtgtgggaactgtttgcttgagcattagagatgaaatgtgagagagatacttcaaaatgaagctaaacagtttgatctagtacccaggtaaaaaatgtattggtttgttaaaagaaatcttcactttaacacaagatagtgtttggttaagaaagtgggccacaaatatgatagtcataacaattaaggttaaagttagagctaattacacaaagatgtggctagttgttgtcacaaaatcaaaactgaatagtgtttaaaatgtggatgttctcctgctggatatgtgagatccagtgtctcttgagtagaaggaaccgaggagactgaaggttggggttgacagaacacatcaccatgggaggcatggccatttagaactccatgtctaaataagctatattgcaaagaacagtgccgatcctaaccctcggtgttgcttaaatagatggaacccttctgccctccgtaaagaaaattgatgaaataggtgggggaaataagtgttaaaatgcagcctgcattcgaattccaatgccaggtaccctggagcaaggctgtgtcacctggagaacagagcattatttctgggaatgtcagtcagaggagacttttttttctttctcaaaaaggtagttatagtccagctgggaccctaaggtcattggattacaataattgttttatttgaatggctatgggtgacacaggaggacattatgctcagtgaaaataaaccaggcacagaaaggcaaataatgtatgatctcacatatatgaaagctaaaatgttgatctcatagaaacagagaagaaaggtgatcaccagaggctatggtcggggtggaatgggtatagcaaagatgttgatcaaagggtacaggtttcagttaggctggggaaagaagttttagtgatctattgtactgaatgatgaccagagttcttaataataaattgtatatttcagaattgctaaaagaatagattgttagcaatttggttaggcgatatattaattagcttgactggatcttcctataaatcaaaatattacattgtaccacataaatatacacaattacctttgccaattaaaaaaagaaaattatcaggtgcaaggcttcctactgctataagaaacttcagtatttactatgaaaacattcttaagtcaccagagtcacactgggaagactgacatgacattctcattacttagacaggagtgttattgggagaatcctgttttgttgacaaatactgagatcatccaactcaccaggcaaagttgacttgtgtaagtgatcttcagatatgaaaagtgtggaacccagctgctcctcctcagataggtaagttcacttttccctttggtggctcctttttccaccaatctcaacatctgctcttatcctttttctacaggcgacatgacaattgtaggcctggagggagatgagttgacaacatcccttccctataaccacttgttggatctgatctcacatacacagactcactccaaagactgacctgggtgtctgcttctcagcttcattaacagtgggtgctcacaagtctaggtgagtggtgaatcgagatagaattttattagctagttgttagaattagctcctaataatttcagtctgtggttcattgaattctaactatcataagaaggtgtttccagatacaaaataattaatcttatgaagtaacaaatttatagatttgtagaaaaacatttagatttttggagatgttctacttgaatttgtatacatttgacttttctcaatataatagctgaactctcaatataattagctgaactacaactttctgcatttatgtgaagttttaatttgtaaacacagaaatctgaactaataaaattatttagtcatacttcttgcttctttaaactttgaagattgctttatataattctgatattttagaactgtttcaaattaggatgttaaaaacacaagatatgtctaacattttacagtaataagattttagcagatacccagattcttttgtttcatttcattatagtaattgccaatagagatttttttcttgtgatattaaaactatctgaaaatataatgttctgctgtttatataaatttctgttgagctaactactaccttgtataaatggggaggaggtgatactcagtgtgctttgaaatcttttcctaaagtaaattgttttagtatggtattgtttctaagtaaaccaaaactttaaaatactctgtgtattagtttgggtgaggttatttcatgatgagaacaatggtattaaaacaatggtattttcttattataaaacatcctcttggtttagtatttctgcttatacctctgaagactaccaactgcaatgtgttcaataaaacacagtccaaaatgtgacaagtaaatttggtttttaaaaacacaaataatcattgtctgtattcagcaggcatatcgtcatcaagcatgtgtgtttctttaaagtagaaaacagagaggatgaaatcaggataagtaaaacacagaaaggaacaaatgatgataaaataaatttgtggtccatgtgggcatcaaaatattaaggaacatactcagtggacaattgctatatttctgaatatgaatgaatttgtcttaaaataatttgtgttgaaagcccctgtcttccatgcatagtggagagaatgtctgagaagaggaggaccttgactgctcctgaaccggagacctcaggtacacaaggcatgccctccattttcctccaaattctccagttgaatgcaattggtatgactatgatcttctcattactgtgatgcacagatatctgatactaaaacaccacataagcattttcacataagaattgtatatttcgctggtatcttctaggttgtgttgattacaaaaacacatttccaaacaggtttatagggtttcccaaaatttataacacaagatttgtggtcaaacattttgtgtgtttttctgtctcctacttttgcttttttattctgttttctcctttccttgggaaagctgagaattaaatgtctttaagttataatttccttgtcagcagcattgtgttcctagctgttcctacactaatttcaaattccaagaaaaaatagtagctgttttatcagttactcactactgtctcatgtttattatatttattcttcaccatttatgcatttcataaaggtaatttcatggaattaatctagatggaaaggtgttttccttcctgccactgtcagctatgtttctcaggttgccaaatattgccattgggttaacaaactcaccctggccttgtcacctgaaaacttcattatgacttatgctgtccaagaacagcaataggttgtgcaatgctgttcatagaatgtgggaaaaatttacaagcaaaataatgccattaattaatacaataataaagcaaaacacatacataaaggcagagtacaaagaactgtactaaataatatgatttataagatgataaaactctaaaattatattactataaatatgagacaatatattactataaatatgagaaaatagattttatcaaattttattttctccaaaatattttttatgcataatagcacttaggatattataagtagcttcttacttttaacatgttttcctattactttggatgtctacattaaaaaacttttgtacctagtctatttgatggtgctattttctccacctttatctgtgcttatgttcctgcttttgaatttacaatattaagatagcctacagtgaagccataatactaagaacgaactttaactgcattatctgagtgctcaggagcttcacgcttaggccaacaatctggttgtcactgctaatagtaaatgctgagatgtacattcagatttatgtattttaaggcagctgttagaggcaaattctcctttatactctgaccgatatgactttcatgtttttttctattttgtttttatgatactaaccatgttatctaaatttcataattctttcatggtggggtttccagattcaccaaataacaattcaagttgtagttaagtttgaaattcagaaagatgaccgtaactttttagcataactatgaaatattttgcatacttgaatgtaatagttgtatgtgatactttggagatacatacaccgaagtagttattcattttttacctgaagtttaaatactatgtgttgtgctttattctctgaactctaattcacagaaccatggtgctctcctgtccaggctgaacactaatgctcttgagagtcacattgaagaaagccaacatttttaaatctaatggatacattcattttgtggtatgtgatgtttagaaagagggagctaaagttagtggtcatgagctaaataccctgtgaggtaagaaatgaaaatattaacattattatctatgttcttttatgtgataaattttactattttggggatatgacttgtgatagatgcagtatattagtaaaataattcatatatagttactaaatgattacacatatattagtggttcgtgcccaaatattattttactggtactggactgtgattcttaaaatgtggaaattattgtgccttaatactaatcttacacttgttcccacatagcagtagaagtcaactgtgcttagcatggttccatacgttggtagtaattatcagttatttggtttttgtattaaagataaatggattccttcagtagattaagatgtaggaaaagtgttataacaatttaacaaaatatacaatattttctttatatgttcatacatattagtcagttttagagcaatattctccaccatatatgaccttctgacttgaagccaagaacactagcagaatgtctgcattgaaaacataagtaaacattctttcatctcagggaaagtatctgaatgcctatgcacttttccattatttatttattggtgtcatcagctaaactgttctcagcattaaattgatttatatggttgaaatagtaatgcctgcatctagaaaaataacatgataatatcattgcaaacttattcagtgaaattttacaaagggttctaatgtgaaaacatcttgattaaacttcaaaaaagaatcttttccatagaagatctaaatatttttaaaggcacaggaggctatccctccattaaaatctcaagaatagcatcaccatgtaaatatttcaatacaacctcacagatgtcaaaatgtaaagaaatatggtgactgtctttccaaaaattgaaagctagattttaacaattttcttgtgagatgaaaatagtttatataatggatctctcaaatttaaagtaaattagaagatggccagaataatatttaataaaaatagtgaataagatcggtgataaacagactaatgcttttccaacggtgtccacatcctaatccccagactgcagatatattaggtcatgcagcaatgggaaataacattgcagatagaataaaggttatagtcacttaactttaaagcagggaggttatcctggattactagggtgagcttaatataatcacaagggtcctgaaatgcgaaagagaaatagagaagagaaagtgtcagagtgatgctgtcttattagtccattcaagatactataacaaaatatcatagactgagtaggttataaacaacagaaatttattattcacagtgctggaggctgagaacttcaagatcaaagtactggaagatttactgtctggtgagggcctgtatcctagttcagagatggcaccttctacatgtgtcctcacacaactggaagggcaagccagctccctagaacctcttatagaagggcgcagatcccatttatgagggcttttgttgaaaatgtcctaactacttcccaaaggtcctaccttctaataccattacactggtggtttggttttaacatacaaatttggagaaaacagaaacatgcaggctgaaattaatgtcatgttacaaagactcacttggacattctttgttttcagttgcatgttttgggggttcttttaccattagcataaaatttgcttcagctcagccatacaaacacttctgcatcatatacatgcctgtcaccattgtgtgtgctgaatattaaacagtgaaatacagaacagtaaagcaaagttttctaaagagtaaggccaagaaccgtaggagcatagaaaatgagtacattacgtagacatgatagtggatatgctggtgttttacatacactacatcatcacttaatatcatgataggttttagaaatgtgcaattttaagtgtaaaagtttgttttattccatagaaacttagtacctgttgatatctattagcctatggttaaattggtttcatgatacagtatatcattttgattaaagtcaatttttatgaacctagtgattacattaagtgatcacttatgtatatgtatacatatgttagatatgtatgtatatatgtgtgtgtgtacataggctgggcatggtggctactttctgtaattctagcactttgggaggccaaggcagaaggattacttgagcccatggacttgagaccagcctgggcaacagagtaagatcctgtccctacaaaacaaaacaaaacgattatgcacaaacacattatatatatgttacttggcataaaattaatgctgactatatatatgtgtaatgctgacatatacatttacatatagtgtctctcacacacactgaagcattgtgcaaataaatacatgtaatgccgaaggagtattttctaataatttatattacattgtaagtcttaataattgggagaaataaacataatcatagttgtgataattttaactatagaacagcactgaagatgtctaaacttgttttttcagatatacaaatatgtttcctctttgccactacaatgtacatatatatcatgtatgttattaaaaagctgctttgttttacaagttgctgttggaatctcagtcaatacttttctgttcctcttcagcatcttcactctccttctgtatcacagactaaaacccactgacttgatcatctgtcccttgcccctcgtccacatagtgaacttcttcattgcactgttattgcagtctccaaatctgtttgcatcattgaacttcagaatgacttcaagtgtaaggcacttttccacctgagcagggtgttgtggggcctctctatctgcaccacctgccccctgagtgtgttccaggccaccaccatcagccccagcacctcctgattggcaaggtttaaacataaatcttcaaattacattatccatgttttcttcttcttatggttcctcaacttgtctttcagtagtaacaggatcttctacactgtagctgcttccagtgtgagccagacaaatgtactgaatataggtaagtactgctcagttttctccatgagcttcatcctcagggccacgtttcttattctgacaacacttagggatgctttcctggtaggaatactgctgttcttaattgcatacatggtgactctcttattcaggcctcagaggtgatcccaccaccttcacagcaatggtccttccccaggagcttcccctgagaaacgggccatccagaccatactgctgctggtaagtttctctgtggtcctctgttgggtggatttcatcatctccttctcctcagcaatgttgtgggcatatggcccaatcaaccagcaagttcagagtcttgtagtcaatgtctatgccgtgatcagtcctctggtgctcctcacttcagataaaagaagaaccaatattctgaaaaatacacaacagaagtgtcatagatttaatatcaattaataataaaaataattcttggaaaaatgagttcttctgccatcagttaaatcattccagtagcagataacttactttaattaattaaaatatgtaaaagtatacttttattatatctaaataattttgaaactgatgctgccaagaacttgggtgattttttaagtttgatgtgtatgttgactgaagtcccatatgtcttagaagtttcttacatttcattttgattttgtaaagtttatacaaggaaacttttctgtcttcttgagttacatcgttaagaagctcactgttggccaggcgtggtggctcacacctgtaatcccagcactttgggaggcagaggctggtggatcacctgaggtcaggagttcaagattagcctgaccaacacagtgaagccccgtttctactaaaaatacaaaagttagccggacgtggtagcaggcacctgtaatcccagctacttgggaggcggaggcaggagaattgcttgaacccgggaggcagaggttgcagtgaggcaagattgtgccagtgcactccagcctgggtcacaaaagcaaaactccatctcaaaaaaaaaaaaaaaaaagaagaagttcttattgtttataaaagtgttttactttataaatttgtttaggctaccctcattcataaaagatattttagccaggtatccagtataagaacaataataatttttctcggcactacttctctgctctctgactctacacaggctttggacattttgctcttatatttataggtggtttcacttttctttctcacacttcttttagttttctgcttatctttagtattttatagtttgttacattgagttgtatttttatatctttttggtatagtacaattacacatttaaatatttgtatatctgatttacaactttagaaattagtaaattgttttactactgtgattcattattttatgtattctagtgaattgtttttattctatttcaatacacataattatactcatatttttatttatttttatttttatttttgagatttactgacttttttttattattatactttaagttttagggtacatgtgcacagtgtgcaggttagttacatatgtatacatgtgccatgctggtgtgctgcacccattaactcgtcattcagcattaggtatatctcctaatgctatccctcccccctccccccaccccacaacagtccccagagtgtgatgttccccttcctgtgtccatgtgttctcattgttcaattcccacctatgagtgagaacatgcggtgtttggttttttgtccttgcgatagtttactgaggatgatgatttccaatttcatccatgtccctacaaaggacatgaactcatcattttttatggctgcatagtattccatggtgtatatgtgccacattttcttaatccagtctatcattgttggacatttggattggttccaagtctttgctattgtgaatagtgccgcaataaacatatgtgtgcatgtgtctttgtagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgaattatactcatatttttattaccttttgtttatctggtgatatttattcttctaaatattataattcactattatttttgtcagttcagcctaatgccaaacactgtgcattgaatttatttatttttcaattgttcaacttctttgtggttcttttccaaatatgcttgttaagtttatagtttcttgctttgccaaaatattttcattttctattttttaccatttacttcacttaagcattttaaacacattttcaatatctgaattttatgtgatgtctagtttcttctaattcttcatcttggtagcttcttttgtacttcatagtatgtgagaaattataatttaaaaataattttggttttgtatttgagagattttgtacaaaataactttagtcagtactttttttgttgtttattccaagaaggtagttgaataatccccaaagcctgaggtccctgtgatcatccagtacctggaggcggcactggcttctcactttgattactcctctgggttgttcttttaatttacttcttgtcctggaaggttccatgttttctattagctttggtgggtattttatgaattcttgtaacttctgagtattttcagatgtctgcatcaaatgagatttgtaaatacatttttgttctaaaacatcaaatattcaccatgcatctgtaagtaaaatatttcacattgatatttgttgcagaataatgtctcattggaaatctcaacattcttcatttagaacaccaccgccaatatctaccatatgccgggattattgtgcagggtaatttttattattacttgaatgtatatttatatactgcaggaactatacatgtttatggctagaattactgtttttccttaatattaagatagtattggtagatttaattatctgaatttagtcatttggctccagtcaaaatggtttctccttagcagtactctgactttgtaaaagtaatcacatttggattctgtttcctccagtagtttttaaaatgatttttttgattattcatataacttttttttaatgatcttttaaaaactagtatgtggttatatattacttgttacactttttgttttctttattttttggttggttacaccttaaatgattatttctattgccttttaatgttacttagaaaatatcacatgtaagacttttgcttttataaagttagtaatacattttcaagcctaaactcttgaaattttaataatttctatgatatttgaaaattatttttatcttcttttgagtgctaaaagataatatttgtctacctgattaactagcacaacttttaaaaagttatttagcactctttatattcattcatttgttttctacgagaaaacttctttctctgatatttgtgtgtttgttttagagatgggatctcaccctgtcacccaggctggagtgcaatggtatggtcatggctcactataacctcaaacacctgggtttaagcagtcctcccatctcaaactcccaagtagcaaggacgacaggtgcatgccaccatgtctggctaatttttaatttgtagacattgcccagcctggtttcaaactccaggcctcaagttatcctcccaccttggtttcccaaactgttggattataagtatgagccactgtgcctggcctctagaatgattttaatgtcacctaatatttttataaaggtataaattcctcacttacatgaaaatttgggttacacattaaactctttgttattaaatatatacatacaaatggcttggaattgtgcctaaaacatcatatatcctaagtattaacaactctggagctcagtacaatggctcacacctgtaattccaaacactttgagatgctgctgtgggactgcccacaggagttcaagacaaggctggaaaacatagtgagaccccatctctagaaaaaaatttaaaaattagcctggcatggtgacaagtgcctgtagccccaagctactcaggagggtgaggtgggaagatcacctgagctcagaagtttgaggttgcagtgagctataattgtgccactgcactccagtctgagcaacagagaccctgtctctaaaaaattttaaaacaactctaggccgtgtgtgttggctcatgcctgtaatcccagcactttgggaggctgaggtgggcggatcacaaggtcaacagttcaagaccagcctggcctacatagtgaaaccctgtctctactaaaaatacaaaaaattggccaggcaaggtggtgggcacctgtaatcctagctactcagcaggctgaggcaggagaatcgcttgaacccgggaggtggatgttgcagtgagccaagatcacgccactgtacta

SEQ ID NO: 771 - DNA, 26960 bp, Homo sapiens
gtctctgtgtagtagtagaaaatctggacttcatttaacactcaattcttgcctttccctcctcaacctgctgcggctgtagaatctggacccatgccataggaagaaaggggctcctcttctcccaccccctgctggtttcagaatttctgactcatcctcagtgggaatggcgttggtgggtgggagaggtataagaaaggtttcatttgacatgtaatctgacaccagctacttagagctgtagtcctttaaagctggttctcttctttgggtgtttgtgggttctgcagtacccccaacaggcactgagaccctctcgcttgcagttgcctggacatgggtgaatgtctgccctggcagcctgtctatataggcgccttcacaggggagtatcacactggtagccaaccgtcacgggcaggccccacagacaacgccaggcctcttctcattccccatgtggcccacatctgaaccatagaagcacttccagaccctgtgctctcccagacctgggattgtaggcctttctcgacatggccacctccaaggcaccccatggctaccttagtcttatccaaggctggactcgtggccattcacggctcccagagatacaggtcaggttaagggaaagggcgcacccaccactccccacagtcagagaggctcacaatatccttgacaatgctttccagaaacatccctggtgcccaacttcctggctccttcagtctcagctctgtgactcctctcgatgggcgcaggctggagccacagcccctggccctcagccattctctttccaggtcatgtgtccgtgtctggctttggaatgaggaagagctggctcctgctctgggggctttcagccggagcaggcagccggaatcacactttcatatcctgtggcttatgtttattgtattcctgatttattgattttagatattctctattgattcctactgtggaagatggagatacggccctgttacatcacctgggcccccgcttctcttccctccatcctctcagaacaggtacatcacactttgttggttacattggtataaattatttgcccagttatgattatgtgtgatttactgctgaacaaggtggtgtattgtgatggtgttgccttcattgtcggactcttccccctcgaattggaaaattttttcttctttttcatttttctcactttctttaccctcatcagttcttcccagactgtccagtggaattataaaactcctccgaagagtcttttccacgtgacgggacatcctgtgatctctccatttcattctttctctggagacttcgctccggggccttctcctcccctgctctgtctgacccaggcagctgttaggcctgcggcacacctgtggtctgagatgtgcctttgtctctcccccatttcccgagtctgtctcttcttttgtggttgacgtcttcatcttcttagtgtacatcctccagtggcttcctaaggaagggtgcaggggaggccttctttctgtgacgcatcctgtctaaaaacatcatattcttccctcatgattcagtgataacttgtttgggcatataggattctaggttggaaatacttttcctcagcattttgaaagcattgcccttttaggttttactggtgctattgagaggtctagtgccttcttattccagaatctttgaacatgacatatttgttctactctgaaagcttttgaaattgatttcaattttctcaaatttttaatgatatgccttgatgttttatataaagtgtgtttttaatctttttttttgggtatctggtgtttcccttccatgtggaaactggtctttccctgtttgggaaaattttcttgtatgatttcttcctattttctcttttctttcttccagaaattccttcctattagtttgatattggacttcctggattgagtctctggttttctgtttgtgtctttttctcctattttctgcttttatcttttttatactactttcttggacatttcctccattttattttctaacaatgctattttttttattctattgggttttttagttgctaaacactgttatttcctctttcatgaatggctatcatgagttttctttctaggaatattaattctcattattttgaagttttgttttgcttcctgctgtatttcaagtttttccaaatcttttcctacttgttttggtttctctctttcatgttagaggcttttcttaaataattatctctcggttcattcctgtgtacgagtaagccttagaaacggactggaagccctgtgcatggctgcagacctgtgcatggctgggaagcatcaagagtaggtttcacttttcactgtaggatgaccagttcttcttactgaagaacccacaaaagtcagtgtccatagatcttttgaggggagagggaagggcaattccatttttccaaagaaaacgcttcccgtctcctgtttggagggtatgataagcccagccaacattcttggagtcgagcagtgcaccccttggtccatagacatgactcgatctccctgctttcagtaccgcaccaccccttcacctttctgtgtacgtggtatatggggtctggagcctttctggataagtttttctgtaggccaaacctctgttctcctctggggtgtggtggtggtgtttcctggtttcccggaataggtgagaggacctgggattgatcagatctctgtcagatttgagccagtccactgctcccacccattccccatccaccacgttctcccatacctgttgcctgcagtttctgaatctttctgggattctctggtaccaaccagcttgcttctccttgttaacccctctgcaggcatttggtgttcagctctgtttgtttctctttcttttgtctccttcccttccaaaaatggacttgcattcctaatccaatttatcttgggcttatacctcattttgttatttttattcctttgccctcattttagagatattttaagaaggatatatgttcaatttaacacactttagtaatttacttatttatatttttattagtagtaaatatgtagatattgacacacacatatatgtatcattatatatataagtatattcaagcgatccaaagatgagtagtggaaaccaatctcccttttcctttgtccttcacttcctccccaggagcacccacaggcccagttgcttgtgtggctctccacagaaagtttatgcacacattcacatagacacacacaaaagcatgatgtagatagtgatggattttattttcaatagaggaaatggtttatctgcatacccctgaacaatattcctattttaagtaaaggttagtgcttaatccaaagacacaaatctcctttagtcagatttcaggctccattgcaggtggtaggtatttcagggggccctccaagtgcccctttcaaaaacccatgtagttggtcaccttcacaaaggccagctgtgggggcagaggggcacacgcatgggccagctgtgggggcagaggggcacacgcatgggccagctgtgggggcagaggggcacacgcgtgggccagctgtgggggcagaggggcacacgcgtgggccagctgtgggggcagaggggcacacgcgtgggccagctgtgggggcagaggggcacacgcgtgggccagctgtgggggcagaggggcacacgcgtgggccagctgtgggtggcaccttccacttctcatatggctgctgtttccccctgcctctctctcctgcttagtccctatgtttcttcctgtttccacccttccccctctggtgtgtatggctggcccatggatctgaggaagccctatcctagctgagggctgcccctccccttactgcctctttggcactctgggtttgcgctcagcctgcccctggccgactagactttataaggacagaacccagagacacctctgtgtacttcagggactgggtctagcttgagggggctactcgatttggccacagcagtgacatcagcatgattcttcatccttacaacaggacctgccgctgccaagccagacttgatctccaaactggagcggagggctgcaccctggatcaaggacccaaatgggccaaagtgggggaaaggtcgtcctccaggtgagtgtaaacctacagcattctgaaggacatgtgccagggcccaggcggctatgatgagtcaaacagcatgagctcagctgtgctcatctgatgggggccgattgggcaccaagcctggcaggaggccctgggtagacaagatgaataagcaactaaccctgcccacagagtgtagagtagtctgggaaacagggaaaaaacaggtccttttgtaagcagaagtactgatggaggctgtggcagagctggtgggagcaggtacgtggggacactggtctcgaggagccaggggacccagagatctgtgagcctctcatcccttctccctccttctccagtgctcggtgacagcactattggtttgtgagaattcgttgtcttgcctatctcaatcagtaatttcttggcttgtagttgctacacttacttctgtacctacttccttctgaggcttgtaaaagccttggcaggtgtttaacctattctattgtggagcctcacacgagagtgaaagccacctgcttatccaacagtctctgtggccaagggggttaattgaacttattggtatctggtgtcacatgatcccagggtagctgtgtggatagggtggttggggcgctggtgaaagaacccacaaggattagcaacaactctgggggagccagatgaactttcacagatgagaatgggtgagggtttaagtggacgccactttctctagaaagaaggattgcattcatcttctctgccttgcttaagggatacttattaaatttgggggtgtcttagctgatagaagatggcagagttctgggtagcagaaccaagcatgattcaattttctccaaagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctgcctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagtaagtacacgtggcagagctcccccaaggcagcctcatgctgagccagaggccaataagacaggactgcaggtgcctgtggagcttctgtcatgcacccacccatttgctaggccagtgggtactcgatgcgtgacatccaccctccaggagcttgcacccctgccagggagatgacgcacatgtgctctaggcagcagggcttagtgcagagagcgtgcatttctagagcctgtctgccctggtgacagtgctgtgctggctctgcccccaactggctgtgtggccttgggcaagtctgtcctttgatgccttggtttctcatctgccgaatgagttgtgtgtggaaaacactcaggacaatgcctggcaggtggtgcaaatggtactagttaaaggtcaagaccactgctgggagtaaggagagggctgaccagccccaggcagcgccatcacattctaagtggggctgtatagactctggaccgtgcaggaattttcaagagggaagaggtccatgtggctgtggaggaggtgagatgcggaggagatggtggggctttcaggcagaaatctcacggggcaggggagaacagaaacagcctctctggaccggagggctggggtcaagaacttgcttgagggggaagctgtattagaagggagggcaagttactgaaagccacagacaggaaatttttctcttcaagtagtcactgaaaaccaaagaaaatatgcccattgttggggttctccagaccactcgcgaccacttgacaaggatggagcagtgctctctctcctcgcgtctctagctggcctccttccggctgttgctgctcccagtgctctctctcctcgcgtctctagctggcctccttccggctgttgctgctcccagttttcacctctgagtctgtggtcaccagaaatgggactggatctcatggctgacagaggctctgtaggaagcaaggtggccctgaagccacagtagggcaggtggggataagaaaagagacccctcactgataagagaaagggaaagccgagagagggctgggtgagttgctctgtgtccagccctgtgggtgctaaggagaaaaaaatgatgtcaggtgtgccctgatgcgagttactctttccacagggacaacaggaccagcacagattggtccaaacactgccaaactacgcaccgctgcctccttccaggcagggctctcagccttggcattgttgatgctggggctgggtaatctctgttgggggcccttcctgttcactgtgggaacttgagcagcatccatggcctctacctattagataaccactggataccagtagcacacaccccatttgtgaccacaaaaatcatctccagacattggcaaatggcccctgggggacaaaatcgcccccagttgagatcccctatctcaggataaaagaatgaacagagtagcaacagatgagggctgcaaagagcagtcgtggtcctgacttcagtctgttctgccaagctttcctcaccaaacagcccctgggcgaagctggatgtggaaggcggtcactgtcagtcagtctaattgtattctccttcctccctcacaggcgccaggctcaggaaggaggagatgggagccctctatgtggaggagcccaggacccagaagccacccatcctgccctccagggaagcagcggaggttctgaaggactgcatcatggagcctcccgagagactcctgtatccccacaccagccaggaggcccccgggatgtcctgagggacagggagtccttgggactgccttggagacgcctctgtgatcactgggacaggctctgcagattctaggctgccctaggatcttctgctggtggcgatggtctctaagcaccaggaagtgggcagtggcatcccagagcagcaggggtatcaggaggtgcatgacctgtttcctgaggccccactcagcacagccatgcctcacagcacacaaatgtgccagaaggttctatatctcaagttcatttttaaggtgctgcagaaaataaccccatcatgaaaggtttcagcccctgagttttggtggcaagaggagtgtcctggtaggggagactgttggacatccctggggaatgttccagggaggctgcccacagtctaagtgggaatgggaaagaccaccttgttagagggggaggttgcccctgctctagggacagctggcctggctgcaagagcccccagaggcattgttctgggacttcctaccctggctcccacagcagaagcagtgaggccgtggtctcgtgcggaactctacctcttcccagggcttcctttagggcgaaacaatcacaagccctttgcacagagcacccaagaaagttctcttcctgcagctccagatggtggagctgggctcttctggcagggggtctggtgcttcccggagagccgagccgcgtttaacccgtggcatgcccggcccggtttacccaggagaggatgggacgaagttggagttgggaggcttgggatgcagccccagctctgctgcaggcagtggtctgattaatcccttcctctttgtgcctcagtttccctctccatgaagtggcagcagagatccaagtgcctgctgactccccatctgccctaggattagtgaatgagagcctcgagctccctcaaagacctctggctgcagtgtggacttagctgccatctgccccatcctcgtccttagtgggacaggtaggaatttgtctccaaagtccttgttgtaggagttgctctctgaatgcaccatctgcacgacaggctagtccactcttctctgagctgccctggggactctgcaccaggatctccagggcccactgagacatccccgaatgggcgctcagtgacaagggctttgaacaacctcctccagggactttgggcctgctctagcttcagaaccacagaaccaccgccctagaggcacagaggggcttctggcactgctaggttcacaccctcctcgccccgatcttccttccacctaaagtgaagcacttttccttccaagggcagctccgtcttggcaggctcaggaggccgcttatcaggaggaggatgattttgtctaggttctgccttccttaaccatgggcaggaaatgaggcaagtcagcaggcagggtttctctgccctgcctgatacttgttttaaacaggcaggaagtgggcgccatccatcccagcttgcttgctgcctggctcaggcaggtcctgtgctgtgctgcaggcccctgtgggtgggccctttctccatagtctgccgcttcccattcccagggtagatgctggcatctgagcacctgagtacccttcctattcccagggtagaagctgctgtctgagtacccttcccattcccagggtagatgctggcatctgagcacctgagtacccttcctattcccagggtagaagctgctgtctgagtacccttcccattcccagggtagatgctggcgtccgagcccctccctggtaccgcaggtaccctggtaccccacctgccctttcatccccaccccagtacttagccttagcactgttgctttcgtgtcattttcagttctagtcaggaattcctttcttgctttctgcctttgacctgtggaaatgtctcccagccctgtgggtctggcggtcagagggaccccacaggcctgtggtgcgggagctctgggaggtgttactatctgcgtggctaaggcacacacaggcctccttctccccatcaccgtctccatgggcgttcaggaacttgcccaggtcaggcactgtggatgtgaactcgtggaaagggagggagaaaggcttttttaggtggggctatagcctctgccctacccacagggattccacatcaaggtgctgttccagcacacatgcttcctgcggcctcttcatccttgaagaatccctcagagcaggaggccatcctgtgagcagccgtgagtgggtctctgtgggagtagttctggagctgaggtggaagctaggggaagcaactcgccctctccacgtcagcatcagcgtgctccgaggacaccggccagtgccttccttaggtggtgggaaaggggggtccctgtgcagcggggccactgagaatgctgtttgtcataaaatttgcactacccgatttctcaaggggcacaggcctgctccgttcccctttgtcagccaatggccaagaaggaagaagatgactgccatcttattcctgaacttcctcattcaggacccccgtggaaacacagtgagcatccttatcagaggccctggcccaggctggcccctttgctttgtttggagaggctggctgagtttcagcccctagtgctggagacccccttgttggagaggcttcctgtttatgcctcacaagaagaaaaaccacagggctctgggaggggaagaagcatgcactcccgctttggctggagtcccagcgcttgtcgccaccctcctccttgcctgtagtcttgacagcatccgtatgtacgtgtcctggcatttcccctccctctccctgatgactgatacccaccgggtctgacattccaagtaaccagtatgtaactggtagtttgatcccaatagccatagcgactccaggtgggagtgagggagcccagccccctgtcctggaagataccttagagtatgtgaccgcgctccagacccttgcttctctctcctgcagaggatgagtttctagggtgctaagtacctatcagaacagtgtggaggggcgggtccctcatacaggtgtgtgcttagccaaatacagtaactgtgactggcccagggatgttctctcctctattttcaaagatgaaaggaggttttaaaaaccatgtttgattcctaaccttttgctacctgaataaagcagagtctatttcaacacatctctgtcttgtgtgtccctaagcgaggaccaggagctcagagaagctgacagaacgagctctgctctcactcacgaggggacagggccaggaacagaggtgggcaggggaagtgcctgtgtattcacctgatttttgtctttcagtttctttcctctctagtccttcaaagtgagctcaatcatttttgccagttagaaggtaaagatgagagttggctgtttggtgagttataattaagggcttggctgccttttctggagtactgcatagtttacaaagtgctttcacatacatgatctaatttggtttactgaacttagaaaggtagactttcaaggaaaaaacatcgatttccaccaatagtaaaagctactgcatcagacctgtcactcaacagcgctccttgaggcctagctcctgagatccctctggcgagcccttgcggctccacatcctcgggacggcacgctcccacgggactggagcaaaggtttcagagactcgggatacagccagatctcttcggtgaggagactcagtcttactcgagtgtatgtgatttttaaaaaagacattgaaacaactatggaaacagaggcaaaggcagcaaggctttgggtttgcgactgggaatccgtgcggcctccctttggtgaagacctgaccccgtggtgggggtgaacagggtttccttgaccccgtcccagggttcccttcaggacagatggatttcactaggggaagcgtgatgctggtagcctccactctcaggctgggcagggtaggctcccagggaggcagctcccagcgcagcctcttccatcactccggctggagctagaaggagagaagtgagctgaggctctagaaagtgctgcactcctgcctttctttttcccaagggtgctcttgacatctggagtgcagtcagcaggcctttccgagtgggctggctgcctcagatgcctcagtccctgttgctggggatgcttcggtggggcctcctcactgtgggccttctcttgggtcagtgtgatcctcgtgtcccttccctgtgccagcgacactcgtgggcttcacgtggctggcccctgctcccagggctcttgagatgctgcctctgactgcagctcctgccacactggcacctgtgtggccgctgctcccctctgcacctgggaatagctgcccagagacttcctgttttgaaccttttgccttgctcaggcagccagcaagggccctggcactcacaacagaagggccctgcagtgctgcggctctgctggcgggccaggacaagctgtggggcgcagacacactgggcacactccagacaggcacagggcctctgggcagtgagtttgcaagtgttttgtggtcctggatcatgcacaggcttcttggcagccaggagaggctgtctctgcatttagtgtgcacacctgaaagagcggcccctcacccactaggcagtgtcctcccacatccccaggagggtcttcctgtgccatctgaggtccacttagtggaaagcctttgccacaccaggacactttcaggactactcccccacgtggctgtgctcatggtggccagggctatatggctcttgaagctctccacacacttggcacagatggatggcttttccagtggaatcaaaaggactcaggcattctgaggccagtctggccttggggtttttcagcttcccagaagcctgcagaatcgttctggggggttcccagttgcctccagaatcatcttcagtcttgtttctgactgtgttaccaaatactgtggaagaaactcagatgttagcctagtgatggggacacacttcttttgttcagtgtgacctgctcagcctctagcccccagccccagcgagatgacggataaggcagcgtcctgtggatgccagagccggggccaagtgtgggtcagcatcccagctcagaggagcggcccagtttgtctgagaacactgaagtcccagagccctggggaggggcttctgaccagcactcctcctgctctcattccaacacacacaaagggaatgtcctggtccagggagccagggctctcttgctgccatgtgaataattccctgtagcagccactgctagacagcaagcttgggaagccttcttatgcagaaatcaaagtcatttttataaaaagtgtcacagagtcccttatgaagacagctggacagagcaggagccgacccttccctgactgcccagttcagtgagcccggtaaaatatctgccgtcagcagcctgccatgaggtgcagtgaggaccttctacttcatccctccaagctgagtcgtatcataaaatgcatactttatgttccttctgcctgtagagaatcagaaagcacatgatggaggtttcagaaaagggcttgtgagatcgagcatgtcagagctgaagatctgtgtctgtgagacatgtcctcctgaaagagcacacatgagctgacatagccacggcgccggattgccctcaccctgattgtcccatcagtgtagcttgtctcaagaggtttacactgtggctgtgtttctcacaggttacccaaactcctatcataaaggcaggaaacagaagtaaaaaacctgaatccaaaccacaggaagtgctgcggagatactgattcgtgggttgatcagagcccaggaggcactaaaggctcaatgaacatggtgatctttgtgcaagagatgttccatcaaggcttacctggctgggtggtagctttttggcctctgttgggggctgggaatccttcacccaaagctcatgttccctttcaagtctacaagtgatctctggtttggcagcagcatgcactgtagggagaaagacagcccagtgcccctcaacccacactgagcgcacatagacccgtgtcagtcctgaagcctgacttgcaccacccatttaatgccctgggctcaccctatcaatttgggacagcgggggtaggttgtaaacctaagagagctccagaagtaggcagggcctggcatacaggtagggatgtttatttcagggcaacttcaggagtgccaagggctgataaaacagtgcaattgtcataatatgttttcccactgccagggcccttgaaggagaaacaggctcaactagtcacagagacaaccatgctctgggtctagttctccctgaccccacaggccaggagtgcccctattagatggcaagcaagcaaggggccaaggtcctcacccagcaagactcccagctcctaattccttcttatcacatcctggtataattccttctactcatggccaccagaacaatgggtggaaggtaggtggttacatcattaaatgtcacaggccttatttgcaaagacagagacatctggagctgttgttctcacctccgacacgtgccccgtctgcagagagcattaggatgcatctgtggctctgaggtgtgatttcctagggccttcaagtgtcctggggctcctgttcatttgcactgggggacactcagggaagttttaaagagcctctttcagtggctccttctccttctaccctttctaggaattcatcagccccatgaaaagatgaacgatagagatgtcaccaacatcaggaccccactccctgggagatgtcatggaaacttgtcaatcacacccaaagcactcactgaggagccatggcagagcagtcggtggcgccaataccaaccagaagccgccagggcagaggggaaccgtgaagccagtggaatgcacagctccacctcaggggaccggggtaggcggggctgtgtctggtaacatgccctttgcctcacattagtgcctctgaaaatagtgtcctcagcctgggcacaaaccctaggggtgagctgggagtgtggaggagacgctggattagggagaagtctcggccatgtgttctggctcttttactgatgagctgtgtgggcctaggcaagttacttcacttctctgggcctcagttttatcacctgtaaagtgataggattgccttagcctctaagatccctttcagctaaaaacaaagttctagaaaataaatatgtggtactgtggaactctggggagctgtttgatcaggtgaacagtttacccatggaaatggggctccagcacaaagctgctcacatcttccagtcacgctccagggaacagccagggcttgtgggcccagatgaggctttagtggttggagaaggagccagttcctggttttaatcccttcatggacctcagaccatcacaaagctgccaaacaaatgacacaggcaatcacatgcaaattaggacagaaatgaaacatcaaagacattaaaggaaaagagtaagagctgcaggctgctaatatgagtggctgctcagactcagcaatgtttttggttctggccaaagccaagacaaaggagcagaggcaaagaaggaaatacatttcactttacagctgtcattttctacagaggatttttttttttccagaacaaaattcaaaaagtccgtcttttttgagctatagaactttcgtggtgattttttttttttttttttttttgagacggagtctcactctgtcccccaggctggagtgcaggggcacaatctcggctcactgcaagtgcaagctctgcctcccgggttcacgccattctcctttcagcctccaaagtagctaggactacaggtgcccgccaccatgcccagctaatttttttatatttttagtagagacggggtttcaccgtgttagccaggatggtctcgatctcctgacctcgtgatccgcccgcctctgcctcccatagtgctgggattacaggtgtgagccactgcgctcagccctcgtggtgattttttgaaggcctgtatggacatactcttaactctatctcctggatgccaagtgcacccttatcctaggccagtgttctcaacaatgtacacactctggatgagaaaaataaccattgtttacaatccagctaaaatctcacctcctccagggagtcttcctggatttctccaccctctgaattctcataatgggcatttggctactttgatcacagggctcttagaactgcgctgtccagcattatgattttaccagaatatatcactcctcaactactttagaaacccctcgaaggctaggatggtattttatacctaacagtttggtgtcatcccacgcccacctccaacttacatgaatgttggaaggatggatagggaggtttcaactagagaacggagaagggcggatgtaactggttcttgatttcagaaaacagccaggagcacacatggctgacggggtcagtgcaaggacaggcacatttcccttctgcatcacgtggggactgcgcctccctatgtcatgaagccagggaatatgtgtggccggccgcttggggtagcacttgttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcgggtaaggaaagcgcgcaggccctgcagacctctccaccccggccccctggcccggctcgcccctccgccccggggcggcggcttcctgctctgcagcgagcgtccgcaggagggacgccaggaccccggacgccacctctgaggtctctctgcacctgggtctctgacagccgggaacaggcaggaggtggggcgagagggcatatccagaaggtaaagaggagagtgacattggagatgtctgtcacccctcctgcagccagtaaagggcacaagtgggcactgacgcagtttctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtaggtatgggataagtttagctggcgttatttttcgaaggtcctctagcagattgctgcgccattcaccagtttctgcttcatattatcttcagttacaaagcacccttcccttgactgcatgttcccaggggctggagtttgtccagttcaccattgtctactcagtgcccagccaggactggcacaacctgcttagtaatgttgaaaaagggatcgcgtgctcctgtgtccagcaccagcttgcagtgctttagatcaaagatcaagggcctcgtttggattagagttagctttgcccaaaggccgtttggacatgtgagtgctgcctttgttcttaaagacaggcagggtttgggatcccacagcttcactttgtaaaccattttcgtgtcttgcgtctcctgctattcttggtgagttcttgcttcagtttgactgaaatttcttttgctgcacttgaagcatctgtctctggtcttctctgagtacacgcaaagtggctagtccctgttctctttgtaacaactcactgggcctcagaactggctcacagtctgcctgcttcttgccctgtcttctagcctattgttttccttccccttgctccatgaattttgaattctacagaccactccctgttgggttgccacaaatgcagctctgtgcagtgcctttccacaacacgtctgcattaagatggagcaatattgggtggtagagaagggaaatgaagggaaggattcttaaggcaacttggatgtggtcaaggttggcctctctgtgaggtgacactttcagtttttattttctgccttgctattcttaccctgagtagaactcagcctcctgtgtccaggaggcatcaggaaggccaatggaaaagagctcacaccaggagctcttcttgctctggtcctggccaggccttgtgaggtgctggctgcatttgttctgacccgtgtcctcttctgctgcagagtgatcatcaccatgctggtcgccaccgccgtctgctgttacctcttgtaagtactactctccccagctcaaagtcagccagttcctttgtcctccctcctttcctcctcaccctagcctgctcttccttctgtcctggtagtaaatgcctcttgaaaggctgaacctataaaacaacaggagtggaggtggtgtggaatgggaaagagagcagtgggccagaagtcatgaaccctgggctctggatctggctctgcccccagagttctggcccccatgggctgtagttttctcacctgggcaaggaaggaggcaggccacctcagtgctgtctgtgcctgactgggtcacctggagtgattgttcaaacacagttttcaggctgcaccctacacccatgaaattacaactctcgagatctgcacttgggaattcctgttgttcatgaatgcccccaggtgactggaatgcagccatcttagaaccactaggtgagaggccagacgtggcggctcacgcctgtaatcccagcactttgggaggctgaggtgggtggatcacgaggtcaggagttcgagaccagtctggccaacatagtgaaactccgtctctactaaaaatacaaaaattagccaggcctggtggcgcgtgcctgtagtcccagctactcaggaggctgaggcaggagaatcgcttgaacccgggagacggaggttgcggtgagccaagatcttaccactgcactccagcctgggcaacagagtgagactccgactctaaaaaaagaaccactaggtgagagtaagtcatcaaacttggaataggtaccctggggatatagaagaacattccaagggacttgaatacctggagagtgtgaggaaatcagtttgcagatcctcagtgtctattgtttagtctcttgctaaaactgccattcacaatagccaatccctctttattaaaaaaattttttaaaaggaaaaagaaaaagaccctgcccccgcatccatcccaaacctgcggttacattgctccatgtttagatgatcctggctgccaaccaagagataagttcaagttctagtttgttgggaggcctgtctcatggttaatcaagctgcattaaggctgttgggtttcccatcttcctatgtcttgtacattatttttatgggttaagcttggcatcgttgggtgttcttaattcagaataatcaaaacaggacaggtaaagtgatgagatgctcattctttaagaggtaacagattcttttgaaacaactggaatattttccagggttgccaaatttttcaaaatacataggacaaaacccactttcaaaaaatttacttcattgatttaagatttgatgttatcatagttaaaattgttttatctgattaggtcatggattctttattcctattaaccaattctcttaatttaccttatgttttattgattgattgattgaaatggggtcttgagaccaggccagtatggtctcaaactcctgggctcaaatgatccttctgcctcagcctccccaaggagctgggatgacaggtgcacaccattgcacccggctgttaactaattagataattgacagggtcttactctgttgcccaggctagagtgcagtggtgggatcatagctcactgcagcctcaaccttctgggctcaagccatcctcccacctcagcctagctttgaccacaggcatgtgccaccatgcctggctgatttttaaattttctgtaggacagggtcttgccatgttgctaaggctgtgcttgaactccttggcttaagtgatccttccacctcagcctcctgagtagctaggattacaggtacacgccactgcacccagaaatgtataagccctcctactgacaaaaactaaacttgttagaaataatgatgactattaacacatggtttaacttaaacccactttttttttttttttcaaaattcttcctggacagagcattctctgaggtcctttctctaatgctatttctaggtccttcagggcttgagaaaagatcctcatctgcccatggcagggcctcagaggggcttgtgtttggtggctgggagggtgggggagacggggcctacacaagatgcggggtaatcccaaataccaactgaatcaacatacgggaaacagaaaacacactgcaaattggatgcatacaggtagaaaggtggggtcattctaagaaaatgttacgcctagaaattatatttacaaaacataaactcggagagaatgctgatgtaaaggaggtaacaatttctgatggcttcctgggcgttaggtcctcctacctactgtgagggattcaaagagggaaaataccgatccttcctgcagaaacagacaaagcagtgtggatgtggtcgtggggggcccttccaggtcaggcactgacagagcgtggggacctactaactactgtggcaaatgaagttgggagctttgtcatgaatgatggggccagacagccacccacacgcccagcagtgatgacaggtggggcaggtccctgagggttttctggcctgaagaacagaggtggcctggcagcagcctgaacaggaggcccctgacccgtcagctcctcacgtcttggggtagttccttctctcataagaggaggtgattctgacgtgctgcccgccaggcctgccctgttcgctccctggtgcatggagccgggggagcctggacagaggtgtgtgagggcacagctgggagtcgctcccaaagcgcccctgaggctgcctcccctcttctctaaccccaggttcagccccaactcggggatcctgcagatctaccgaacatcaaatgaaaccaaaaccaaacccagaagtgccataccaaccccatgtgcctgccggagtgtggatggctccctgggcccttcttcaccctgggaacacaggccctgccatctgctgggttggccgcatccaaaataatatgaccgaggcctcccctgggtgtgggaggaccctcctgtgccaggctcaccatgctttgctgtccctggcagctggctcatcgccatcctggcgcagctgaaccccctgttcgggccccagctgaagaatgagaccatctggtacgtgcgcttcctgtgggagtgacccgccgcccccgacccaggtactgtgtgggcgaggggtgtgggtggggaagaggggaaagacaaggctttcccacacccagggcaggcctcggtcatattattttggatgcggccaacccagcagatggcagggcctgtgttcccagggtgacgaagggcccagggagccatccacactccggcaggcacatggggttggtatggcacttctgggtttggttttgatttcatttggttagagttcttgttgggattcaggcatctatttatttcatgaaaagaaaaggtggggaggggactgaacatcaactcccttcctgcctggcctgtgttggccgccagggatgaaatgggaaccatgctcccagcacccccctcccccatcctcacagcgcttcaccccaaggcaagaccctaacctgggccctaacctggacggagggagggaaagggtaagctgaggactatctgggcaggggtgagggggctttccagggagggttgggggcagtggagtctccactgcaaggccgggacccttccatgtgatgtgcttttcaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaagattactgtttggtgacaaagccctggcctctgcctgtgtgcaggtcccctgccccgcccacctgattcttgtttctccagtgggtgggtctggggaggggagcagggaaggattctgggagctgcagttatgaacacagatatccaggactactttcctgagatctggaggaaaatccggccccctgctgactgcccggattcggcggagaaccaggcctggcaggaagaccgaggacttgttcaagtgcagctttgagcaccactcgtctgggccccagaggacacagtgcaggactcctgcagtgaagcaggtcgccagaggcttcaaagcctccttcatgaaatagcctagggctgggatctgccagcacatctcgctgcaggtccagtggggaagtgggcagagggagcccagccctccagcccagcctgtagcccagggcagagctgaaagaacttccctggagggacaggagggtggggcgggactggaagacgcacaatggaggcaccagagcactgagggcggaaagccagctgaggagcttggatggatcccaagggccatgggagccgtgaaagggatttaaagcagggccgtgacatggccaactggatttctagcattatctatctctacaagctgcacagtggacggcaggctggtttgacatctttattagggcccctggtggaagtggtgaggacagagaagcgaggggggagctgcttggctgtgacccatagagaccgaggctgcccgtggtggggagtgcagcaggggcaggtctgagagtggctgtgggagctgaggtgttcctttgtttcctggtgagtcgtgtgtgtccagggcaccccgtggaagtgtaggtagtggctggctgggcggtggggcggatggtcaggaggaagatgaggctgcaggaggcagagttggagccatcggcataaataaccggtgatccctgaggggtgcaggttgctcagggggttcagagtgagaaaaacccagaagagaaccccaaggagtgtgagttcacggggtgggtgggtgaaggtggcctgtggaggatgccgggaggttgcaggtagccggaagacaaccaggtgagtgtcactcaggaggatgagaggttcaacaggagagagtggttgaggtaacacagacccccattgtcctctacccccaagaagtcaaggtcagctggcatctttggtgatgggcagtaaagtcagactgcagtgggctgggagcgagtgggcaggtggggggtgagaaacacagtgacctcaggatggggaccccgtggacccagtgaagctggacctggaaagaccaaagggagctaaacaaggagggacctactgggcccattttcccatgtcgctgtgggtcagccctgggcctgggggaaccactctgccagttcctgccgctgcacctctgaagccacacccagcccgccacaggcccaccatgggggcttcaggttcaggatgctgaagatccacgttggcccaggattggggtggggggcatgtatccaaaatggctacttccttgtctcggcttctgctc

SEQ ID NO: 772 - DNA, 7868 bp, Homo sapiens
gtctctgtgtagtagtagaaaatctggacttcatttaacactcaattcttgcctttccctcctcaacctgctgcggctgtagaatctggacccatgccataggaagaaaggggctcctcttctcccaccccctgctggtttcagaatttctgactcatcctcagtgggaatggcgttggtgggtgggagaggtataagaaaggtttcatttgacatgtaatctgacaccagctacttagagctgtagtcctttaaagctggttctcttctttgggtgtttgtgggttctgcagtacccccaacaggcactgagaccctctcgcttgcagttgcctggacatgggtgaatgtctgccctggcagcctgtctatataggcgccttcacaggggagtatcacactggtagccaaccgtcacgggcaggccccacagacaacgccaggcctcttctcattccccatgtggcccacatctgaaccatagaagcacttccagaccctgtgctctcccagacctgggattgtaggcctttctcgacatggccacctccaaggcaccccatggctaccttagtcttatccaaggctggactcgtggccattcacggctcccagagatacaggtcaggttaagggaaagggcgcacccaccactccccacagtcagagaggctcacaatatccttgacaatgctttccagaaacatccctggtgcccaacttcctggctccttcagtctcagctctgtgactcctctcgatgggcgcaggctggagccacagcccctggccctcagccattctctttccaggtcatgtgtccgtgtctggctttggaatgaggaagagctggctcctgctctgggggctttcagccggagcaggcagccggaatcacactttcatatcctgtggcttatgtttattgtattcctgatttattgattttagatattctctattgattcctactgtggaagatggagatacggccctgttacatcacctgggcccccgcttctcttccctccatcctctcagaacaggtacatcacactttgttggttacattggtataaattatttgcccagttatgattatgtgtgatttactgctgaacaaggtggtgtattgtgatggtgttgccttcattgtcggactcttccccctcgaattggaaaattttttcttctttttcatttttctcactttctttaccctcatcagttcttcccagactgtccagtggaattataaaactcctccgaagagtcttttccacgtgacgggacatcctgtgatctctccatttcattctttctctggagacttcgctccggggccttctcctcccctgctctgtctgacccaggcagctgttaggcctgcggcacacctgtggtctgagatgtgcctttgtctctcccccatttcccgagtctgtctcttcttttgtggttgacgtcttcatcttcttagtgtacatcctccagtggcttcctaaggaagggtgcaggggaggccttctttctgtgacgcatcctgtctaaaaacatcatattcttccctcatgattcagtgataacttgtttgggcatataggattctaggttggaaatacttttcctcagcattttgaaagcattgcccttttaggttttactggtgctattgagaggtctagtgccttcttattccagaatctttgaacatgacatatttgttctactctgaaagcttttgaaattgatttcaattttctcaaatttttaatgatatgccttgatgttttatataaagtgtgtttttaatctttttttttgggtatctggtgtttcccttccatgtggaaactggtctttccctgtttgggaaaattttcttgtatgatttcttcctattttctcttttctttcttccagaaattccttcctattagtttgatattggacttcctggattgagtctctggttttctgtttgtgtctttttctcctattttctgcttttatcttttttatactactttcttggacatttcctccattttattttctaacaatgctattttttttattctattgggttttttagttgctaaacactgttatttcctctttcatgaatggctatcatgagttttctttctaggaatattaattctcattattttgaagttttgttttgcttcctgctgtatttcaagtttttccaaatcttttcctacttgttttggtttctctctttcatgttagaggcttttcttaaataattatctctcggttcattcctgtgtacgagtaagccttagaaacggactggaagccctgtgcatggctgcagacctgtgcatggctgggaagcatcaagagtaggtttcacttttcactgtaggatgaccagttcttcttactgaagaacccacaaaagtcagtgtccatagatcttttgaggggagagggaagggcaattccatttttccaaagaaaacgcttcccgtctcctgtttggagggtatgataagcccagccaacattcttggagtcgagcagtgcaccccttggtccatagacatgactcgatctccctgctttcagtaccgcaccaccccttcacctttctgtgtacgtggtatatggggtctggagcctttctggataagtttttctgtaggccaaacctctgttctcctctggggtgtggtggtggtgtttcctggtttcccggaataggtgagaggacctgggattgatcagatctctgtcagatttgagccagtccactgctcccacccattccccatccaccacgttctcccatacctgttgcctgcagtttctgaatctttctgggattctctggtaccaaccagcttgcttctccttgttaacccctctgcaggcatttggtgttcagctctgtttgtttctctttcttttgtctccttcccttccaaaaatggacttgcattcctaatccaatttatcttgggcttatacctcattttgttatttttattcctttgccctcattttagagatattttaagaaggatatatgttcaatttaacacactttagtaatttacttatttatatttttattagtagtaaatatgtagatattgacacacacatatatgtatcattatatatataagtatattcaagcgatccaaagatgagtagtggaaaccaatctcccttttcctttgtccttcacttcctccccaggagcacccacaggcccagttgcttgtgtggctctccacagaaagtttatgcacacattcacatagacacacacaaaagcatgatgtagatagtgatggattttattttcaatagaggaaatggtttatctgcatacccctgaacaatattcctattttaagtaaaggttagtgcttaatccaaagacacaaatctcctttagtcagatttcaggctccattgcaggtggtaggtatttcagggggccctccaagtgcccctttcaaaaacccatgtagttggtcaccttcacaaaggccagctgtgggggcagaggggcacacgcatgggccagctgtgggggcagaggggcacacgcatgggccagctgtgggggcagaggggcacacgcgtgggccagctgtgggggcagaggggcacacgcgtgggccagctgtgggggcagaggggcacacgcgtgggccagctgtgggggcagaggggcacacgcgtgggccagctgtgggggcagaggggcacacgcgtgggccagctgtgggtggcaccttccacttctcatatggctgctgtttccccctgcctctctctcctgcttagtccctatgtttcttcctgtttccacccttccccctctggtgtgtatggctggcccatggatctgaggaagccctatcctagctgagggctgcccctccccttactgcctctttggcactctgggtttgcgctcagcctgcccctggccgactagactttataaggacagaacccagagacacctctgtgtacttcagggactgggtctagcttgagggggctactcgatttggccacagcagtgacatcagcatgattcttcatccttacaacaggacctgccgctgccaagccagacttgatctccaaactggagcggagggctgcaccctggatcaaggacccaaatgggccaaagtgggggaaaggtcgtcctccaggtgagtgtaaacctacagcattctgaaggacatgtgccagggcccaggcggctatgatgagtcaaacagcatgagctcagctgtgctcatctgatgggggccgattgggcaccaagcctggcaggaggccctgggtagacaagatgaataagcaactaaccctgcccacagagtgtagagtagtctgggaaacagggaaaaaacaggtccttttgtaagcagaagtactgatggaggctgtggcagagctggtgggagcaggtacgtggggacactggtctcgaggagccaggggacccagagatctgtgagcctctcatcccttctccctccttctccagtgctcggtgacagcactattggtttgtgagaattcgttgtcttgcctatctcaatcagtaatttcttggcttgtagttgctacacttacttctgtacctacttccttctgaggcttgtaaaagccttggcaggtgtttaacctattctattgtggagcctcacacgagagtgaaagccacctgcttatccaacagtctctgtggccaagggggttaattgaacttattggtatctggtgtcacatgatcccagggtagctgtgtggatagggtggttggggcgctggtgaaagaacccacaaggattagcaacaactctgggggagccagatgaactttcacagatgagaatgggtgagggtttaagtggacgccactttctctagaaagaaggattgcattcatcttctctgccttgcttaagggatacttattaaatttgggggtgtcttagctgatagaagatggcagagttctgggtagcagaaccaagcatgattcaattttctccaaagggaacaagaagatggtggcagtgagagaggcagacacacaggcctcggctgcagactccgcgttgcttccaggctctcccgtggaggcccgtgcctcctgctgcagttccagcatttgtgaggaaggagatggacctaggagaatcaagaggacatacaggccccgttccattcagaggtcatggtttgggcagttcccatggttagtaattgaccccaaagagaccaaactcttctgctcagcctgcatagaaagacctaatctccatgataaatcatctcggttagtcagaggttacacggggccttttaaagtggagactttaaaataccatgaagtcagcaaagcgcacaggctctgtgtcaacacggttgaaatcaaggaagacacccctcacactgccctcgttccagagatctccagcgacctcatggccaacatggagcactttttcaatgccgcctactccattgcataccactcaaggcccctgaatgactttgagaagatcctgcagctcctccaaagcacggggaccgtgatattaggcaagtaccgcaatcgcacggcgtgcactcagttcatcaagtacatctcagagaccctgaagagggagatcctggaggacgtgcggaactcgccctgtgtgagcgtgctgctggacagctccaccgacgcctccgagcaggcctgcgtggggatttacatccgctacttcaagcagatggaggtgaaagagtcctacatcactctggcccctctctacagtgagacagcagatgggtacttcgagaccatcgtttctgccctggatgagctggacatccccttccggaagcctggctgggtggtggggctggggacggatggctcagccatgttgagctgcagaggaggccttgtggaaaagttccaggaggtcatcccgcagctgctgcctgtccactgcgtggcccaccggctgcacctggctgtggtggacgcctgcgggagcatcgatctggtgaagaagtgtgaccggcacatccgcaccgtcttcaagttttatcagtcctcaaacaagaggctgaacgagctgcaggaaggtgcggcgcctctggagcaggagatcatccgcctgaaggatctgaatgcggtccgctgggtggccagcaggaggcgcacgctgcacgcgctgctcgtgagctggcccgccctggccaggcacctccagagggtggcagaggctgggggccagattgggcaccgggccaaagggatgctgaagctcatgcgcggcttccactttgtcaagttctgccacttcctgttggacttcctgagcatctacaggcctctgtccgaggtgtgccagaaggagatcgtgctgattacagaggtgaacgccacgctgggccgcgcctacgtggcactggagagcctccgtcaccaggcagggcccaaagaggaagaattcaacgccagcttcaaggatgggcggctccacggcatctgcttggacaaactggaggtagcggaacagcggttccaggcggatagggagaggacagtcctgacggggattgagtacctccagcagaggtttgacgcagaccgacccccacagctgaagaacatggaggtgtttgacaccatggcctggccaagtgggattgaacttgccagttttgggaatgatgacattctcaacctggccaggtatttcgagtgctccctcccaacaggatacagtgaggaagctctgctggaggagtggctgggcctgaaaaccattgcccagcacctcccgttctccatgctctgcaaaaacgccctggcccagcactgccgcttccccctgctaagcaagctcatggccgtggtggtctgtgtgcccatctccacctcttgctgtgagcgggggttcaaggccatgaaccgaatcaggaccgatgagaggaccaagctctccaacgaggtgctcaacatgctcatgatgacagctgtgaacggcgtggccgtcacggagtacgacccccagcccgccatccagcactggtacctgacctcctcaggccggcgtttcagccatgtctacacctgtgcccaggtgccagcccgctcccctgcaagtaagtacacgtggcagagctcccccaaggcagcctcatgctgagccagaggccaataagacaggactgcaggtgcctgtggagcttctgtcatgcacccacccatttgctaggccagtgggtactcgatgcgtgacatccaccctccaggagcttgcacccctgccagggagatgacgcacatgtgctctaggcagcagggcttagtgcagagagcgtgcatttctagagcctgtctgccctggtgacagtgctgtgctggctctgcccccaactggctgtgtggccttgggcaagtctgtcctttgatgccttggtttctcatctgccgaatgagttgtgtgtggaaaacactcaggacaatgcctggcaggtggtgcaaatggtactagttaaaggtcaagaccactgctgggagtaaggagagggctgaccagccccaggcagcgccatcacattctaagtggggctgtatagactctggaccgtgcaggaattttcaagagggaagaggtccatgtggctgtggaggaggtgagatgcggaggagatggtggggctttcaggcagaaatctcacggggcaggggagaacagaaacagcctctctggaccggagggctggggtcaagaacttgcttgagggggaagctgtattagaagggagggcaagttactgaaagccacaga

SEQ ID NO: 773 - DNA, 168269 bp, Homo sapiens
cagaaggttctatatctcaagttcatttttaaggtgctgcagaaaataaccccatcatgaaaggtttcagcccctgagttttggtggcaagaggagtgtcctggtaggggagactgttggacatccctggggaatgttccagggaggctgcccacagtctaagtgggaatgggaaagaccaccttgttagagggggaggttgcccctgctctagggacagctggcctggctgcaagagcccccagaggcattgttctgggacttcctaccctggctcccacagcagaagcagtgaggccgtggtctcgtgcggaactctacctcttcccagggcttcctttagggcgaaacaatcacaagccctttgcacagagcacccaagaaagttctcttcctgcagctccagatggtggagctgggctcttctggcagggggtctggtgcttcccggagagccgagccgcgtttaacccgtggcatgcccggcccggtttacccaggagaggatgggacgaagttggagttgggaggcttgggatgcagccccagctctgctgcaggcagtggtctgattaatcccttcctctttgtgcctcagtttccctctccatgaagtggcagcagagatccaagtgcctgctgactccccatctgccctaggattagtgaatgagagcctcgagctccctcaaagacctctggctgcagtgtggacttagctgccatctgccccatcctcgtccttagtgggacaggtaggaatttgtctccaaagtccttgttgtaggagttgctctctgaatgcaccatctgcacgacaggctagtccactcttctctgagctgccctggggactctgcaccaggatctccagggcccactgagacatccccgaatgggcgctcagtgacaagggctttgaacaacctcctccagggactttgggcctgctctagcttcagaaccacagaaccaccgccctagaggcacagaggggcttctggcactgctaggttcacaccctcctcgccccgatcttccttccacctaaagtgaagcacttttccttccaagggcagctccgtcttggcaggctcaggaggccgcttatcaggaggaggatgattttgtctaggttctgccttccttaaccatgggcaggaaatgaggcaagtcagcaggcagggtttctctgccctgcctgatacttgttttaaacaggcaggaagtgggcgccatccatcccagcttgcttgctgcctggctcaggcaggtcctgtgctgtgctgcaggcccctgtgggtgggccctttctccatagtctgccgcttcccattcccagggtagatgctggcatctgagcacctgagtacccttcctattcccagggtagaagctgctgtctgagtacccttcccattcccagggtagatgctggcatctgagcacctgagtacccttcctattcccagggtagaagctgctgtctgagtacccttcccattcccagggtagatgctggcgtccgagcccctccctggtaccgcaggtaccctggtaccccacctgccctttcatccccaccccagtacttagccttagcactgttgctttcgtgtcattttcagttctagtcaggaattcctttcttgctttctgcctttgacctgtggaaatgtctcccagccctgtgggtctggcggtcagagggaccccacaggcctgtggtgcgggagctctgggaggtgttactatctgcgtggctaaggcacacacaggcctccttctccccatcaccgtctccatgggcgttcaggaacttgcccaggtcaggcactgtggatgtgaactcgtggaaagggagggagaaaggcttttttaggtggggctatagcctctgccctacccacagggattccacatcaaggtgctgttccagcacacatgcttcctgcggcctcttcatccttgaagaatccctcagagcaggaggccatcctgtgagcagccgtgagtgggtctctgtgggagtagttctggagctgaggtggaagctaggggaagcaactcgccctctccacgtcagcatcagcgtgctccgaggacaccggccagtgccttccttaggtggtgggaaaggggggtccctgtgcagcggggccactgagaatgctgtttgtcataaaatttgcactacccgatttctcaaggggcacaggcctgctccgttcccctttgtcagccaatggccaagaaggaagaagatgactgccatcttattcctgaacttcctcattcaggacccccgtggaaacacagtgagcatccttatcagaggccctggcccaggctggcccctttgctttgtttggagaggctggctgagtttcagcccctagtgctggagacccccttgttggagaggcttcctgtttatgcctcacaagaagaaaaaccacagggctctgggaggggaagaagcatgcactcccgctttggctggagtcccagcgcttgtcgccaccctcctccttgcctgtagtcttgacagcatccgtatgtacgtgtcctggcatttcccctccctctccctgatgactgatacccaccgggtctgacattccaagtaaccagtatgtaactggtagtttgatcccaatagccatagcgactccaggtgggagtgagggagcccagccccctgtcctggaagataccttagagtatgtgaccgcgctccagacccttgcttctctctcctgcagaggatgagtttctagggtgctaagtacctatcagaacagtgtggaggggcgggtccctcatacaggtgtgtgcttagccaaatacagtaactgtgactggcccagggatgttctctcctctattttcaaagatgaaaggaggttttaaaaaccatgtttgattcctaaccttttgctacctgaataaagcagagtctatttcaacacatctctgtcttgtgtgtccctaagcgaggaccaggagctcagagaagctgacagaacgagctctgctctcactcacgaggggacagggccaggaacagaggtgggcaggggaagtgcctgtgtattcacctgatttttgtctttcagtttctttcctctctagtccttcaaagtgagctcaatcatttttgccagttagaaggtaaagatgagagttggctgtttggtgagttataattaagggcttggctgccttttctggagtactgcatagtttacaaagtgctttcacatacatgatctaatttggtttactgaacttagaaaggtagactttcaaggaaaaaacatcgatttccaccaatagtaaaagctactgcatcagacctgtcactcaacagcgctccttgaggcctagctcctgagatccctctggcgagcccttgcggctccacatcctcgggacggcacgctcccacgggactggagcaaaggtttcagagactcgggatacagccagatctcttcggtgaggagactcagtcttactcgagtgtatgtgatttttaaaaaagacattgaaacaactatggaaacagaggcaaaggcagcaaggctttgggtttgcgactgggaatccgtgcggcctccctttggtgaagacctgaccccgtggtgggggtgaacagggtttccttgaccccgtcccagggttcccttcaggacagatggatttcactaggggaagcgtgatgctggtagcctccactctcaggctgggcagggtaggctcccagggaggcagctcccagcgcagcctcttccatcactccggctggagctagaaggagagaagtgagctgaggctctagaaagtgctgcactcctgcctttctttttcccaagggtgctcttgacatctggagtgcagtcagcaggcctttccgagtgggctggctgcctcagatgcctcagtccctgttgctggggatgcttcggtggggcctcctcactgtgggccttctcttgggtcagtgtgatcctcgtgtcccttccctgtgccagcgacactcgtgggcttcacgtggctggcccctgctcccagggctcttgagatgctgcctctgactgcagctcctgccacactggcacctgtgtggccgctgctcccctctgcacctgggaatagctgcccagagacttcctgttttgaaccttttgccttgctcaggcagccagcaagggccctggcactcacaacagaagggccctgcagtgctgcggctctgctggcgggccaggacaagctgtggggcgcagacacactgggcacactccagacaggcacagggcctctgggcagtgagtttgcaagtgttttgtggtcctggatcatgcacaggcttcttggcagccaggagaggctgtctctgcatttagtgtgcacacctgaaagagcggcccctcacccactaggcagtgtcctcccacatccccaggagggtcttcctgtgccatctgaggtccacttagtggaaagcctttgccacaccaggacactttcaggactactcccccacgtggctgtgctcatggtggccagggctatatggctcttgaagctctccacacacttggcacagatggatggcttttccagtggaatcaaaaggactcaggcattctgaggccagtctggccttggggtttttcagcttcccagaagcctgcagaatcgttctggggggttcccagttgcctccagaatcatcttcagtcttgtttctgactgtgttaccaaatactgtggaagaaactcagatgttagcctagtgatggggacacacttcttttgttcagtgtgacctgctcagcctctagcccccagccccagcgagatgacggataaggcagcgtcctgtggatgccagagccggggccaagtgtgggtcagcatcccagctcagaggagcggcccagtttgtctgagaacactgaagtcccagagccctggggaggggcttctgaccagcactcctcctgctctcattccaacacacacaaagggaatgtcctggtccagggagccagggctctcttgctgccatgtgaataattccctgtagcagccactgctagacagcaagcttgggaagccttcttatgcagaaatcaaagtcatttttataaaaagtgtcacagagtcccttatgaagacagctggacagagcaggagccgacccttccctgactgcccagttcagtgagcccggtaaaatatctgccgtcagcagcctgccatgaggtgcagtgaggaccttctacttcatccctccaagctgagtcgtatcataaaatgcatactttatgttccttctgcctgtagagaatcagaaagcacatgatggaggtttcagaaaagggcttgtgagatcgagcatgtcagagctgaagatctgtgtctgtgagacatgtcctcctgaaagagcacacatgagctgacatagccacggcgccggattgccctcaccctgattgtcccatcagtgtagcttgtctcaagaggtttacactgtggctgtgtttctcacaggttacccaaactcctatcataaaggcaggaaacagaagtaaaaaacctgaatccaaaccacaggaagtgctgcggagatactgattcgtgggttgatcagagcccaggaggcactaaaggctcaatgaacatggtgatctttgtgcaagagatgttccatcaaggcttacctggctgggtggtagctttttggcctctgttgggggctgggaatccttcacccaaagctcatgttccctttcaagtctacaagtgatctctggtttggcagcagcatgcactgtagggagaaagacagcccagtgcccctcaacccacactgagcgcacatagacccgtgtcagtcctgaagcctgacttgcaccacccatttaatgccctgggctcaccctatcaatttgggacagcgggggtaggttgtaaacctaagagagctccagaagtaggcagggcctggcatacaggtagggatgtttatttcagggcaacttcaggagtgccaagggctgataaaacagtgcaattgtcataatatgttttcccactgccagggcccttgaaggagaaacaggctcaactagtcacagagacaaccatgctctgggtctagttctccctgaccccacaggccaggagtgcccctattagatggcaagcaagcaaggggccaaggtcctcacccagcaagactcccagctcctaattccttcttatcacatcctggtataattccttctactcatggccaccagaacaatgggtggaaggtaggtggttacatcattaaatgtcacaggccttatttgcaaagacagagacatctggagctgttgttctcacctccgacacgtgccccgtctgcagagagcattaggatgcatctgtggctctgaggtgtgatttcctagggccttcaagtgtcctggggctcctgttcatttgcactgggggacactcagggaagttttaaagagcctctttcagtggctccttctccttctaccctttctaggaattcatcagccccatgaaaagatgaacgatagagatgtcaccaacatcaggaccccactccctgggagatgtcatggaaacttgtcaatcacacccaaagcactcactgaggagccatggcagagcagtcggtggcgccaataccaaccagaagccgccagggcagaggggaaccgtgaagccagtggaatgcacagctccacctcaggggaccggggtaggcggggctgtgtctggtaacatgccctttgcctcacattagtgcctctgaaaatagtgtcctcagcctgggcacaaaccctaggggtgagctgggagtgtggaggagacgctggattagggagaagtctcggccatgtgttctggctcttttactgatgagctgtgtgggcctaggcaagttacttcacttctctgggcctcagttttatcacctgtaaagtgataggattgccttagcctctaagatccctttcagctaaaaacaaagttctagaaaataaatatgtggtactgtggaactctggggagctgtttgatcaggtgaacagtttacccatggaaatggggctccagcacaaagctgctcacatcttccagtcacgctccagggaacagccagggcttgtgggcccagatgaggctttagtggttggagaaggagccagttcctggttttaatcccttcatggacctcagaccatcacaaagctgccaaacaaatgacacaggcaatcacatgcaaattaggacagaaatgaaacatcaaagacattaaaggaaaagagtaagagctgcaggctgctaatatgagtggctgctcagactcagcaatgtttttggttctggccaaagccaagacaaaggagcagaggcaaagaaggaaatacatttcactttacagctgtcattttctacagaggatttttttttttccagaacaaaattcaaaaagtccgtcttttttgagctatagaactttcgtggtgattttttttttttttttttttttgagacggagtctcactctgtcccccaggctggagtgcaggggcacaatctcggctcactgcaagtgcaagctctgcctcccgggttcacgccattctcctttcagcctccaaagtagctaggactacaggtgcccgccaccatgcccagctaatttttttatatttttagtagagacggggtttcaccgtgttagccaggatggtctcgatctcctgacctcgtgatccgcccgcctctgcctcccatagtgctgggattacaggtgtgagccactgcgctcagccctcgtggtgattttttgaaggcctgtatggacatactcttaactctatctcctggatgccaagtgcacccttatcctaggccagtgttctcaacaatgtacacactctggatgagaaaaataaccattgtttacaatccagctaaaatctcacctcctccagggagtcttcctggatttctccaccctctgaattctcataatgggcatttggctactttgatcacagggctcttagaactgcgctgtccagcattatgattttaccagaatatatcactcctcaactactttagaaacccctcgaaggctaggatggtattttatacctaacagtttggtgtcatcccacgcccacctccaacttacatgaatgttggaaggatggatagggaggtttcaactagagaacggagaagggcggatgtaactggttcttgatttcagaaaacagccaggagcacacatggctgacggggtcagtgcaaggacaggcacatttcccttctgcatcacgtggggactgcgcctccctatgtcatgaagccagggaatatgtgtggccggccgcttggggtagcacttgttgctagagataccgcctggaggccactgatctgtaaaagggatctctacagaagatagggatttttgatcgccagagaagaagggatatgtgagatccaaacgccgaaggaggaaagcaggctccgtggtctcttccagccctgatggaagaaactaccgagccttattatactaggtgctttccacatgcctattcatttaatcctccagcaaccttgtaagaagggccatcccattttatatttaaacaaaccttaactactgacgcaaggagtcaaggatctaatcccaaagcctctgcctggttcgctgcagatggatgtccgcgaggacgccagccctccgcctcccgccgggtccctgaacgccggcccggccggtccaacctcattccgcttcccgccatcgaaacgcgaagcccccgccttcccccaaacgtctcagcgccgctggggcctttctggctgcgccgcctccgaccccaggccccggtccgcgcccgccgctcgctagtcctgggagtgaggagaacgcgtgctgaggacccggccagagggacagcggggaccgccctcccgctgcgtctctgaaagcgaggccgttcctcccgcgtccgacccccgcggggccgtcaggttcggggcggcccaggctgcgggtccgcagggcgcttcgggccgagccggcgcggcgcgtgaagggcaggggacgccccgaaagaccgctggggtgggaccccaagctccaggggtctttggaaataagaatgcggcgtgacgttggctgtgcgggcgcggggctgacgcggaccctataacccatcgccgaaaccgggcggccgcgcccctattcctcggcatttctctctgtccgcggccctgctcagccaatcagcgagtgggctcctaggcaggtcctgagtgacagcgcggcgggctggatcaggagatgcgcgtgcgcggcccggcccggctgatcgcttcgggtgctcgactcctgttgcgcatgctcagcgcgctgcccggctggggacccgcgcacctgcagcgcccgctgctcggccctgcatcctgcctgggcatcctgcgcccggccatgacggcgcactcattcgccctcccggtcatcatcttcaccacgttctggggcctcgtcggcatcgccgggccctggttcgtgccgaagggacccaaccgcgggtaaggaaagcgcgcaggccctgcagacctctccaccccggccccctggcccggctcgcccctccgccccggggcggcggcttcctgctctgcagcgagcgtccgcaggagggacgccaggaccccggacgccacctctgaggtctctctgcacctgggtctctgacagccgggaacaggcaggaggtggggcgagagggcatatccagaaggtaaagaggagagtgacattggagatgtctgtcacccctcctgcagccagtaaagggcacaagtgggcactgacgcagtttctccactccttgctagctgtgtgacctagagccaatatcaagtctcagtttcttcatgggtaaaatggagataatgtcgactcctgccttaaaaggctgctgtgaggatgacctgcggtaacgcatttaaaacacctaccagtgcgtgacactttgtaggtatgggataagtttagctggcgttatttttcgaaggtcctctagcagattgctgcgccattcaccagtttctgcttcatattatcttcagttacaaagcacccttcccttgactgcatgttcccaggggctggagtttgtccagttcaccattgtctactcagtgcccagccaggactggcacaacctgcttagtaatgttgaaaaagggatcgcgtgctcctgtgtccagcaccagcttgcagtgctttagatcaaagatcaagggcctcgtttggattagagttagctttgcccaaaggccgtttggacatgtgagtgctgcctttgttcttaaagacaggcagggtttgggatcccacagcttcactttgtaaaccattttcgtgtcttgcgtctcctgctattcttggtgagttcttgcttcagtttgactgaaatttcttttgctgcacttgaagcatctgtctctggtcttctctgagtacacgcaaagtggctagtccctgttctctttgtaacaactcactgggcctcagaactggctcacagtctgcctgcttcttgccctgtcttctagcctattgttttccttccccttgctccatgaattttgaattctacagaccactccctgttgggttgccacaaatgcagctctgtgcagtgcctttccacaacacgtctgcattaagatggagcaatattgggtggtagagaagggaaatgaagggaaggattcttaaggcaacttggatgtggtcaaggttggcctctctgtgaggtgacactttcagtttttattttctgccttgctattcttaccctgagtagaactcagcctcctgtgtccaggaggcatcaggaaggccaatggaaaagagctcacaccaggagctcttcttgctctggtcctggccaggccttgtgaggtgctggctgcatttgttctgacccgtgtcctcttctgctgcagagtgatcatcaccatgctggtcgccaccgccgtctgctgttacctcttgtaagtactactctccccagctcaaagtcagccagttcctttgtcctccctcctttcctcctcaccctagcctgctcttccttctgtcctggtagtaaatgcctcttgaaaggctgaacctataaaacaacaggagtggaggtggtgtggaatgggaaagagagcagtgggccagaagtcatgaaccctgggctctggatctggctctgcccccagagttctggcccccatgggctgtagttttctcacctgggcaaggaaggaggcaggccacctcagtgctgtctgtgcctgactgggtcacctggagtgattgttcaaacacagttttcaggctgcaccctacacccatgaaattacaactctcgagatctgcacttgggaattcctgttgttcatgaatgcccccaggtgactggaatgcagccatcttagaaccactaggtgagaggccagacgtggcggctcacgcctgtaatcccagcactttgggaggctgaggtgggtggatcacgaggtcaggagttcgagaccagtctggccaacatagtgaaactccgtctctactaaaaatacaaaaattagccaggcctggtggcgcgtgcctgtagtcccagctactcaggaggctgaggcaggagaatcgcttgaacccgggagacggaggttgcggtgagccaagatcttaccactgcactccagcctgggcaacagagtgagactccgactctaaaaaaagaaccactaggtgagagtaagtcatcaaacttggaataggtaccctggggatatagaagaacattccaagggacttgaatacctggagagtgtgaggaaatcagtttgcagatcctcagtgtctattgtttagtctcttgctaaaactgccattcacaatagccaatccctctttattaaaaaaattttttaaaaggaaaaagaaaaagaccctgcccccgcatccatcccaaacctgcggttacattgctccatgtttagatgatcctggctgccaaccaagagataagttcaagttctagtttgttgggaggcctgtctcatggttaatcaagctgcattaaggctgttgggtttcccatcttcctatgtcttgtacattatttttatgggttaagcttggcatcgttgggtgttcttaattcagaataatcaaaacaggacaggtaaagtgatgagatgctcattctttaagaggtaacagattcttttgaaacaactggaatattttccagggttgccaaatttttcaaaatacataggacaaaacccactttcaaaaaatttacttcattgatttaagatttgatgttatcatagttaaaattgttttatctgattaggtcatggattctttattcctattaaccaattctcttaatttaccttatgttttattgattgattgattgaaatggggtcttgagaccaggccagtatggtctcaaactcctgggctcaaatgatccttctgcctcagcctccccaaggagctgggatgacaggtgcacaccattgcacccggctgttaactaattagataattgacagggtcttactctgttgcccaggctagagtgcagtggtgggatcatagctcactgcagcctcaaccttctgggctcaagccatcctcccacctcagcctagctttgaccacaggcatgtgccaccatgcctggctgatttttaaattttctgtaggacagggtcttgccatgttgctaaggctgtgcttgaactccttggcttaagtgatccttccacctcagcctcctgagtagctaggattacaggtacacgccactgcacccagaaatgtataagccctcctactgacaaaaactaaacttgttagaaataatgatgactattaacacatggtttaacttaaacccactttttttttttttttcaaaattcttcctggacagagcattctctgaggtcctttctctaatgctatttctaggtccttcagggcttgagaaaagatcctcatctgcccatggcagggcctcagaggggcttgtgtttggtggctgggagggtgggggagacggggcctacacaagatgcggggtaatcccaaataccaactgaatcaacatacgggaaacagaaaacacactgcaaattggatgcatacaggtagaaaggtggggtcattctaagaaaatgttacgcctagaaattatatttacaaaacataaactcggagagaatgctgatgtaaaggaggtaacaatttctgatggcttcctgggcgttaggtcctcctacctactgtgagggattcaaagagggaaaataccgatccttcctgcagaaacagacaaagcagtgtggatgtggtcgtggggggcccttccaggtcaggcactgacagagcgtggggacctactaactactgtggcaaatgaagttgggagctttgtcatgaatgatggggccagacagccacccacacgcccagcagtgatgacaggtggggcaggtccctgagggttttctggcctgaagaacagaggtggcctggcagcagcctgaacaggaggcccctgacccgtcagctcctcacgtcttggggtagttccttctctcataagaggaggtgattctgacgtgctgcccgccaggcctgccctgttcgctccctggtgcatggagccgggggagcctggacagaggtgtgtgagggcacagctgggagtcgctcccaaagcgcccctgaggctgcctcccctcttctctaaccccaggttcagccccaactcggggatcctgcagatctaccgaacatcaaatgaaaccaaaaccaaacccagaagtgccataccaaccccatgtgcctgccggagtgtggatggctccctgggcccttcttcaccctgggaacacaggccctgccatctgctgggttggccgcatccaaaataatatgaccgaggcctcccctgggtgtgggaggaccctcctgtgccaggctcaccatgctttgctgtccctggcagctggctcatcgccatcctggcgcagctgaaccccctgttcgggccccagctgaagaatgagaccatctggtacgtgcgcttcctgtgggagtgacccgccgcccccgacccaggtactgtgtgggcgaggggtgtgggtggggaagaggggaaagacaaggctttcccacacccagggcaggcctcggtcatattattttggatgcggccaacccagcagatggcagggcctgtgttcccagggtgacgaagggcccagggagccatccacactccggcaggcacatggggttggtatggcacttctgggtttggttttgatttcatttggttagagttcttgttgggattcaggcatctatttatttcatgaaaagaaaaggtggggaggggactgaacatcaactcccttcctgcctggcctgtgttggccgccagggatgaaatgggaaccatgctcccagcacccccctcccccatcctcacagcgcttcaccccaaggcaagaccctaacctgggccctaacctggacggagggagggaaagggtaagctgaggactatctgggcaggggtgagggggctttccagggagggttgggggcagtggagtctccactgcaaggccgggacccttccatgtgatgtgcttttcaggtgcccagctctcggaatgactgtggctccactgtccctgacaaccccttcgtccggaccctcccccacacaactatgtctggtcaccagctccctcctgctggcacccagagacccggacccgcagggcctgcctggttcctggaagtcttcccagtcttcccagccagcccgggccctggggagccctgggcacagcagcggccgaggggatgtcctgctccaatacccgcactgctctggagtttgccctctttcccaaggagatgctgctggggagctggtatgggtggggtctttccctttacagacggggcagatgccaggactcagcccatcctgaggaggacacgtgtcctcatggagagggtgctccggcccaggcgggggagtcagtgcccagtcagcagctctgccaccatcctgctgggaactgggggggcctctattgggttataggcaaggccttttctctggcatggaattgttaattttctgacacgtctagatgtgaaatttctgaaaatgttgaagcagagaaacattcacacacaaaaagcaacatagtcatgtgggtccagatggcctcagtcctagatgttggcaccctttgctgtgtctcctcagagtatcctgttccgcctcctgccacctggacctccctcagtggatgtcttccctcccccgaccccagcctgtcagtccgagcacagtgcaggtttggctctgacttgggcttttggctgcagtgggggtggatttcagagcctctcatggcagcatctaagtgaccagagctgggatgagagaggggaaggggcaatgtgagtggcgctatgggacgggccagccctgctcctgagccagccccgccctctgccccctggccctgggctctgtgctagggatggtgaagaatgggggcgtgccagcctggcaggagtgggaagcaacacgcaggggtcccggacctctccagccttgccctcacgcttacccgagctcccagtgtggttagcacagagctcacccaccttgcctggctcccagctggggcctgtcctcactggtgctccaggggaagaaacgacagcctcacttctgtatggactgctgatgtggcctgccatcctgttcagcgggcattgtctttggagcagcaggagaataggatgcctctcactcacatgccagttcctggctggccagctgctcagggctcaggctggggcctcccattgacatcctccccctacactccctctctgagcctccgtcgcccctcctgttgggtaagggtgttgagtgtgacttgtgctgaaaacctggttcatatataataaataatggtgatgaaaagattactgtttggtgacaaagccctggcctctgcctgtgtgcaggtcccctgccccgcccacctgattcttgtttctccagtgggtgggtctggggaggggagcagggaaggattctgggagctgcagttatgaacacagatatccaggactactttcctgagatctggaggaaaatccggccccctgctgactgcccggattcggcggagaaccaggcctggcaggaagaccgaggacttgttcaagtgcagctttgagcaccactcgtctgggccccagaggacacagtgcaggactcctgcagtgaagcaggtcgccagaggcttcaaagcctccttcatgaaatagcctagggctgggatctgccagcacatctcgctgcaggtccagtggggaagtgggcagagggagcccagccctccagcccagcctgtagcccagggcagagctgaaagaacttccctggagggacaggagggtggggcgggactggaagacgcacaatggaggcaccagagcactgagggcggaaagccagctgaggagcttggatggatcccaagggccatgggagccgtgaaagggatttaaagcagggccgtgacatggccaactggatttctagcattatctatctctacaagctgcacagtggacggcaggctggtttgacatctttattagggcccctggtggaagtggtgaggacagagaagcgaggggggagctgcttggctgtgacccatagagaccgaggctgcccgtggtggggagtgcagcaggggcaggtctgagagtggctgtgggagctgaggtgttcctttgtttcctggtgagtcgtgtgtgtccagggcaccccgtggaagtgtaggtagtggctggctgggcggtggggcggatggtcaggaggaagatgaggctgcaggaggcagagttggagccatcggcataaataaccggtgatccctgaggggtgcaggttgctcagggggttcagagtgagaaaaacccagaagagaaccccaaggagtgtgagttcacggggtgggtgggtgaaggtggcctgtggaggatgccgggaggttgcaggtagccggaagacaaccaggtgagtgtcactcaggaggatgagaggttcaacaggagagagtggttgaggtaacacagacccccattgtcctctacccccaagaagtcaaggtcagctggcatctttggtgatgggcagtaaagtcagactgcagtgggctgggagcgagtgggcaggtggggggtgagaaacacagtgacctcaggatggggaccccgtggacccagtgaagctggacctggaaagaccaaagggagctaaacaaggagggacctactgggcccattttcccatgtcgctgtgggtcagccctgggcctgggggaaccactctgccagttcctgccgctgcacctctgaagccacacccagcccgccacaggcccaccatgggggcttcaggttcaggatgctgaagatccacgttggcccaggattggggtggggggcatgtatccaaaatggctacttccttgtctcggcttctgctctttgggttcttgccttctgtgatattggattggtggcatctttagacactctcccgggatgtgtgtggctgtggctgaattctcactgagccccctgggtggcatcctctgggcctgggaggtggagtcctggagagctgctcgctgctctctgggcagcctctggactgctgagggctggtagctccttcccaggcagggtggcctttctcacatcttccatccttccttcctgtgcagccattccgggagagaggagagggtcccagagctcatgtccactccactccctggcacgatctggtctcccaccctttggtgaggaccgtgttcctcccagaggctttccctccaggcccgaggtgggaacctgcagggtaagtaggtctgtcaaagataaactaagctggaccttagttaaagctacgaaaacagaccttattcattaaccactgacaggggagaagctgagctccattcagatctgtgcagggggactggacagtttaatgggagaacgtaggagtcgggaaagggcattccagggctcaggaatcatgggagtgaaaaattacaaagggctgtctgtgttattgtggccgggccagctgtgtgtgccagctggcagtgatggaagttaggttctggcctcccccagagcctgggagacaggccccatccttcctgatgatgccatttcaaaggactggctctcaggctcttgagaaagacactcctggacacacatgcatgtacatctcaaagggacaagggaaggaggtacgactctaagtgtttttaacgtaaatgctctaagaaagtgagggggtggtcagaggcctgttgtcaggtgttggtaggaacaaacactaaatgattttgacggccttgagctttttcagacaggaactcaaagggtggccaggtggtcccagggatgccgctttgggctgccagaagccatgctagggttggtccagtctcttggtgcaggggtttggacacagtcactatgtacccaacttctgttagagttatcagtttcaaaccccacccgtgcccccaacaccatccccaatgtgggaggcacatcagtaaatatcagcctctgacacagatgctcacggacctacacgatgcaaaaaagctctaaaaatgggccgtgactgagagcagggcagccctgaaccataccaagtggcagagcaggaagtggccttggaggccacgctgagacagaggacaaagccactgagaaaaaaaagtaaaggtaaccaagaaaagttaagctgcacacaaagagtatggccaacagagggcagcgcctgcgtgcaggatgaagtctctagcgagccctcgtccaatctgcgcattgctgggggtggatggtgccgaggtcagagatggtggccctagagtcataggcttgagcagggagccacgataattctccagacagtaccacagcctggaggaaacgcccttcaggaatatttcatagtggcaatgaatgacgagcattgagccatcatgaggtgccaggcactgcttcggaaaccaaaggaccatgctgaagagctctgtcgttctccactctgatcccaggcttcccgaaccgtcttctggttctgtcttcccgaactgtttcgtacctcagcatccctgagagatctagcacattccattctgtaacagggacgccacaggtttttagtggagggagggagggagggaggtgctgctcctgctggccatagggtccacgctccctgcagaagccctcaaagagcagccctcagttaattttggctgctttgaacagaaataggatagttggtaattctggaacagtgaggagctggaggtgaagtgagaggcgtggctaatctccttatctgtgtgctggaagtgacctgctggtaaagctttgggcttccgggaatgaaatcagctggcaggcaccacagttttgcttgacttgtagcactggaagatgagggcagatgaccagagtcctgtgtggatttaggccacatactgggttagcaaatctaaatacgaatctctcattggggaaatgttggtcaaaagatagagaatttcagttagacaagaggaataagtccaagagacctagtgtgcagcccatggtgacaaagtgctcaacagtgtgttgtatgctggaaattgatgagagtagatttcacaaaatgaaaagtgaggtaatgcatttgttattagctcaatttagccatttcacaatgtatacacatttccaaacatggtatatacctacatgtatgcaatttttgtcaacttaaaaaaaaaaaaggaatcacttaagccaaacaaaacaacccatggaattctgggatggaagccatgtctattacaagagaacctccagggatgaaggaggctggggctttagccagctctccagctgcctctgccccaggcagacccacacagggccagagtttgggaatcatgcgccgggtgcagcctgcagtgctacttgtcaatgtggagtatggtctacctgtaacagaataatctggaatgcttgaaagtacaggttcctgggtctcacactgcaccctatgggtttaggggattctagactccacattttaaaccagctcccaagggttttggtgctaactgaagccctcgaagacaggatgtccaagccctgacactgttgacaatttgggctagataattctttgggtttttttgtgggggagggggagcacgggagggcactgttctttgcatcctatgatgcttagcagtaccgcctccctttacccaccagatgctagcagaacccctctccctgctcctggccatgacaactataaatgtctccagccattttgaaatgttccctagggaaacacccctaccattgaaaccactgccctagaacctcaacccctcaagggatttccaaacttagttatcaacccagaccctcgggaaaggagcctgggaggccctgaggggagccgagtgccttcagctggcttccccagcaggactggagcttctgaccaggagaccacaccccagcaagaagtaagcccccaagccgccagggacttccaggtatcagagcaggcactgatcccagcatgagctggtccctctgcgagctggtgcttcccaggaggccgggggcagggagctccggcactgccccgagcccagtggaactttgtgttctccccgcaggcggcttcctgagcagggtgggcggacacagttgggatggatgttctcacccctacaggacctccgccttggctccctaacctcaggattaagggccatgatagcagcaagggtcttcctccctcctgaaatgtcagcattttgtcctctgacaaagacctgggacacactggggtggtgacttcatcttcccattctgtgtcccacacagcaggagccccaggctctgaattcctgcggattctgcagcttcagtcagctgtgatgccaggtgcaaaggcctggcccttggccggcagcaattgattcagcaaacatatttctcttttttctctctacccagactcccagaagcagtttaactttacttagcagctcagctcagcttggaggttgagagtgcagagtctacaactggatcaaattccagctctgatgatgattagttgagtgaaagtgacttaatctttctgagcttcatttttattgatgaatcaggataatattagtagcacctgcctcatagaagttgtgcatatgaactgagataatggactaaagtgctcaactggtcgataaatgctattaatttcattatatttacatattaactatttaattccatgccacattttattctgccaggatctcagcttccttccccttttctgttcctgtcatggtcaccacactgatgcactttgcggaagagaaggtggcaagtgccctgtgtgcttttatatgtgagacaggacctgacaaataagtactatgaaaaatacctggggcctgcttatgtatctgcatttttgtgtttcctgtcgaatgtctttaatgtataaatgtagcatcttctcagtaaaaacacaaatgcttttggaggacggggggaggaagcagatactagaattggcatgctgtttctaaagccctctgggaaaaacaaacatgtaagaaataaccaagatattcctggaaaagcagagtattgagagggacactggcactccagatactaaaaagtctaagataaagataccatttgcaaggctacagaaatgcaaacagtggggctggcacatgaacacacagacgactcaaggggagaaaataagtccagaaataaatttacaatcaggaattaagaatatgataaacagccagacacagtttctcacacctgtaatcctagcattttgggaagccaaggcgggcggatcccttgagcccaggagttcgagaccaggctgggcgtcatagtgaaaccctgtctccactaaaaatacaaaaagtagtcgagtgtgtgtagaggtgtgagcctgtagtcccagctactcaggaaggcgaggtaggggaaatacttgagcccaggaggttgaggctacagtgagcagagattgtgctcctgcattctggcctgggcgacagagcgagactgactcaaaaaaaaaaaaaaaatgaatatgataaacatagcaaaccaaatacataaggaagagatgagtagggcaatgaacagtgtccagagtcccagcagcaaaacacatacaaaatggaaagaaactataaatgtactagaaaaaaattggagaatttttaaaattatcatgtaatagggaaggtctatctcaggggaagaaagaaaaaaagaaatccagaggctatgaagataaaactttatacatttaactaagttaaaatttacattttcttcaaggcaaaaaccatacaagtagataaatgagcaaatgacacaaaagaattcacagaagaagacatgtaaaagacttttgagcatgaagagatgcttagtcaaggaaagcaaattcaaacagcaatgtaacctccttattaccttattaacctgcttattacagagagcgagactgtgataacagactgtaggtctgtgctgcctgctgcagtgcatctccccatgctcttggtgctcccatacacgccaggcgccttccaggtgccagcactggcttccttcctgggcagcaggctggacgtaccatcaggagttggtatataaactggctcccagagctgcccatagtgtcgctggcttgcacatgtcctggatggcctactgggcccagaaaaggtgaaatgtgaggagcacactaatcacaaaatgacccgagccaagtcgagccaatcctgggctagactggccaaaccccatgatatgatttggctgtgcccccacccaaatctcaacttgaattgtatctcccagaattcccctgtgttgtgggagggaccaggggaggtaattgaatcatgggggctggtctttcccatgctattcttgtgatagtgaatacgtctcaagagatctgttggatttatcagggatttctgcttttgcttcttcatttttctcttgccgctgccatgtaagaagtgccttttgcctcctgccatgattctgagacctcctcaaccttgtggaactgtaagaccaattaaatctttttttttccccccagtttcaggtgtgtctttatcaccagtgtgaaaacagactaatacaggccagctgatgcagacatactagccaaaattaaatgcctgttgttataagtcagttttagggtgttttgtcatgcagcattattgcggcacacctgactgatacaatactgttacatacagatctagttcattagtgacatacactttctttgtccacccccctattaatgacccctgtgttacttccagattaacaaatagtaagcatcttttatatgtctttgtgcacatttgctggaacttctctaggatatatatctaggagtcaaagagcttttaatattacaagagattgccaaatttctctccaaaatgattgtttcaatttacactcaaccaaccttgtggcatgagccacagcacctggatggtagttggttttaacttgcatttccctaatagctgctaagcttgactcttcacctgtttattggacatttcggtttccacttctctaatttgcctactcaaatcattggcttgcttttctatgactttttttggtcttttccctattgatttatagaagttctttatatattcttggctacaagttcccctaatcctagtgaatctagtgccaggaacagggaaggaaggaggaagtggggagagagggcaagatcagacagcctcatttctccttctgctcttcaaaaccattgttgctgggcgtggtggctcacacctgtaatcccagcactttgggaggccaaggcgggtggatcacctgaggtcaggagttcgagaacagtctggccaacgtggtgaaaccccgtctctactaaaaatacaaaaagtagccggacgtggtggtgagcgcctgtaatcccagctacttgggaggctgaggcaggagaatcgcttgaacctgggaggcggaggttgcagtgagctgagatcacgccactgcactccagcctgggcgacaagagtgaaactccacctgaaaaaaaaataaaaaataataaaaagaaattaaaaaaaaaccattgttaaaaaaatgaaaagcaaaccacaaactggaagaaactatttgtaaagcatatatctgtcaagacttgtatcttgaatatataaagaactcatacttaaacaacatgacaaacctaagttttaaaagtgggcaaatttgaactcttacttcacaaaagaagaactgcagccctaccttagatcatgcacagaaacaaatttcaggaaggtcaaagacctaaccccaaagagcaaaatgtcaaagtgtttaaagtaaatcataagaaaatgacttcctgacatcagaaaagggaaaaattttctaaatcaggctgggaaaagatcgctgtggtacatatttatgaaagattggcatccagattatataaacaacactgacaaattaatctaaaaaatacagttgaaaaattggcatgtatattcccagcaactcacaaggagggaaacttgagaggccagtcagtaggtgaaaaatatacttagccccattagtaatcagggaaatgtacattaaagtcacaatgagacatttcatactcatcagatgggcaagttatgtctgccagcacaaaaggctggagaggatgggggaaatgtaagtaggggtgcaaatggaggcaaccccaccccatctccacaaaaaatttttaaaaattagccaggctagtggcttctacctgtggtccgagctactcaggaggttgaagcgggaggatcaactgagtccagagtccgaggctgcagtgagctaggattgtgccacagaactctaacctggacaacagagcaagatcccatttctagaaaaataaaatacagagcaaaacagtaaaataaaataaaccactgtggatgtacagagaaaacagagtggcctgtgaaacgcagtggccatacttggcaatttcagctgtgaagacacagccagggaaaaaaaatcaaagactggctttaatatacattaaatacatatattcgttatagagttattccatatttaatagttattccaataactattagccttatagttcaaatatttcttataccagataattcttaaaaacacttcatatcctaacatcagaaagaattttataattggatctgggaccatttgacaatgtacttgcatgaaaaaaaatccaaacctaaattatgcaggtttaatacgcagcttacgtcacatgaaactgccctctataaagcaagcattctgtacatataattaattttaacttgatgaaaagagcatctcacggaagaaaacatgtaatgttgagtagaaccactagagaacgaggagatatttcttctcatttatctgtgatgtttcatttcatttgaatgaaatcagttaagtatataattagggcccataactcagttcagttttattttacagtaacatttaaaccctagaaaaaaacaacatcttgacctggtttcctctgctataagtggcaataattacaatcatcttgctatgtctcaagaaaactaaagtaggcagttggtttatccaaatccattcctccttctattgtccttgcttttggaggcctgtttagctacttaccctcctccagggtccagaacatcagacaagttctcctggtccccacaccaaggagaaagtcttcaagaatctaaaccagtcacagtaaatccattcctattgctctaaccaggttaggcataggcagatggggcaaatgtgctgggaaggtttctgggaaagggtctctaaattcttaaaaagtgcaagggaaatcttctatctctgtatagaaatgtccaaagaggtgatctaggaatttggcagccaccctggacccagggggaacaaacagaagagctccagctagtgccctaggctgcatgtgcaattccatcactgagctgctaaaacaacagccctagagctgcctcacttgggcttcctgtttggtgagctaacaagcccctttttgttctgaacgtttttattgagctttattttcaaaaaagcagcctgattcatgcacatatctttagaagaaatttaaaacgccctagaaaagaatatcttcagtttaaaatctaagcaatttggaatttacaggaatatattcctcttagttccagttactcaccattaaaaaataatggtcctcaggttcagctcgaagatatttaaaaaccacttgctccatgaacctttccataagatcccagtcttcaatgattccatgtcgtatcggccactggaggaagagacaccagagttgtcaagcctcagttcgcaacaataagagcaacagtttaacagtggcacagaagaaactgtattattaagaataaaggtctccttctcattgcagttgttgttaattcttgtaaagaaacaacagcatttggaaaaaaaagattaagttacattattgttcatattctcctccactcatttccacaaacaaagaatcaccttaacaatgacacggaggcaggccaggcacagtggctcacgcctctaatccaacgctttgggaggccaaggcaggaggctcacccgagcccaggagttcgagaccagcctgggcaacatagcaagacactgtctctacaaaaaattaaaaaatcagccaggcatggtggtgcgtgcctgtagtcccacctacttgggaagttgaggtgagaggattgcttgagctcaggaggtcgaggctgcagtgagccaagacggcatcacagcactccagcctggatgacagagtaagacctatctctaaaaaaacaacaaaaaatacaatgaggaaccgatagaaaactgcagctaattatcatacaattggatctggagctttaaaaaaaaaaaagtctgcttaaataacgttagtgtttctttttaattaaccaatctgcaattttccctcatctgacaggttagtcaacctgtcaacaattttccaggggaggggatcttgctttcatgtgtgacctggtgtttcctgagtctattctgcattccagggatctgttaattcccttaattctccaatcaaaaatacccccattcaaaaccaaccatcaccaccacctctattcaaacataagaattcaaacataagaatagaaacacattctacaactcgcaaatacaacttctagatgaccattttgcattactcatcctactgctctacacttagagaagcagacacctgtcggaaatttacctttgtagcatatgtaggtttatcgatggcttcatctcctatgaaaaagtcaaggtcatcaactcccctcaacactctcctttgggcttggtcaactacctttgctgactctctgatggcaataccttaaaaaaacacacacacacacagatttctatcactatccatatctatttaaatgatcaaaagggataatatcctaatatacacacaagtaaattttcattgttagggctccatgtggggtgaagggtgctcacagaaaagacaatgtcaatgagtacataaaataatacagaaacaggttattctattctggtatgattttcagaatgggacaaaggaaatgagctgctctacttttatactgacagaaggtccattgcaaaatttctcagttttatctggaaaaatccctcaagatagtaagtgaaatgcctatacatcagtaggttccaaatttaaaatacaatatggaaggggacaaaattctgtacaatacagaaaaggagagtaaactgaaaaataatgtctataataagactctacatcacatagccttaaaatgtacttttagtcttgttacaggaagaaaaaaagccgttaaaatttatcccattaaaaggataaattagaatgttattggttaatatctgtagccaaaaaaagtaccataatcaaataactattacataaaaattccaaatattaatggctttataattcattattttaataagatcttaaccttaaatatttgggaatatacttagcagtaaataatcatatcaaacttcactccagaatttaacagctaatgaaatgtggagggcatcacaaagattccattttccattcaaatttctaactcctgctcacactctcgagctctcccatgagctattttcatccatcaggtctcgacatcaacaccatctcctcacttgagggcttccttgacaacctgcagttctgtacacgtgtttgatgcttccactggcccttttattcctgcattaaggcatttttctggatgaattacaattgtttaagatcagtctaccaaactgtagattccttgatgtcagataacatccatcttttactgtctctccagtgggaggctcagatgtcaataactaataataataataaaagtttacatttattgaacactctgctaagtgtttccttttgcacactattttattaaatcctcacaatagcttatgagacaggtactattatctgcatttcacagaaatggaagcttaacaatctatcaaggtcacacagcttctaagacacagacaggatttgcacctaagcaggccgctggctatcagaatagacattagagaaatatttgttaaattaacattttactccactaaaatatttattgtgggtttgaaaaatggtcaaactatacctaaataattctaacataaacctaattccataaatatactaatggcttctcactgtccttaatgtatttctgatgaaagtacgactctgtagctatacaaatgtaagtgctagataaaatttctctgaatcaaaatctttgtgacttactacacaaagtgatgtacagagtcagtacagtccttatcaaaataccaatggcatccttcacagaaatagaaaaaataatcctaagttcacatggaaccacaagagaccccaaacagtcaagggaatcttaagcaaaaagaagaaagctggagggatcacactacctgacttcaaagtacactataaagctacagtaatcaaaacagcttggtactggtataaaaacagacatataaaccagtggaacaaagagcccagaaatgaatccatgtatttacactcaactgattttacacaacgggcaaagtgtaaatgttactggggaaactggatatccacatgcagaagaatgaaaatgaatgcttatctctcaaccatatacaaaaattaactcaaaatggattaaagacttcaatgtaagacctgaaactgtggaactattagaagaaaacggtaaaatgctttatgacattggtctgggcaaggatttttttggacaagacctcaagagcacaggtaacaaaaatagataactggaattacatcaaactaaaagtcttctgcacagcaaagaaaacaatcaacagagtgaagagacaatctatagaatgggagaaactatttgcaaactatctacctgacaaaagattaataatcaaaatatataaagaactcaaacagcaataaaaaaaacaaataacccaagtgaaaaatgagcaagagacctgaatggacatttctcaaaagaagacatacaaatggccaacaggtatatgaaaaaatgctcaatatcactaatcatcggggaaatgcaaatcaaacccacaatatcaatcacctcaccccactgagaatggcaattatcaaaaaagcaaaagataataagtgttggtgatggtgtgacaaaaagagaacctttatacactataggtgggaatgcaaatcagtagagccattatggaaaacagtatagaggctcctcaaacaattaaaaatagaactaccatacgatccaacaatcccactactgggcatatatccaaaggaaatgaaatcagtatgttaaagagctatctgcactcccatgtttactgtagcactattcacaataaccaagatctggaatcaacctacgtgtccattaacggatgaacagataaagaaaatgtggctttataaacagtggaatactattcagccatttaaaaaaaaaaaggaaattctgccatctgcccacaacatggatgaacctcgagggcattatgttaagtaaaataagccaggcacagaaagacaaatatcacatggtctcattcatatgcaggatcttaaaaagttgatctcatagaggtaggctatagaatggtggttacagggggctgaggctgttcggggatgggaaggacaagatgttggtcaaaaaatacgtaactacagttagataggagaaataaattacaagagatctagcatacaacgaggagacaacggttaatgacgatatattgcattcttaaaaaatgtagagtacatgttatgtgctctcaccacaaaaatgatgactatatgaggtaatgcatttgttaattagctagatttaaccattcacaatgtatatagacttcaaaacatcatattatacacgataaaaacacacaatgttatctgtcaatttaaaaaaataaaatcagagccagctgtggtggctcatggctcatgcatgtaatcccagagactcacgaggctaaggcaggaggatagcttgagctcaggagtttcagaacagcctgggaaacatagcaagaccccatctctaaaaaagctaaaaaattagccaggcacaatggcacacatgcctgtagtcctagctacttggaaggatcacttgagcccaggaggttgaggctgcaatgagctatgatagccccactgcactccagcctgagcaacagagtgagaccctatatcaaaaaagtttaaatttttaaaaactgtttttaattaaaaaaatttttaaaatccttgtgactgaatttcaggagagagtaaataatgtttctaggccaggcacagtggctcacacctgtaatcccagcactttgggtggtcgagacaggcagattgcttaagtctgggagtttgagaccagtctgggcaacatggtgaaaacctgtctctacaaaaaaaaaaaaaaaaaaaaaacacaaaaactagccgggagtcccaactacttgggagcctgagacaaggggattgggaaattgaggctgcagtgagccatgatcacgccaccacactccagcctgggtaacagaacaagacccagtcacagacaaaacaaacaaagaaaaaacagtttctgatatgaactaatttcttcaaacagtccagccaagttaatttttctgcacagctactacatgaatgagcacacagactctgaagttatgaaaacctaggtttgagcacttactagttagctgacttgaggaaagttattattaaccctcagtgctctctcctccaaaatgcatataccactacctatcagggtggtgagtattaaatggaacaatgtttacaaagtgtttagcagagactgtggtagagaatagtactcaataaacaatattatctatactaaattggagaccaaatttgtgactggcggaactgaacaggtacccagatacaaccattccagagaagaactgagaaaaatattataatatgtttatccagcaattccacttctagaatttcattctaaagaaataatcattgagtaaataaaagtatatacataacaacactctttgtagaactaattataatagcaacaaattgaaggaggaaagttaactgacctgaaatcagagatcaggtaaataaattatatcaaatccttagaaagagctgctaaggctgggcgcggtggctcacgcctgtaatcccagcactttaggaggtcgaggcgggtagatcacctgaggtcaggagttcaagaccagcctgaccaacatggtgaaacctcatctctccttaaaaatacaaaaattagccaggcatgggggcaggcacctataatcccagctacttgggaggctgaggcaggagaatcacttgaacttgggaggtggaggttgcagtgagctgagatcgcgccactgcactccagcctgggtgacagagcaagacaccgtctccaaaaaaaaaaaaaaaaaaaaacaagagctactaagttgcctttcagaatatccacagtatgactccacttcagacagagtttgcacgggtgtgtttaatgtaaattcagaaaaataagatggccagacaaaggattaatactggttaaccatggatggtagagctactggtgacttttgctgcttctactgggtatattggtttttcagctattaaaaagaagctaaacaaacataataaaagtaaaagctaatctttggtttgtgagcgaaagcatttaacctgttacctctcaaaatcatttacctttaatgcctcatttccaaatgaaaagttttcaaggtaagtcaggctatagaattttctcaaacagagagctattaagctagctagaaatttatattaaaatttgttccaagacaaattagtaaacatatacaattatttctaaaagtagattatctggaacctccaatttactacaaatgaagaataacaacacagctataagagtgaatttgaggccaggagcagtggctcacgcctgtaatcccagcactgtgggaggccaaggtgggcagatcacctgaggtcaagaattcaagaccaccctggccaacatggtgaaaccccatctgttcttaaaataaaataaaaaatacaaaaattagctgggcgtggtggcccatgcctgtaatcccagctactcaggaggctgaggcaggagaattgcttgaactcaggtggcaggggttgcagtgagctgagatcatgccactgcactccagcctgggtgacaaagtgagactccatctcaaaaaaaaaataaaaaagagtgaaactgaagcctttttctcagaagggcatcttgaggtaacaggataaaaaggtgaaaagaaaaagacacagggcagaaatcactttccccacctccttttctcattgcaactcactgccacatttaaagtctcaaagatatcaaattataaacagtggcacacaagtaaaggacagaacttcagcagaactgaagaaagcacgagtgaagtggaaacacgggctgaaatgagaagtgaagaggacattggagatcttgggctgaacatgggctagaaaagtcttgtgggccacgacgactgaggtgatctgtagaaatagataacatccatctctgaccacaccattcaatggcacactgactgacaccacacagaaccatctgatgtacaagtctggtattccaaagggccactgccaatgtgccaacacaagtgacagatactatcctctaggcaagatcaaacttaattgtgtgtgaatccagaattaaactgtcaagtcaatataaaagattgtaaagatagccgggcgcagtggctcacgcctgtaatcccaacactgtgggaggctgaggtgggcagatcacaaggtcaagagatcgagaccatcctggccaacatgatgaaaccacaactctactaaaaatacaaaaattagctgggcatggtggtgcgcacctgtagtcccagctactcaggaggctgagtgagacaggagaattgcttgaacccaggaggtggaggttgcagtgagccgagatcacgccactgcactccagcctggcaacagagcaagactctgtgtaaaaaaaaataataatcaaaaagaataaaaataaaaataaattaaaacacatcacacacacacacaaagtatacttcttttaacaactatacaggaagcaactgtatccatacaagagaataaaagtatatagagcttatattccaaatattttgtctatacctatggaacaagatgtggcccaaacagttcttatgaacacaatggagaaatctgtctaaataatctatgtcacccaagctatctctagtacagcacaacataccacagtccccacttccaccccggcccagcagtaacatggagctcctccccaagtgagtgtcaacaaaggccaaaaggagaacctcaactttgacccccacactggcaataatgaagtggtatccccattcccctgctggagtagtgtcagaaaagacttgctaaaacacaaaattaaaataagaacctcataacataatacccaaagtatctaggtttccactttaaaactctcaccgtggcaaaaaccagtaacatctcaactgaaaagagaaaagacaatgaatagacaatgccaccgagataacacagacattataattatcaaacaaggattttaggagccatcacaaaatgcctcaatgagcaatctcaaatactcttgactcttgaaacaaatggaaaataaaaggaagtctcagcaagcaaatacaaagccacagcaaagaaacaagatataaagacaaaaccatatggaaattctagaattaaaaatcacaataactgaaataaaaatcttaagagatggcctcaacagaagaaaaggacagaggaaagaaacactgaacttgaagacagaataacagacattacccagtccaaacaaaagacagaaaatagactggaagaagtaaaaaaaaaaaacagagcccagagcctcagggacatctgggatatataagaaaagatttagcatttgtggattacaattcccagaaggaaaagagaaagaaggcaggaccagaaggtatgcaaagaaacaatggctaaaactgccaaatttggcaagaaaaaaaaaagggaagagaaaaagaaataaactaatagattcaatactgaacaaaccccaaataagttaacccgaaacaaaacaaaacaaaaaaaatccattccaaaacacattatactcaaacttctaaaaactaaagaccaaaaaaaaaaaaaaattcagcttccaaggacatttctcatcagaaatcttgacacacacacaccaaaaaaaaaggtaccacaacatttttgtgctgaaagaactgtccatccagaattctatgttcagcaaaaatatcccctgagaatagagcaaatcaagactttccgttgaaataaaactaacacaatttgtcaacagcacacctacttcaaaagaatggcttgggatgttcaggcagtccattatttttgttgttgttgtttttgtttttgtttttttggtttgtttttgagatggagtatcgctctgtcacccaggctggagtgcagtggcgcgatctcagctcactgcaacctccacctcccgggtttaagcgattctcctgcctcagcctcccgaaatagctgggactacaggtgcacgccaccacgcccagctaatttttgtatttttagtagagacagggtttcaccatgttggccaggatggtctcaatctcttgacctcatgacccgcctgcctctgcctcccaaagtgctgagattacaggcataagccaccgtgccctgcctatgtttctttaattaagaataaataaataaatattaaaaagaatggctaaaggaagttctctaaagagaaaagaaatgataaaagaaggaatttgggtacatcaagaaaaaagaaagaacaatggaaagatcaaaaatatggatcataattattttccttttcctcttgcgttttctaaattatgtctggcagttgaagcaaaaattataactgatgtgaatctcatgagattcaatgtatatcaaggaaagatttaagacaattatattagaaatggggggccaggcacagtggctcacacctgtaatcccagcactttggaaggccgaggcaggtggatcacttgaggagtttgagaccagcctggccaacatggtgaaaacccatctctactaaaaatacaaaaattagccgggcgtggtggtgggcacctgtaatcccagctactcaggaggctgaggcaggagaatcgcttgaactcagaaggcagaggtcacagtaagccgacatcacaccactgcactccagcctgggcaacaaagcgagattctgtctcaaaaaaaggcacacactgtatgagtagtagcattactgctgagtagtatttagtgtatgatgtagcaccgtcagtttaaatattaatctattgaagaacatatattatgcagatgataaaattatagagatgaaaacagagtagtggttaagaacagtggagggagaggagtaagtgtaattatataggaatagcaccagagagatcttggtagtgagaaaataattctgtaactttattacagtggtagttcaaggaatctacaggtagaattacaatgacatagaactatacacacacattgtaccaacatccgtttcctggggctggtctgtttttgtttttattttttagagacagggtctcacttctggttataacattgcactacaatttgtaagatgtaacctttgggggcaaaataggaaaagtgtacacaggatctctctaaactatctttgcaacttcctattaatctataattatttcaaaataaaatattttaaatacagagtttataaatgacttaaactagaaaataaaacacttcagctataatgatgaatcaaaactaataagattaaacttaataataaagaacaatgggccggcacagtggctcacgcctgtaatcactttgacagactgaggcaggtggatagcttgaggccaggagttcaagactagactgggcaacacagtgaaaccctgtctctattaaaattacaaaaatcagccaggcatggtggcacatgtcggtaatcccagctacttgggaggctgaggcagaattgcttgaacccaggaggtgaaggttgcagtgagccaagatcgtgccactgtactccagcctgggcgacagagcaagactctgtctcaaaaaaaaaaaaaaaaaaaaaaaaaaaaaagaacaattcttttttccaacaagctctgcagttgaaaaaaaatgtgtttgggtataggattataggatgtgggtaaccagaaaagacatgactactttcctaaatgccaaaaaagtcatctgagggcaatctaaggaaggttatcaagaagagtgtatctaaggacttaagacacagatactttagaacatttgctacaacagttgagagacacaacaatagtaatttttttaatccagtatatttctcaaaagactgttagatatttttactaaagcttgaaggaataaacaattcctatcttatgcaaactgttccagagaataaaaaaagaaagctaacaaactcattttatgaagcccatataatcctgatacacaaccagacaaaaacaagaaatcaaaattacagtccaatctcacttttgaatattgatgcaaagttctcaagtaaatatttgcaattacagttcagcatgtacttcatatttcatagccaagtaggatttatcccaaaaatgaaataattgttcaagctggacaaggtggctcattcctgtaatcccagtgctctgggaggctgaggcaggaggatcacttgaggccaggagtttgagaccagcctgggcaacaagagagacccccatctctacaagaagaaaaaaaagaaaagaaataactgttcaatatttgaaaatgtattaaagtaactcctcctattaagagtaggtggggtggctcacacctataatttcaacactttgagagaccaaggtgggaggattgcatgagcccacaagttcgagaccaggacaggcaatataatgagaccccatctctatgaaaaatttaaaaattagccagacatgatggctcccacgtgtggtcccagctacttgggaggctgaggtgggaggatctcttgaacctggaaagtcaaggctgcagtgagtcatgatcaagccactacactccagccttaaagtacagtgtctcaaaaaaaaaaaaaaaaagaaagaaagagtacaaatgtccaaaaccatatgatcatctcaataacagaaaagctttgactaaatgtcaatactcactgtcattcatgatttttttaattaaaaaaaaccctcagattaaactaggaatagaagagcactgttttaatctgaaaaagcatctccacaaaaacctacagttatcactagtagagtactataataaaatcccattctctttaaagtcagaaagtcaaaaaagcacctgctgtctgcagttctgatcactattttaatagaagttctagccaacacagcaagaccaagaaaagaaacacgaagtgttagaattggaagagacaaaataaccactatttgaaggcaatacaatagtctgcatagaaaactttaaagaatgtgcagactgttaaataagagaggtcaataaaggttgccggattaaaaaaaaatcttacaaacctcagtaacattcccatatgctggcaataatgaattagaaaatagaattttttaaatattttgacgacagcaacgaaaacttaaaggtacctaaaaataaagctagcaaaaactatggaagagttgtcttggggttttgcttgtttttgagacaaagtctcactatgtcacccaggcaggagtgtagtggcgcaatcacaactcactccagcctcgatctcctgggctcaagcaatcatcccacctcagcctcccgagtagctgggaccacaggtgagtgtcactacacgtagctaatttatttttatttctggtagagacagggtctcactatgttgccaaggctggtctcaaactcctgggctcaagcaatcctcccacctcggcctaccaaagtgctgcaattacaggtgtgagccactgtgtccagccctctgtgtacgagtgtaagggcgttgttgttgttgttgttgttgttgtttgttgttgctggttgttgttgttgttgttgttgttgttgttgttttgagacagcgtctggttctgctgcccaggctggagtgcggtgacgcaatctcagctcactgcaacctccactcccaggctcaagcaattctcatgcctcagccttccaagtagctgggattacaggtgtgagccaccacatccggctaatttttgtattttttagtagagacaaggtttcaccatgttggttgggctggtctctaactcgtggcctcaagtgatccacccaccttagccctcccaaaatgctggaattacaggtgtgaaccactgcgcctggcctgtaagagctttttaaagaatactttaaggccaggcgcagtggctcactcctgtaatcccagcacgctggggagctgaggtgggtgaatcacaaggtcaggagttcaagaccagcctggccaacatagtgaaatcccgtctctactaaaaatacaaaaattagctgagcatggtggcgtgcacctgtagtcccaactactcgggaggctgagggcaggagaatcgcttgaacccgggaggcagaggttgcagtgagctgagactgtgccactgcactccagcctgggcaacagagcaagactccatctcaaaaaacaacaacaacaacaaaaaaaactttagaacattagaacactactgaaaaacacaagagacatgaataaacaataaaacacatataccatcttcaaggataggaatactcaattcgtatccacgaaagtcaaatttgatgtcaaattttttcccaattaatctataaataataatcaagggcgggcacagtggctcacacctgtaattccagcactttgggaggccaaggcaggaggatcatgaggtcaggagttccagaccagcctggccaacatggtgaaaccccatctctactaaaaatacaaaaattagctggatgtctctactaaaaatacaaaaattagctggacgtggtggtgggcgcctgtaattccagctactcgggaggctgaggcaggagaatcatttgaacctgggaggcggaggttgcaatgagccgagatcatgccattgcactccagcctgggcaacaagagcgaaactccatctcaaaaaaataaaaataaaaataaaaataataataataatcaaaaccccattataattttcatggaacttaagctgattctaaaatgaacactaaagagtaagagccaaagctattctgagaaaaaaaatgagtaggaatcgaacccactagattaaaacatgataaagtaatagtgtttaacactgtgagtatggaacgtatggaacacagataaatacatcaaagaaacaaaagacaccgaaaacattcccaagcataaatggtacctccatatgatcaaagaggtgtgccaaatgggaatgcactctttaataaatagtgttgggacaactagccttccgcatggaaaacaaaattacctatctccttcacaccatactcacaaattaacttaaaattttcttagaaaaaatatagaaagtctttatgactttggagtagaaatgcattttttaaacagaaacaaattataaaagaaaaagactgaaaagtattactatatcaaaattttaaatttctagatgataaaagataatttttaaaaatgtcatagaataaaaaagtatctgcgaaaaattcatatttaacctctacaaagagttcctataattccacttaaaaatgcaatagaaaaatgggcaaagatatgaacaggtaatgaaaggtgctcaaccttaccagtaatctgagaaatagaaattttttgaatgagccatcattttacattcattagactgaccaaaatgtgagtcacacaataccaattatcaaggatctacgaaacagaaactctcacacactgctgatgggatatccatcagaacagcctcctggaggagtaacgtggcaatacctaattaggtgttgcctaaggatgaaggggtgtacgctctgtgacaaaacaatttctgattatttcctctcaggaaactagcagatacgcataaggaaatttttactgcaccattttatataacagagaagtgaaaaatgcccaaaaggaaaaaaatcgttgtatattcgcgttagaattctgatgtggatctgtatgtgtcagcactgatacatgacaaaaacataatattgagggtttttctttttaaagaccaggcagaaagttatttacgatgtgataccatattggaaatgtttgaactcacaaaacgatgtatctttgtacatgtaatatacggataaaaatggagtagaaacacaaccagaaactatccaccagaggaaagaaaagaggaaaagaagagagggctgatactcaacctataatgtgccatttattcatttactctgatacagagatgaaatatgcagtaatgacgtgttcattcttggtggtgagtccatggggtttttgtgtgtggggtttgtttcttttttttttttttttttttttttttttttttttttttagatggagcctcactctgtcccccaggctggagtgcagtggtgcaatttcggctcactgcaacctccacctcccggattcaagtgagtctcctgcctcagcctcccgagtagctgggattacaggcacccgccaccatcccgggttaatttttgtatttttagtagagatggggtgttgccattttggccaggctggtctcaaatccctgacctcaggtgattcgcccaccttggcctcccaaagtgttaggattacaggcgtgagccaccgcgcccagcccactgttatattttctagctgcagcctaactctcttccctaggccttaaacctcttcacacctgaactcttccaatattgaatgtctaaaatgtgtgccctttttctcagcccctcgctgctcctcctctagcctctttctacaccacacattctctgatcaccacacattctccgcctgaagctgcggcaggaccaccaatatcctccaacgacttaagaaaaaaaagtagggaataactttcttcaagcaaccaagcaaattctgcacagaagctccaacaaaccagacataagcagagctgcccctggaggcagggacggggcttgaggattctctagtccagtgggccaggccccagagagaagcctcaaaaacagtctgaaaattcctggtatgcaaaataaaaacagaattccttaagaggacacttgcaagtcccttgccacccagtccttccccacaggtctccacctcctggcgctctccccaccatcccacagcacccctgcttctccacacccccacagcacctcacctccatgccacgcagagaaagtcttgctccagcactcagcacacacatccacacacttgcacaaaatggttccactcccagccccaagacacgcagcaggccaactgtccacggtgacccagggcctcacttccacatctcagtatcctcacttctgcccgaacatcttctaaccttgactcctggggcctctcttgcctctcttctcttctctctctctctctctctctctctctctctctctcaacaaactcagcccaacaatgtaactgttcttttactcccacctctttgacatttgtattatcctcctagcttctgcgactgctaaggttctgatagctgcagtctgagagctctcctgctttttgacagtgaatgaaatcctgataataactgtcttcgcttcccgtctctattaatgatgacaggttaaatggggcagccaactgaatgctaccaacagctttaaatggcaacacattaaagcaaaaggtgcaaggtcagccttttatagctgtcacacttaacaaggttaaaatctaattttctgctttgaaaagtcagggagttcaatttatcaactcagcatggaatgatcgggttctggggcattcacattaatgaaattcacaaaagactgattcatcctacagaacaccaattgtcatggactgaaccatgtccccacagaattcactacgcagaagccctaaccctcaatgtgactgtatttggagatgaaacttttagagaggtggttggggtaaatgtggggtccccatcaataagagtggtggccttatcagcagagaaagagacaccagcgaggtccccagcaaccccacacactgacacagagatgagaccatgggaggacacagagagaaggcagccctctgcaggccgtggggagaggcctcacgggaaaccaaccctgacagcaccttgatcttggacttccaacctccagactatgataacattaatttccccagtctttagtattttttatggcagcccaagcacactaagacactcgtttctgaattcaaaatgaggacacagcagaccaatcatgcctgtcatcaggataacccattcatggcagcagagcgtttagatctagaaaatcacattcatggccagtttttcagcaagcaaggaaccggaatgaggttacttaaatgttctcaaagaatctggagtccgctttctagtgatgtgaatacccacattcaccaaatacagctttagccctcccctgaataagcactaatcaagcaccttctctccagctgttttttccctgtcgacattccccactgttcacaaagcctgttattacaacatcgtggccccctaaaaacttacaatttctaaaatcacaacttatcttattagagctacatgtagagaacagactttcactttctcttgattaatacatcctactctttagaaaactgtttccaaataataacctgaaatatagatagttccagggaatcctatctttttttttttttgagacggagtttcactcttgtcactcaggctggagtgcagtggcacgatcccggctcactgcaacctccaccccccagcttcaagtgattctcctgcctcagcctcccgagtagctgggattacaggcacgcaccaccacacccaactaatttttgtatttttgatagagacggggttccaacatgttggtcaggctggtctcgaactcctgacctcagctgatccacccgcctcagcctcccaaagtgctgcgattacatgcgtgagccaccacgcccagccaagaatcctatcctttaacaaccgactaacctcgggaagactcctacaggaaataaagagtgagtagaacgccccatgccaaactgcaaggacacttctgttattctctaccgattaaaacttaaacaaaaacagaatactactaaacacaataaaaacagtcatcaggcctatcatttccaccaaaaaaaaaaaaaagaatctttcaatagagtgaatagtgtagtacaagagatattcagtccattaagttactaagctaacagactgtatgtacttaaaattacaaatttaccttaaagaccagatatactttttctaggcagttcaggcatttataattgaataaatggaccctgctgactatccaagctgagattccaacgacagtgacaaggggctttatcagaatggaacagaaggactagaaagttgtggggtaaccagaacggtcttctaaaagaagatggtaagtacattaatatatcttgaaaaacagaatcagaacacttagaacaattctgagaaacacaaacctttataaacccaaggatagagctttacttacatgaaggaataatgaactggggctcagtgttgcctgcgtagccaagcttggtatacctaaaagcacaaagtcatcaacacatgtttagataataatactctcgtctatattggattaatgtcttttattataagctctccaagtcctaaaatagcaagcctcagaatactccttgaaattaaaaaaaaaaaacaaacttgtgatcactgagaatcaaacactaacttcaaagaaagcagttttgcaaaaacttaaaatattatgcttgtttctagtagaaaaaaagaaacacatatatactaacatataaattacatttatgcatccctaataactttaaaagtgcctttacactctatctttacaaaaaccttgtgaagaaagtagaaattatccctgttttgcaaatgagaaaagggaggcactgagaagttgattaaactgcccacattagtgaactgcagaaaaagaactcccatctacatatgcaggctaattccaacactggctctctaagaagtgtacttacttcctagaacttttatacaaacttcctgaactttgcggggtggggggcggcggttagaaaatgattatataattttcttaaaatgtcatggcatatgtctaagaaacagctactgccgtctcctgagaatcatctgacaagagcatctcttcatcatctcatttcagaaggagcccattttctgtcaagacactgcatgatagattccaaaagtcttaactaaaacaaatgccaaaatactactatctgttccaaaagcatttgctagtctcctaaatataaaagggggggtggtgggaaaaaaaccaccactcagaaccatctgctggaaataaagttgaaacgcggtaagtaaatcgagaagactcatcagcgcttcctttcttattaggactactctaattaacagtaacgtctggacaaccaagccgtcattctgtaataatgcttattattattatttcaacactgctaacactagcagtgttgaaactaactttattcattcaattttaaaaattatttcaatatgcttaatattaaatttttgatccggtaatatttctaaattctaataaattaattttacaatttttaagtatggtttaccatatgctaattttactatttttgaacacacggtgaatggataaggtctggggaaaccaaaaaaaaaacaagtcagctcccctcaaatcacacattgctgctcaacttccacaggacctgaggtcttcgtgccacaggagccagggcaatgccaagtcctgagactcctcaggcctacaaggagcttctggaggcaagacccaggtgaagtcctctccagctccacaactcaagagctggaaacagagtacaaggccaagtggacctaccacaactccactccggggttccacctacaaggtagaattcagagccaaccaagagccaacccaggatggaggcaatagagagcctgacctttagaattccagatccttcccaattttaacatatttctggaattatattccagaaaataaatataaataagtgaattactaacccaaggctaaagatgcctatggaatccaacaagcagaccagaaatcactaaaatcatcaaatctgtgtctttaacaagctacctcagctacttcccacaaaatgatgcaccttatgcttaaataaatccaccttcccacactgttagactatgagttccacacgctgcccagaacagggtcctttctcatggttatatctacacccccggcacagtgactggcacatggcaaatactccagaaataactgctgaatgtattctcaccagttgtaaaaaaggtaatcattgtcaaactgctagcggaaggaccaatatttgcaagagggatgctgaaagtcagaaaaagaatctgatggaaccagaaaaaaaaatcacagacatcatctcctacaatctcctatttaagaggagcagtggcctatgtgtaatgggtttcagaaaaaaaaaaaacactgaaacgaatatggtaaaaattaacatttattaaaattaggtgctaagtttcattcaggctattatatcattttcgtattttgagtatactatactggttaagatcatgcactttggcaccacactgagttcaaatcccagccccactatttgacaaatgtgtatctttgggcaagttactttacctatctgtatgtcagttactgtaaaatggggataatagactgaggcaagaggacccgttaagcccaggagttcgaggttgcagtgaactatgactgcaccactgccctgtagcccgggtgacagagcgagaccctgtctcgaaaaaaaaaaaaaaaatctgaaaagtttaaaaaaacaaacaaaaagcaatttgttctgtatcccaagtgatagcattcattcttcccactgtgcaccatggacagtttaatttgtatagtggtgagaatgaaatgtatgaaacaaatggtaaatctagtagatacctgataggccttcaacaactatgcctcatttccatcccaaagttttgtaccctgaaatcataactatggcccacagcaggaaaaggtcagactacaaaaacagacttgagcactgttaggctcacagctctaaaattcaactaaacactgatgatatgactcagcgacagctgctggaatgttcagattcttaagtcacaacattcttttagacagtatagtcttggaaggaggtctctgtcaaagtcacacgggtaccttaagtatcaatgacattaagccaacaatgattttcgtgaccgaggcaaactaacatgaagatatattaattttttttttttttgagacagagtttcgctctttcgagcaggctagagagtgcagtggcgcgatctcggctcactgcaacctccgcctttctgtttcaagcgattctcctgcctcagcctcctcagtagctggaattacaggcgcctgccaccacacccggctaatttttgtatttttagtagagatggggtttcaccatgttggccaggctggtctcgaactcctgaccttgtgatctgcctgcctcggcctcccaaagtgctgggttacaggcgtgagccacagtgcctggccctaatattcttatgtgttaacaacttactatgagatcattaccctcctagcagaactgacgttatttttaaaaacactggcaaaagcacaaattcttcagatcactttattctaatataatatctttccattttcctgggctattccttatatattaatagtatcaaatacacttgaagttttgttactttgaataatcataatgtaacaaacatcaaaccaaatttgagacattcaaatttaaaattttaataaaatctgcaccaacataggctcatccatcactaacttcaatgacaatctattaaatataactcagtagatgtcatctaaaaagtacgcatcctcaaattctttcccaggaggagaactcaatgctagactggcctgccccattagagatgttaacatcacagctcaatgccatgaagagcaggaccaaaaaaacaaaagcaaaacataattcttaaatatggcaagtgctcaagacaccatttaccaaaaaaagaaacgttccctatttcaaccagtttactagctagtaacaatgtagcaggcactgtactagtcactgagccgtactcagactgaggataggggaggcgggtggacatggcccaggtcctcaaagtgttcctcaaaatgtttacctattagttacaggacttcagattgagctttccagttgtagcatggcttactttacctggaaggcaagtttaagatctgggtaggcatcaaggaagaataagccacatgtggctgaccagatcacctgggaaactccggaaacagattcccaggggccgtgcgcgattcactaaatgggaatctccagagaaggctgggcatctgtgttcttaacacccctcgctcacccgcatggttctggcggtcaaccagcttagaactcactgacctcaactacgccacatgaagtcacctttagcatttttatataatgcaagcttcctcactgtcacattataccacaaccttcttccacccaccacatttagcacgatatatctataatactgaagtttaatactggtcagaagttcagaagaaataactcatatgtccctttttttttttttttttttgagacagtctcactctgtcacccaagctggagtacagtggtgtgatcacggctcactgcagcctcaacctcctgggctcaagtgatcctcccacttcagcctcccaagtagctgggaccacaggcacatgccatcacacccggctaagtttttttttatttttttgtagagaggggtcttcctatgttgcccagattggtctcaaactcttgggctcaagggatcctcccaccttggcctcccaaagtgctaggattataggtgtgagccaccgagcccagctaccaaatgcagcaattttgtcttattatttaaaacactgtgtgtttaggtactctatgaaaaaaaataatgtaggaaatgctttccaattcaaactatgcaattaagaagtagtgaaaaaaggccaggcacagtggctcacacctgtaatcctagcactttgggagtctgaggtgttggatcacctgagctcaggagatcaagaccaccctgggcaacatggtaaaaccccatctttatactaaaatacaaaaaattagctgggcatggtggcacgtgcctgcagtcccagctactcaggaggctgaggcacaagaatcgcgtgagccctggcgccactgcactccaacctgggcaacagagtgagactttatctcaaaaataaataaataaataaataaacaaacagaagtagtaaaaaaaaaaaaaatctaggctcaatccaggaaagtaaaaaacttaagctaaaaagggaaagattccttaggaacagatgatgggagaaaaaaaaaatctcaaaccaaaataaaatgaaacactagaagaatccttattgaagccagaattaagccaaggagatctactatcattattctgattttacactgtttaggaagaattagatattacaaatcaaaaagaacagagtaaaggaaaaggattttgggaagaaggaggagattaaaatttaattcttttttttttttttttggacggagtcttgctctgtcacccaggctggagtgcagtggcacaatctcggctcactgcaacctccacctcccatgtttgagcgattcttctgcctcagcctcctgagtagctgggactacaggcgtgtaccaccacgccctgctaatttttgtatttttagtaaaaacggggtttcaccatgttggccaggctagtctggaactcctggcctcaggcgatccacctcggcctcccaaagtgctaggattgcaggcatgagccaccgcgcatggcaaatttcattctttatagatgataactgtataccttgaataactaaggaaattaagtgaaaaactaaagcaataagggaattaaaaaagatgaccagttactaaatgaatagacagaaatcaacaactaccctgtctaacaataagaacatataatggatgaaaacatcccactcagaatggcaacagcaatagaatgttacccttaagaatacactacataactacatgaataagctattactcctacccttaaaaataatattgctctttaaataaactctctatgtacaagcagacaaatagagacatgccttaatcttacacaggaagagtccattttgttttttttgttttttgttttctggtcaattggttcaggatgaggaagagtcaatatttttaaaagaaatattgaatatcactaaatctacctacaaatttaatgcaaagccattcaaaactggtgccaatactgaaggtggtggtaaattatacacaggtgatagtaaagggttaaagagccattataaagtgtcacattagctatcaaaaattttaatgcacataccctattagccaaatagtgcctttctaggaacctaccccacataagtatttgtacatgtatgcaaagatatacacacacaaaaatgttcggtgaagcactataatagcaaaaccaccaccagaacctggaaacactcaaaatagaggatatattaaataaattatattacatccattcaataaaattctatacaaccatcaaaaatgaagatgtatacttactgccataaacggatatataatatagcttgaaagtgcttgaaaacagtatatatttataatgtgaggccagcttaatagggacacaatgctaggttcaaatcccagcaccagctatgtgatttcaggcaagtaaattaatcccttcattccttggtttcttcatctctaaaacgtgggtaataatccctacctcagtgttaaatgttgccatttttggataatatttcctaattcaaaagaagtaggatttcatggtgcagtgatttatttacttattactgaatattattttttgtatactagtgatctctatttctctcatgaattgtccttggataacttttctactggagttttagtgcttcttatcaatttgtgtgaatgcttatacactgaggatatttgtgcttgctcattacattgctaatttttcccagcttgttgtttaccttgttatacattttctgcaatataagtatttaaacagtctaggtgatcaaatctaccaattattttcctgaataatttcctttattatgtttctactttgaaagtccctctatatgctaaaatgtcatatcatttctcttccacttttatatatatatattttatcccaaatgggaagaactacactaatccaattttcccaaacatatgtatataagcattcaagaccatcaactttgcattaaaagcccttggtttttttaacactaccttcccaaagctagcatgatggaggtaggcactactctcaaaaatacataaactatacttacagattgccagccatgttctcaaactcacaccaccttccatgagtcccttaacttgtctgagaccttttctcatacagaaatcaggaaagacagaagaggaagctatggaagcagacccaatcaatagctgcataaagcactaccaatagttacatgtctgccttttaagcaaagaatatgttatagctcaaaattcaaagcaatataaaaaggtatcctttaagaagtcttacactaccccatttctgccttctatccaccttctattcctgtgtatctttccgatgcttctctctgtacatacaatatattattatttgccccaaatattttttttttttttttgagatggagttccgctcttgttgcccaggctggagtgcaatggcgcgatcttggctcactgaaacctccgcctcctgggttcaagcgattctcctgcctcagcctcccgagtagctgggattacaggcatgcgccactacgcccagctaattttgtatttctagtagagacagggtttctccatgttggtcaggctggtctcaaactcccaaccttaggtgatctgcccgcctcggcctcccaaagtgctgggattacaggctgagctatcacacccagcctgccccaaacattttaaacagttcttgcacgaagactctttcactttacttgttaaatgctcctatcttttgacagcagtaatatgtagacttttcagttctgcaaagtcaggaaaattaacctattgttgactcaacatatttatatataattgaaactcctcttccaaccatgtgtcttaagcagaaggtaatgaacctaaggtcaattaatttatgtttgaaagtagaaatgttacatcttaaaacagtgttttacatctttttttttttttttttttgagacagggtctcactctgtcacccaggctggagtgcagtggtgcaatcatagctcattgcagcattgacctcctggcctcaagcaatcatctgcctcaacttcctgagtggccgagactataggtgcacgacaccatgcctggctagtgttctcaaactgtgtcctgtgagaagttcttttgattgagacccctggtgaggtccagtctcaaaccccaaacttcaatcagaatagctctactccctcttaagatttttcacagtttaaacatggttttgataaaagtaaaattgttcccagacgctaacaatagttttaaagcaacgcacaatctccatattgtgcaatgtaaattacatgaccaatttttttaatgttccttggcttgctgcatagaaaagcatagtctctatagaacgaagaattcaatatataaagttcaaacttaaatattttatccagatccagtatctttgcccgtccttaaattttctatttctccttctgagtactttttttttctctatgttacttcgtatatataagatcataaagcacactgcccttttgtgaattctgaacattgttgtaaggtaaactctgacttccagttaaagtgttttaaaagtgttttaactgtttaaatgatggactaaacatattatctaatttcactctttcccaaagccccactaaaaccaaagcaaaaaaaatttttaagcaattattttaaaaattaaaaaaaaaatttaggccaggcgcagtggctcacacctgtaatcccaacacttcgggaggccgaggcaggcggatcacctgaggtcgggagttcgagaccaggctggccaacagggagaaaccccatctctactaaaaatacaaaactagtcaggtgcggtggcgcatgcctgtaatcccagctactcgggaggctgagacaggagaattgcttgaacccaggaggcggaggttgcagtgagttgagatcacgccattgcactccagcctgggcaacaagagcaaaactccatctcaaaaaacaacaacaacaaaaaatttaaagcaatattaaaccatgaggatgtggagaaaagaaaaggtgacaacagcaagattttggccctgaaaagctgaggacccatcgtgcctgactttagagatataagaaagacagcaggggcaagagctgagaacgagcccaacacactccctagatccttaaaggctctggaacttgttggtgcccatgtacctgtgggactggaataggagggctgaggagcaagtgcggacagcccaaaatactcaggccatggtgagaccctctgccgccccacactgctgggcacttgctcctccctggcttcagccttctctacaagttttccggaatgtgtaaagcaaaggttctctgcacccacagttaactggcagggtcggagtacaatgataaaatcaaacatttttaaataaaccaaaaaaataataattaaacccttgtttcatttaattttttttgttttgcaatcaaataatactcacgctttcttttactgtgcatttgtttggcttatttttgaaccatccttttgctttttttttttgagacagagtcactctgttgcccaggctggagtgcagtatcatgatctccactccctgcaactgccacctcccgggttcaagcgattctcctgcctcagcctcctgagtagctggtattacaggcatccaccaccatgcccagctaatttttgtatttttagtagagacggggtttcaccatgttggccaggctggtctcgaactctgacctcaagtgatccacccacctcggcctctcaaagtgctgggattacaggcgtgagccaccgcgtctggccccttttactttcttttttgaatttttttccaaccttttactttctgaatgaatgacttatatgtaactaccatagtttttgtttagtacagaaagtgaatttagttgagtccatgccaggtgaggtcatctcaggtgcaacagtcttactcgttttaacttttgtactattccttgttgttgcctgtttccttttactctgtaatctattttatttggttgcttttcttcctctcaattttacttttacttttacatttcaaaggtatacaaagtctgtttttagcataatagccttctcaatttatcaatttcaaaaaaatgaaacagtattccttaaccacatattctgaaagatacgacaattagcacagtggtatctcccactccccagcccaaacctaacctaatcccccatgatattgttgacttccaggaaattttgctatggcatgttatcattgtgttgacatttttaaggttgagtcggtatttattcaattgtttttgccttctggcttatttctccaagaaagattattcaattattgaagctggtatctttatacttcaacctctctatttctggagccctcactgattcatctttcagttggctgggttatatctgcaagtagatttttcagtgaggtttatgaatgccattaattcctgagcttttgcccatttgcaaatgtcttattatgctgcattttaatgacatttcaatccaatcacattgtcttccttcttgccctaactcccctactcttgttttttccttttgagccagagtctcgctttgtcacccaggctggagtgcagtggcgcagtcacaactcacggtaacctcgaactcttagattcacactatcctcccacctctgcctcccaggttactgacaccacaggcacgcatcaccacacctggctttttcttttagggggcagggggacagagacagggtcttgctatgttccccaggctggtctccaactcctgggctcaagcaatcctcctgccttggcctcccaaagtgctgggattacaggcattagccactgtgcccagtccccctacattcttaagcattgcttcatcatcttttggcacattacactgttgaaaaccccaagactaaggtgattttattttttccattataggtggcctgttggcttttttcctgcttaaatatgtgtagtattcttttatcttttaggggtttgttttgttttgtttttgagatggagtttcactctcgttgcccaggctgaagtgcaatgtcatgatcttggctcacctcaacctctgcctcccaggttcaagcgattctcctgcctcagcttcccaagtagctggatttacaggcatgcaccaccacacctggctaattttgtatttttagtagagatggggtttctccatgttggtcagctggtctgaccccaggtgatctgcccacctcggcttcccaaagtgctgggattacaggcgtgagccaccgtgcccggcctatctttcaggttttataaattaaccaggatacgcttccattttaatgactctgaattttttccagttcacagtgagtccttatattaatattatatgatctttcattatattccaggaaaactttgtcttttatttattaatgttacatctgttccacacactctgttctcttcagcaggaacaccagctctgactacagtagatgccttctggactcttctcccacagcttccatcttctttctaatcaccatgacctctttgttctttcctaccgtggtctacgtaatttcaggaagttgatcctcacatcagtgatttcagaaccactggtactacctcatgtaacctccaacatgcttttaattcctgaaatgattttagttttctatttctttccttatggatgtcagctgacctccatctcctccttttagctttctttaatcttttaaaattacttctttgttcttttgttttattgagctcgtgttgtctaaatttaagagcaaagtggctttatctaaaattccattctagctgggcacagtggctcacactagtaatcccagcactttgggaggctgaggcaggcagatcacctgaagtcaagagttcaagaccagcctggccaacatggtgaaaccccatctctactaaaaatacaaaaattagccaggcatggtagcaggcacctgtaatcctagctactcgggaggctgaggcaggagaatggcttgaacccaggaggcagaggttgcagtaagccgagatcaagccactgcactccagcctgggtgtcagagcgagactctgtctcaaaaaatgaaaaaaaaaataaaattccattctaattactgaagtactctttccaaagtatactttttcatctatttttgcttgttatgtttccttccttattttctgtgcgtagtcccatgatgggtcctttctgcttcacactcagctttgaatgggtgcaggtctccctggacttgcttgctcagtaacaactcttcgccatgcttacaatgacactgaatacaatgtcttgaaatctctgtgtagtcctctggttgtttagaagaattggctgaacagtgagcaatcagagcctgaacttgggtatactttcccactaattctactaaatcctttgttctgggtgtatatctaattccaaagttcattgtggaggacaggcgggtttaaggggaaatgccttatcttagatattagcaattcctgatcagatataagctggtcatcctcacagattttctcctttagtcaaacaaagtcaaagaacataatgacaccattactacatgatccctctttcagcccagcatgccctgctatattttaggatggaaaggagctgctgccagaatatgcttctttggcaatggtctattcatccatcagctcctagctctgctgtaacgactgtgagtagtaccttcagatacgtatgcttagacacctgcaaccagccagagatgggcggggatgccacatctcagtatcctcctgcaaatggatccacacttcactggaaatttcataaaatgtgatatgaattttagctgttttcttctctatttttggttagttttgttcatttttaggaggttccaggaagtagtgttacatgaatgtatatttatagcaccatatgcccaataaactattaaagaatcttttagtatgaaaaggatataagacatatggtaaaatcaatgctacagagaacttttcctaaatgaagcttttatggcagttgtaaggggaagagtatagtaatttatggctctgtcctctgtcaatacaggtccaatgcaacatgaaaagaatgcacataaaataaatttgttgactactaataatttttattaattagaaataaaaggctttttttttttttttttttttttttacaaatcagatgctgaaagggagaaagggggaggggaagaagagatgcaagctaatttcataattactcatagttgggagccaacagaaaacagccacaaataaaaggactatatataatgataacaattagacaaaaatacagtctgccctaaagtgcaccaaaaaagatattaataaaataaagtggactacatggcaaaagattatgtttaaatacatatatatgtaaatattgcaaaactgaggccaaatatatcaatcatatcaatacatataaatatgcttaaatcacctatctatgagtataaatgagcttaagtcatccaataaaaggcaacattttcatattgactaaaaagcaaaacaatattttgggtacagacaattcagaaagaataataaaaggatggacaaatatatatatatctatatcagataaacacaaggagaagcaagcagggatcacacatcttgatatctgacaaagtagaacttggctgagaaaacaattagaaggctacttgatatgctaaatcaacaactctagtgaagagacaagttatttctatctagataaccaatatggcagcaacaactttcataaagcagaacccacagaaaatgcaaggagaccttaataggttactaaaaataggaggccttagtatgccattctcagtccatgacagactaggtacacacacacacacaaatgtgagcccaggcatggtggctcacccctgtaatcccagcactttaggaggcaggggcgggtggatcacctgaggtcacgagttcgagaccagcctagccaacatggagaaaccccgtctctactaaaaacacaaaaattagccaggcatggtggtgggtgcctataatcccagctcctcgggaggctgaggcaaagaactgcctgaacccaggaggtggaggttgcagtgagtcgacatcacgccactgcactccagcctgtacgacagagggagactcagtctcaattaaaaaaaaaaaattggaagccctaaataacataattaataaggtagttcatatagacacattaaactcagaacttataaagattgtatctcctagccaggcacggtggctcatgcctgtaatcccagcactttgaggggccaaggtgggtggctcacctgaggtcaggggtttgagaccagcctggccaacatggtggaagcccgtctctactaaatataaaaaattagctgggtgtgatggcgggcgcctgtaattgcagctacttgagaggctgaggcaggaggattgcttgaatccaggaggtggaggttgcagtgagccaagatcgctccattgcactccagcctgggcaacaagagtgaaactctgactcaaaaaaatgaatacaaagaacattcgcaaaccctcttagaccacaataagtgaaaacaaacaaacaaacaaacaccagaactatcccactaaaaatcaggaataaaataataatgcccactaactccactctgatttaaattaacattgctttggaggtaatggcctctgcactgtgtcaataaaaaagcggttaagagtccctaaaaatggaaaggaagaggtaaaacaatctcttttgccaataacacgttttggtttttatttttgagacagcgtctggctctgttgcccaggctggagtacagtggctcaatctcagctcactgcaacctccacctcccaggttcaaacgagtctcctgcctcaacctcccatgtagctgggattacaggcgtgtgccaccacgcccagctaatttttttgtatttttagaagagacagggttttgccatgttggccaagctggtctcaaattcctggcctcaagtgatctgcctgcttcggcctcccaaagtgcttgcaattacaggtgtgagccactgcgccgggcccagtgacaagtttttatatctgaaaatccctagggatcaagggaaaaatttatacaaataatgtgagcattctgtaaagcagcacgttataaaatgagtaactaccatgaaaaaccaccatgtaatctaggaatgaaaaaactaacaatcttcatatattcaagaaaaacaagataaaatcgaagagaaggcaccatttatgatagcaaaaaaaaatcaaatacataaagttaacaagaaatctacctgcagaaacaccacaatattcctaaaagacacaaaatagaattgaactaatggagagataaaccatgttctttgatgggaagactcagtattataaagatgatgatgttcattaaattaatttttaagtttaataaaatcccaataaaaatgccatcaggctttctctcccggaactagagaaactgattacaaagatcacttggaggaacaacaatcgaaaacacatgggaaagccctaaaaaggaattagatgggcaggggaagccggcaccattagaaatgaaatcattctaaagagcctaattaaaactgtgtggtgctgctattatgaacagaccaatagactaacacaacacaatacaaaatccagaaagaaacacaattgcatagacaaatgcagcatatgataaaggcagcatctccagtcattgggttttttccataaattatgttgagataaacaggacagccatagccacacacacacaaaagtggatcccactgggtccattcttcataccttatctcaggataaattccaaatgaattagagatttaaatgaaaaaaatgaaaccattaaaaaaaagaaaaaaaacctaccagctgggcacagtggctcacatctataatcccagcactttgggaggccgaggcaggtggatcacctgaggtcaggagtttgagatcagcctgaccaatatggtgaaacccccttctctactaaaaatacaaaaattagcccgatgtggtggcatgcacctgtagtcccagctactcgggaggctgcagcaggagaatcgcttgaatccaggaggtggaggttgcactgagtggagactgtgccgccgcactctagcatgggcaacagagtgagactctgtctcaaaaaaacagaaaagaaaaagaagaaaagaaaccaccatgtaatctgggaatgaaaaaaacctttcttatgactcaaaatctagaaacaataaagaaaagatgaataaatccgattgcctaaagaaaacaaactttgcatggtaaaagacaaatgataaataggggaaatatatttgcaacgtatatcattaagggttaatattccctatgtgcagaagaaagttaatgggcctgagactgctgtctcttagaaagtcctgcttggaggaatggcctttaattggtatctaggatcttggagttcaggtgttcccaccattccctaaatgctaaaagtagttcactgctcctagagtggcaaacaacgtggtttatgccaatgccttgctttccttctgggactctggaattctggcatgtgctatgcacagggtgtctgcatgacaagtccccagtgaaaaccttgggccctgagtctctgaggagcttccctggtacggagcattgcacacatgttgtcacagcctgatgctggaggaattaactgcatcctgcacggctgcactgggtgaggactcgggaagcttgccccggtttcctgtaggctccaccccacatcttttcccttggctgtttttgctttgtacattttcaccgtagtcctgattcctcccagcaagtcactggaactgggagtggtctgcggaacccctgaacagaccttaatacatgaagagcttctaaaaatgaagaagcaaaagaccaaaaccccagagaaaagttagagaaatgaagagaccgaaaaaaataaatgcgaagattatcataatcatgaaagtgggttgttaaaatatgaagttcagccttctctcgtgctcacaatctcacccactcttgcccttccttcttccgccatgggatgacacagcacgcagggcctcattagatgctggcaccatgctctaagactctgcagcctccagaactatgagccaaataaacttttttttttctttttttaaggtgtgcacttttaccgaactggtctcaagtcagtgtacaggtatgccctggctgcctccacacttccacccactcccagggagaccaagagccttcttacatctcaaggtaggaacaaaaatggggaccatgatggctgattattcaaaataaaacaaaaagtattaaggtgaagattttttaaaatgctgcattacataatttacatgaaagcaatcctgtaacctcccctttgtggactcaggagagaactgggccgttctcctgagagaagtggggtggcttttgggagggcaagggacttcctgtaacaatgcatctcacaatatgtggaatgactatttaaaaaaaaaaaaaaaaagccaggcgcagtggctcatggctgtaatctcagcactttgggacgccgaggcaggcagatcacctgaggtcaggagttcaagaccggcctgaccaacatggagaaaccccgtctctattaaaaatacaaaattagccgggcatagtggcgcatgcctgtaatcccagctacttgggaggctgaggcaggagaatcacttgaacccgggaggcggaggttgtggtgagccaagatcacgccattctactccagtctgaacaatgaaagcaaaactctgtctccgaaagaaaaaaaaaaagggccagggtaagacccagtctcaaaacaaaaataaaaataagtaagcaaaataaagaacgatgtacaatcaaggtcctcggccacactgtagaactttgggggatgctcacgccaactaactgctgtcaccttcaccattctattcttttctttataaattacccggtgtgtggtattctgttacagcaacacaaaacaaagacattaagatatcatttattctaggttggtaattttacaaattggcaataggctctattggtgagtctgtaagacagaggcatcctcacacattactggtgagaatgcacactaatgagtgtaatttgacactgcctagcaaaattacatatgcattttccctttgacccagaaatcccatttctaaaaatctaagccacagatactcaggcaaaaaatacaaaaagatatccttgctttctttttttcttttcttttttttttttttgagatggagtctcactctgttgccaggctggagtgcagtggcgcgatctcagctcactgcaacctccgcctcctggttcaagcgatcctcctgcctcagcctcctgagtagctgggactactaaaattagcccgccagtgtgcccggctaatttttttgtatttcttttttttttttttttttttagtagagacggggtttcactgtgttagccaggatggtctcgatctcctgacctcatgatccacctcctcggcctcccaaagtgctgggactacaggtgtgagccactgcgcctggccagaatgctcaaaaaatgaagacatatctaaagaatatggaaggccaggtgcagtgcctcatgcctgtaatcccaacaccttgggaggcagaggtgggcagatcacctgaggttaggagttcaagaccagcctggccaacatgacaaaaccccatctctactaaaaatacaaaaaaacagccatgcgtggtggtgtacacctataatcccagctactcaggaggctggggcaggagaatcgcttgaacccgggaggcagaggttgtagtgagctgaagtcacaccactgcacttcagcctgggcaacacagcaagactccgtctcaaaaaataaataaataaaaaataaagaacatgggagtcagcctgaatgagcttcacttggcaaaatctgggacaatttaagcaatagataataacccactgacaacaatgaggacggcataatggattatcattctttgaacagaacgacaactcctacagacaataaacaaatgaggcctatggataagttctcccttaaaataaaatgttaactaataaatggagacagaataatagagttcaaaaatcaccattttgcaaccatcaccataattagtaattcaggcaagaatcaccaatggaccaggcacagtggctcacgcctgtaatcacagcactttgggaggccaaggcgggtggattgcttgagatcaggattcaagaccagcttgggcaacatgatgaaatcccgtctctaccaaaaatacaaaaagttagctgggcatggtggctcatgcctgtaatcccagctacccatgaggctgaagcaggagaattccttgaacctgggagacagaggttgcactgagcagagattgtgccactgcactccagcctaggaaacagaacaagattctgtcaaaaaaaaaaaaaaaaaaaaaaaagagtcaccaatggatacttaaactaatgggtgaaagttgaagaatagagtacttacgtaaaatatttccccacaaatgactttttttttttttttttttttgagacggagtctcgctctgtcaccaggctggagtgcagtggcccgatctcggctcactgcaacctccgcctctcgggttcaagcgattctcctgagcagcctccaaagcagctgggactacaggcacgcaccaccacacccagctaatttttgtatttttagtagagacggggtttcaccatgttggccaggttggtctcgaactcctgccctcaggtgatccgcccgcctcagcctcccaaagtgctgggattacaggcatgagccaccgcgcccagccaaatgacttattaattacaaagaaaaatagtaactgaacagtgaagaaacctcgtggacatcaccctctccaaatgatccaagtgaacttcatcaagagtgaggcgcgtccctatcttaagtctttcgatgggatgcactaagaaggatcaacaggacttctgtggtagtcctgacaaatatgcatatcctgtatctatcacagagaaacactaggtaacaactggctgtcaaaaatgccaacatcttgaaagacaaaaaaaggttaagaaattattccagattaaattagacttaaaagacatgacatccaccagatgcaatgtatgccgctgatggggaggtctttcatgggtgacattccataaaagacatgaatccgtactgtatgtaggatactactgtatgtatgttaaattttctgattttgatgattggaatgtgattctagaagggaaaatgtgtcctcagaaagtacgcattcaagtattttgatataaaaggatatgatctctgcaacttactctcaaacagtgcaggaaagtaataataatatgtatggacatacagagagtgacaaagcaaatgttaacagttggtaaaactggaagaagagtatacagtagttttttgttctcttccagctttcagtagcagttcagtagctttcagtagctgttctcttccagcttaacttctatttgcctacccaccctctcctcaatgcagcacataccacgcctggtccctctgagccaccatatggtttccatttgttaatcatctgacaggtcagcagcctgagaccaagataaaatgtggcaacagggaaagatgaatggtctgttcgctggtgttttcttgaagattgttttcatattgtagacagttgtgggggtgcatggaaagatttcccccaccaaactcagcacatgagccccacacatacttaaaatttttgtattgttttgttttgttttttgagacagtcacccaggctggagtgcagtggtgtgatctcggttcactgcaacctctgcctttttatttttttaagatggaatctcactctgtcgctcaggctagagtgtagtgatgcaatctcagctcactgcaacctccgcctcctgggttcaaacaattcttctgcctcagcctcccaagtagctgggattacaggcacccgccaccatgcctggctaatttttgtatttttagtagagacagggtttcgccatgttggccaggctggtcttgaactcctgacctcaggtgatccacctgcctcagactcccaaattgctgggattataggcatgagccactgagcccggccatatgaaaacttttctaaacgtacatactgtgctcccacactggggttttggcttctgtaggtcagggagggtgccctgggtctgtacaatattttcaaaagttcttcgggggaggattgtttctgtattccacgcctcagtttactagcactccctgccaggtgcccgtctttgtcggtttcatcctcccctcttatgatgcacagtgctcccgcaatgctcccttgcaactcctgagctcttatccactctctcatcctctgagaaggatggctcacaggtgagatgcaggggtgggccctccaagatgacccttcacagccctccctccccaagaatgtcacagctccagaagcaggtttgcacccacagtgacacgccatggctttgcatttcccccagcactaaggagctgcttcatggagcacctctgattgacaaatctaaaatagagaatgaaagaaagtgtcaacctggaggagtttaataacgctgtaattaaaagaaggaagaaggggccacatcccagtgaggaagcagctcctttaaactattgaagaatatattgttctgggggtgccaacagcagaagaaattttaataacaaaaataaattgacaaaaaaaaaggcaggagaggtattagttggaacaaaaccaagtatcttaaaactgctcattttaaactgagtgttttatggtaggataaggaagctccaatattttcaaacacaatttatgtttagaagttcgagtctcctctttcattctgaggaataaaatacccagtttcctttaaaagtacaaaatggctaattagaatgattataaatctaacagttatatccacataaaaacttgagcataacagttcatagcagcctcattcataccagctgaatagtgaaaaccagccaggaagtgtccagcaactgatggatggatgaacagtgtgacaggtgcatacagtggaatattattggccataaaaaggaatggagtttagatatattctataacacggatgaatcttgaaaacagtaccctccatgaaagaagccattcacaaaagtccaaatgactccatttatatgacacggccagagtaggcaaatccacagagacagaaagcagagtagaggctgctgaaggctgggggaaggatgaatgggaagtgactgctaatggatacgggatttctattttggatgatgaaaatattctaaaattagactggggtgatggttccacaattctctgaaaatactaaaaaccatctaatcataccctttaaaagggtagattttatggtatgtaaattatacgtcaaggaagcagtaaaacaaacgtcatggtcaagatgaaggaccacatcaagtcaaacacaacgacaatgttttaaacaggatggtggagataatcgcacagtcatttgctggctcttttggcactgtttgaaaaatcatggaaatgagacagaatgttcaatgtcttaattcctggaggaaggagggagggagcgggggagagagagaaagagaaggaggggagtggaggggaggggagggaaggggacagcagggcgagacagggcagggcagggcagggaagactcttagaccatagtcagaacaacccaggcacctattctgagaaggaaaatacacgatggcccaagacctgaacctgagcagaggccagaccttgggtgcctggaagaggtttggcggggccaggcagaacaccacacttacgggtggtagccaaaccaggcatcgagtggaggaaagggatgaggatctttggggtgtttccacttggaagtccaggtggaaggctcagtagagagcgggcctgagctgaagctgagtgagactcttgtctctgaggacagctggcaggaagaaggcgtgccctgtagtgagaggggccaagcacagggagccatcctcactcacacacctgcacagtagtggcccaggtacttcccacccctatagctccacccagccccagagatcctggaaccttctccagaggctaattaactttccaaacctgctcttataggataaatcacctccaaatccatctccccaccatccccataggaaaaataatttgctgtataaggaagcatcattgcactagcaaatctggcgatcttattgatacatctgcctcagtaatcaggacactgatgatttacatttgaactacagtgcgtatacatcttgcaaattagttttgaaaaaatttgagggctaaaaatatttttcagaacagatatgtctctctaacacataattgtggactatctggttaagccagcgaatgaaattgaagatactaaagataattaaaggatgatttttaaataaaaaagaaacaaaaaacaattacaacaaaaagccatgagcaagtaaaataattgaagtacaaaccccaaacatgagcaacacacagattctaggtgtccagctcgactcaacactagcaacacacagagtctgggtgttgagttctactcaacactagcaacgcataaattctggatgtcaagttccattcaacactagcaagttccactcaacgctagtcagactccaggtgtagagttccactcaacactagcaacgcataaattctgggtgtcaagttccatacaacactagcaagttccattcaacactagtcagactccaggtgtagagttccactcaacactagcaatgatcagattccaggtgtcaagttcgactcaatgctagcaatgcagattccaagtgtagagttccactcgaccctagcaatgcacagattccggtgttaagttccactcaatgccagcaacgcataaattctgggtgtcaagttccttacagcactagcaatgcatgcattctgggtgtcaagttccacacaacactagcaagttccactcaatgctagtcagactccaggtgtagagttccactcaacaccagcaatgatcagattccaggtgtcaagtttgactcaatgctagcaatgcagattccaggtgtcaagttccactcgaccctagcaatgcacagattccaggtgttaaattccactcaatgttagcaatgcagatcccaggtgttgagctccactcaacactagcaacacacagattccaggtgtcgagtttgactccgtacctgctgggtgaagcaaaagctccagagtgtgccaggctcttggtgcaagctggattccagggaatacagaatggatcctgggaaaactgtaactgcagtctaattttatatattcaagaggttattcacatttaataactccttttgtaacccttaagtgtatagaaaaatgaatgtctatggaattgtgggttattcacttcataagaaccaaagagttgaacttcatctttggattagtttggttcccattcccaagacactcctggtccacaagcagactggggagcttatatggtgaatctcagttctagaccaaggcctccctccactcagatgaggccctggccacaggctggtcagtgcgggttcccgggccaacaccaggcctcccacctcccatgctagccctctgccccacaccacgctgcctctgagtttcgagatgaacccaagtgcattttcctactttattctacccttttggaagaggtgaaaaacaaaatatagatatttataattaaataaaaccttctttagaatacatttttaaccagagtatgtttgctaaaataattgtttagagatacaccatacttttaattttcagattattttgtcacttgagtatttcaactcaactgagacttaaatggttcaacttggttttctcttccttcttctcatggagaaaccaatattttcttattctaagccttatcttattctatggcttttcaggtgactaagaaaacagactacttccctttcagatgacttctctgagaagatctatgatcaactcaagcgctggtctttgacctggaaaattaaatatgatgtcccactcttaggaaaaaaaggtaaatctgaagcctaaagatttggcttctgtttctgtcctggtagcaaaataagacttgaagcttctgagcctccatcttctgaaatgtcacacagcagaagagggctgttctctttgcaaactcacagaggtgtgctttctgcatgtgctatgaaaaggtgaacttgctctacacaggtgtttttttgttttgttttgtttttgagatggagtttcactcttgtcacccaggctggggtgcgatggtatgatctcggctcactgcaacctctgcctcctgggttcaagcgattctcccgcctcagcctcccaagtagctgggattacaggcatgagccaccatgcccagctaatttttgtatttttagtagagacagggtttcaccatgttggccaggctggtctcaaactcctgacctcacgtgatccacctgcctcagcctcccaaagtgctgggattacaaaggtaatgtgttcttatcagcagcaatcatgttaccctaaacataacaccaaaagcaaacaaataaaaccaacaaggatacagctttatctgctgttgtttttatgacctctacatttttggatatatctattatataaaaccttttctatttgagaaaagagaaaggtgtggtgcagtgctggacagctgcacttgtgggagcctcctgactgcccctgagtagacctgccactgctggttgtaaaggaactggaatttttaatttgggaattgtaggcacttagttatgcacagtcacccccaaaagtatggaaacttcttgctgtcagcggttttgcatgtttctggcattccctccccgcacctgcctggctgattattaagtcctcttctgactgtattaggatagtcatttcatcgccaaggtgacagaacgaggtaggtttaggattaactaactctctgctaagctagttttcaagtcccccatctctgtcttctggaagtgagtcgaatgtacatattagaaacaccaaagcttcaatctaagctaaacatttgggtataccgggtttggctactggcttctataacttttcccacccactcctcaccatgcatgaatgagggccaagcaagtgatgaagggagcttctaagcgccacatcctctcacggccatgtgtcctccagataacccaagtgtcccatgagttgaactttccatgatagttgtatacaatgtagaccacacaagcacttcctgcccatcctgctcattttagcatagtttgttaggggaaaataatttactctacatgatgactttagaaagcctgcattggggaagcacttctggaaacaggtgacttttcagcacaataaaacactgtactgaatggcctgcagtggcctacaagcagttagtgtttatccttgaggactgtggctccatttatacatgatacttgactattgattcaggatggaggaactcaaagaacacccagaaacacctggaggtcctgggttcaagtcctatttttgctacttagtgttctggattgggtagccaattaaccgctctatgtctgatgtattttattttatttttatttttatttttgagacaggatcttgctctgttggccaggctggagtgcagtggtatgatcagggctcactgccgccttgaccctgctgggatcaagggatcctccacctcagcctcccaagtagagggatactaaaggcatgtgccaccatacccagctaactttctgatttttggtagagacgagatctccctatgttgcccaggctgggctggaactcctgggctgaagaaatcctcctgccttggccttccaaagtgctgggattacaggtgtgagacactgcgactggccatctgatttttttaatctgcaatatagacatattaccaactaatagtgctgtcgggaagatcagtgtgaataacctgtagagaaggaccctgtatttgtagcgctttgtgctacaaattctttatgccacatgggctttttaggcagtgccgtgcctgatggctccctgacatctttgtgcacaagttcatgtctgggaggcagactggatgatgttagaggcggaggctttatttttgttgagaggagagagtaattctttgtgtctcataaatattaccttttgatttaagtcatctgatccatttgatctgaataaaagcagacaagatgaaagacttccatttaaacattctggattcttctggatttaatacgtatttatttcctctttactgctgaaaatccaccaaaataacactaaatgaataaacaggtaaaaatccacaggaagaggagtgagaagagagaacagcagatcagacctaacatttcaacacctgtaatcaaagacagaccgtgggtgggagaacactggctggtttggtggaactgaagaaacaggaaccgaagtacctggcgaggatgaacgccaaggagaggccaagagaggtgtcaggaaccacggagcaggagctcggggatgggagggtccgggtgcggggaagggcagaaaccaggtgagcaagtgaatatgcaggaaggttgaaagtctgaataaggcgcattctgatcccttccctcagcccaggcacctgggcaaaaaccctcctccagtaacacacgagatgggaggttgactctctggaggaactgaacctaaggtattcaggtctcagagactccagtcccagcggggaatgggaggaggctctgagttgaagatgggacagtgtgcaagtgcttgcatggaagagtgagacacccttcccagcctcctcctcccgacccgtgttctagagcagcagcagcccagctatcttccctgggcaagaggttgagggattccgccctgggaaaatgagggggctccagagaaaagtccatcaaataggagagtcctcagtttaaaagctgactcgctgcttaatcacagtaacacctgctagtggacaagctctactctcagcccccaaaattctattcagcttttattattctactgagacagacagataccaccagacctttgaggaatgttgtttcataaagacagagactaaatgaataaacgtttaaaattacaaaatagagaaaatgcagagagaaaaagaattcaaaaagaacaaaatctgtttcttaggaatagcctcaaaatatagtaatgttttgcattcagaaatttaggagattttttttaaaaaaggaagaaacaggacaagagaccttagcaattaaatgaatggtagccaaatttacagccaatagacaggctgaaaaataaaggtgaggaaaccccccagaatgcagaattaaaataaatggaaaaaagaaattttaaaaattagaatatccatccagattattcaattccatgaactctgagaaaagaaaatgggggttgggtagttattgagatagaagaacccctccaagatctgaaagctctaggtctctaaattaatagtctttgtatacaaaaagagaacgtaatattgtacctcttgttcagcaacaatgcaatcatctcatattggtttaaccaaaattgaaacataattatatgggagtatgggggaaggtgaaattgggtgaaaagtaatacggaagagttaatcttcatctattacagtaggaaagcaatgcataatatctaaataaataagtataaatatatatgtatatataaatatatgtatatatataaaaatatattatatacatatatatgtatataatatattttttgagatagagttgtgttcttgttgcccaggctggagtgcaatggcgcgatctcagctcaccgcaacctccgcctcccgggttcaagccattctcctgcctcagactcctgagtagttgggattacaggcatgtgccaccacgcccagctaattttgcatttttagtagagacggaatttctccatgttggtcaggctggtctcgaactcccgacctcaggtgattcacctgcctcggcctcccaaagtgctgggattacaggcatgagccaccgcacccggcccaaataagtacaaatatttaagcatgttatggagaaatattaaagtagttgttggtaagaaatagcaaaaatcattgaacatattagcaattggggagcaaggccagagttcaggaggagagaggcaggggactactgtttttgtcaatatgagccaataaaagtcagtgttacccacgttgtgcatacattactttgaaaaagacaatgaaaagcaaacacgaagcacaagacaactagagaatgacttcccgttctcagggagttcttcctctgaagtctctgccaggctaagagacagaagctgggaagggacctgtgctgggctcctggctttccatactttcgagtttcctcagcaaagttggagaggcagactgtgcagcagatacctcactgggttatcactatctgattccttcttttctcttggctctgaaattttagataaggatgtgtcacatatgtgagatacaaaaacctgtgtgcccttcagtatcgtgactccgcaatacagcaagtagaaatgttcagaataaccaaaatgtgaacaccttaagcaaatcttccatttgaaagaacctcacacatcaggatttaattatcccagtgagggtatatcttttaaattaaattgctctcccaaaattataaagctaacctgttcttccccaccagggaaacaatgtaatgctgtacaaaaaatagcaccaatacacacctccccacccaccaatggggcacatgtttgcttaaactgcttttcccataggaacaaatttattatattactctggtctcctttggctaaattttaatatagacacaattcttcaacattcatgggttatctatctacctacctacctacctatctatacctccattaaattcaaggtctaaatctgatcaggaagctaaactatacctggtttggtcaacttgttaagaggtattgatcaggaaagacattttattaaacaaggaagcaattaagcaattatatgtgtttgtctgtgaattttgtatgatgcatttgaaatttactttctatgaagattatgtagcctgctgcctgaatttttcttctgatcacatcttaccaaagagggccagctatatccaataaagatcaactccacttacttaatggtccctctagtctcaaccactagtattgatcattcctgagactgctggcaacagtctaaaagagatttgtattttgggagagggtatattaatgtttccctggtcagggctgcccctatagtactctgggcctggccaaatacttttttcaaaactcctgtttaaaaagcaatttgagtcatccaaaatgaacaggccagcactgttctgggacccagtctcacagcatcctgccaaagaaataccatgccggcctgcaaaagagatgagctcacctccccactctcctaggattggtgcctatctggccacagggcctcgggatgaccctgtaggtgcaagtcccagagctcctcagggcatctggttgactcatgcatggggcgggtgggtagagggttggagaacatccaagaggggaagacaagctgggctcaggggtcctgctcagatggctctgtgagccaggccacacacaggcattggagcttagaactctgaaggaaggcactgccaggcctggggccccttaagtctaaggatgacaccatccttggttttctaagacaaccattgggagtacacaataaacatactaccttgacaatatttaagtgaacatttaaagccacgaccttctgtcccctgggctcagaggctgagagctgaggttgactggacatacagattatacacaacccagcaacagtggggcaagggccagccgtctgagagaagggatgtcttcagggatcagacacattctgaaacttataggttcctggcatataaatggaagtttacactcactgcaatcatgattacgttttcagaagaaaatgctgaccagtttctacgtaggaactgttctcctggcacaaggttactagaccatcagaccaatttctcagcagttctgtaactcaagtgcttatggcttctatctctggacacacagctactcactcccagaactggagtgtagtattggaaggctaacagtttagagtggtaggtattacctctgtggcctggaccctaatttaacagatgcagcctctgacctgcctgtctctgcagggagggatgcttgtttaaccccttagctcctgactatttctctgaagaactcagccacataaccgagttcagggaaaggcacctgcaggctctacctagcaacctcctgatcctgtccctccccatgtctatcatatgcaggtggggacaaggttctaaacccttacccaatgcccaggacatgctttggatccccactgggatgggaaacacaggcacctaggggaagggctaatgagatgggaggacacccaagaccttccctgctccatggtgtctctcaagaggaaccttctaatgagaatggtattgcgaccctaggaacttggacgaagccctgcctatggaaaaccaatcaggcaaggatcgagggattgtaaatacccaaggacactgtgcccacagcccagggctgcccagcccacctcctgagcattttggttcagctgttggcagttcagagagagcagctgtgcagcctaaattgtccccaaaatggcatctgtctctctgccctggctctgcagagggcctgagccacacaggctctcaccattcgtgagctcgaatactccttcaaaggagatcctgagctttggtgtgtgtgcaggtgtgtgtgcgtgcatgtgtgtgtgtgtacatacatgtatgcagtatgagtaaagttcttttaaaaagaaatctcatacattctatggccatttcttaggagatatttgaaagtggggaaatcacataaatcacatcaccttagacttcagtcaatctagctctaaaatgggcttcaactagaagaattcttgggttccatctatggttttgttctgtaaacttcaaaaacaatgtggtaatactgtgaacaggcttcaggggttcaaatgggagtaaattggtgggctgttttttctgtttcttggattgcatcagtaatattttactgaaagcatcagtttgctttgtagaagatctgatgtgggaaaggtgggaaggagtggatgggtttcatcaagatcccaggcagctgaattatcattattattgtccagagatcccttaagctcgaacatcacacaaacacacacaaaaggttagcacccatcagtaacatgcagaattgaatacattctacaaagctttacagtcagaggaatggccctggttctcagttcaaaatgatttcagtgaaaatatcccagcgaagtatggaatatttccacaatataaggaatagttcccctagaccttttcttcttggtcatagttaccacccttctcttggatcaccaacaaatatagcaatggcagccgccaactctggacttttcctgctgcctgaagtcagctaataggtcatttccctgtcacctcctggctgatgggaattgaaggaacaattatgtttcacatgcttgggctgatcgacgaacaaatcatcagctgctaattgaactatggctaaaactctaaatgctctaaccaaagatactgttggtgtcattgggtttgagagtttgccacccacggctggagcccctgcttctgagctccacttcaggctacacaatggcgggagtcagcaaactatggccccggggcctgctgttttgtaaataaagttttattggtacacagtcacacccgttcatctatgtgttgactattgcttcaggtaaaaggagagttgagtagttgatacaaaaactgtaggtcctggaaagcctaaaatatttactatttgacccttgatgtagaattttgctgacccctgctctggggatggctgctgagcacttactgtggtcagaaaatgaccagcagagggtggacctgcaggtgtattggctgtcagctgtggccatttcagaagcacccatctttatcaatggatgtgaaatggctgatttaacaagtgccttttatctaaaagtaataaggccaggctcagtgactcactactgtaatcccagcatattgggaggccgaggcgggcagatcgcctgagatcaggagtttgagaccagcctgaccaacatggtgaaacccggtctctactaaaaatacaaaaaattagctgggcatggtggtgcatacctgtaatccctgctacttaggaggcttgaacctaggaagcagaggttgcagtgagccgagatcccgccattgcactccagcctgggcaagcaaaactccatcttaaaataaaataaagtaaaagtaacaactctcctcttgtataagcggcagggagttgagatcacttactttgttttctataatcccagagtaaaagttcacttgatccagaaggcagactcgttcaaagactaacatcagggccacaaaagctgcaattgcggccatcacattaatttttaggcaggccacttcatcaggttttatgctttttatgtacactgaaaacttagcttggcttgtccagccatgggactgtcaggtaaagaatgcttgtaattatgtacgtaacagggagtttatctgttgggtggacatttgggcaggtacttgcagtcttccaactctggcaagtcaagggcttgtttctgattggaaagccgattcagccagtgtgtgctgcttactggatttcttgtgtgttcaggaaaatgctgtagctacagagtcccccatcctctagctgtggatcaggtcccatgctcctgggtttctggtcctggattacctgagctatgtgatcacaaatgaatcccttattcttatagatgagggaactgaagttaagaggttttgccggaactaagtgaaccctaaggttacctcctgataatgttctaatcccagaatggattggcctgaaatatcagccaatgacataaatttgctaaactcctaagaaatattttccatacaagaggcatctcagtctagcattgcagcgggcataaaactcaacacaagaataccaaggttatggactgaggcctgctctgtaggtgctcacagtcttgggaagagtcaggctgggagacagagggtccagagagcacctgttctctccatcctgatggtaacatgcaatgtgaagatacaccagttagattagctgctggtcgcaccccatccctgtacccctggttcatgtgctggacaggcagcagctgcctcctgtgaaaaaattatgtctcctccttcacctgctctcttccatgtggcaagcctaccccactgctttctctgtcactgtcctgtagccagcacctccagcaacccctttatctcacttacacctaagaaaagtctctccaaactactgtaatgtgacatctaggatgcaccaaggcataaaagagtccaacagtgtggtttctgtggagaaccccaggctaaggtcaaagaacagggtatagagaggtgaaagatgaaggcaggaaagaaaggccgtgccaggccatgcaatgtgtcgtgtgccaaactcaaatgtgtggggttgatctcgtgggcaggtgatgctcaaaggtgatggaaaagcctctttaaaagcatgcctgcctcctcagccccagggaaatgttgttgttgccttaggtcaggttccccagaagcagaggctgaggcggggctgtggggattattggggagcatgatgttaataggaggagggagggaagcggcctggggcaggggagacaggaggcactgatgtggtcccaactggagaccagctgcagtcgaatgccatctggaagtgaaagcatgcaatgcacttcacagctggtccctgagggagggcaaggggatggctatgtgtgtacctgcctccatcagtgacaacctcccagcaagggaggtctgggtgagcaccaagagccgtcactgctactgtctgcttcccgtcgaacacaactggaagcattgatggcggggcattgcctgtgtgaaccgtgtcgagaccaaaatgctttctaagaagtgacagtattgccagtcacaggcttacaagcgcaggaatgcagtgacaaaatcagatcagtgctgaggaggctctggggacagggtgaagggcagtccaggaacagaaagcccgcagctcagagaccagccaggggctgctgagaaggtctagggaggaggtgacctggatggatgggggaggcctggggcaagcatcctggggcgggcagaagcaatcaggtgccccaggtctaatgccggcaggtgggacacatgttggcagcttccatggaagaagcctctactgaaaaccacatcgggttctggggaagcactggggaggccatcgtctgagctttagggacaaccttgctatgcacggacagtggtagtcagtccgctgtaggaatctaggggttagatgacagtctacagatctggacccattgcagacaagatcacggagtcccggcaggaagcagctatctgggaacaggtgtggaggagggagacaggcgaccttgccagcctctctcctggcctttaagaggagaatggggaggaagagcctccagagaggcccaagcgagtgaatcatgggggggaaagcactttggtggattctcccaacttgaatcaccaggttcctgacactttgctcagagtccgcgtctgcatgaataaatgtagatatgaaaggggatgacatggaggacctggcctgggccagcgctccaggaatcaggactgtgcagccgctctcaggcctgggaatggagagaacccagacatcgcaggtgcttactggaagccatcctaggtgaaattctctcttctccctcgtgctgagaccataagatgcccattctttggagacttggcaaatatgagctcagactgaccctccagtccttctgcagatgtgccctcgggcctttctttcctagggctgacttggcaatctcacacagcaaacaattccccttttgctctgtttttcagtatatcctcccagaaaaagccacgtctccacggagccctggtatttggtcccagaggtcagcaggttggcaggcgagtccccctgttctcccaggattggtttcccccatccttggctgtttccagggcttcctctgtaagtcaaggtgggtgcccaagtgctgagggcaagtggggggccttgccaaatgagagagggagctctcaaaagttctgtttatttcctgtttatggactaaatttttaagttccaaattgaaggtgaaatgtccaaatggcacattctttttttcttagaacagcaaaacaaaagcaaacctctaaacctccccgtgaaggtgacatcataataaggcatcagaatcccactgtgatcccttctctggacagtttgctgtagtttcaagcgatgctggggaaagaaaccgcattggttctgcttgctaatcattacaacaccacgaatcaaatcatattgtaacaatgagaaaaaaagagccgccttcccccaatgagcttgtgtgggaagcagtgtatctgcctgctggaactttcccggtggtctgagctgcccatgccgggggcggtggagggtaccactggagcggggggtaccacggtggggagtgtccacaatcccggcttccccatgtcctacacatcactgagtcagtggcagccactgctccgtcttctcttcatcccagaacttcccctataacatttgggattcctatcctagcagttaaattgttgttttccagttctctataatcttttctgtttcttcttcatccatccatttccttccaaatgccagaagcatgatcaagtcttaaatatgacttttttataatcctgctatgcacagggcctaaaatgctctcggtggggagccccccaagaagagcagttcagaatccccagagctatttaagttttgcaatcatgttggtaaacaggtgggccctccccaacagcacacttctgaggtgccattcatcatcccactcacatcctcctatgctgggggaccagctccagatgttgcaccagatggagcttcggagggaaggaatctcactgcaattccccatccagcagccagaaggcagggcagggcttgaaacaacaggcccagagccaagcatcctggagggcttcgctaggtgcttgggcagcctctggggcgtggggctggggcagcgtgtgcaggatgagtggggtgggtaggttttgagatggagctgacagctggagcctgtgttccttcactgtaaaggcactgcaattgttctgctgatgcggtgcagctatcctgggggttcacggactgcaggggaatggccattggagggatgaagctccctttggacagagctgtgaggtttctgcccagtataggtctgctggagatactgcaccatactcatcgtgctctgcctcctgctttctagctaaatccccatctgctacaggcatctatttcctcgtgtcaatgttatacacacgtaagcacacagagcagccaggatgatggtgcaaacccacatcacttgtatcatcctgatttccttatattgacccacatggtggctgcactgtcccccagaagcagcccctgcttcagtcacagggcattctcagcaggcgtgagaacagctaatacatgcttgcaataagagcgatggggatgaggcattttggaagcattttaaattcctagcctaaaaatagcacgtgtcttttaatgacatttgaaatttcaaataaattaaatatcactgcttcagaaaattaaagccttctagtagtgagcaggctgtgagcatcacaggtgacagacgtggccatgccaggagagtgcccactgcagcatgggcacagggcaagctctgggggtctctggatccctgaattctccttgtgacctctgtgcctgctcacctcatcgctccactttccagaagaggcaggtgggacttgggacaaatcctgtgcacacggtcacacgtcagaaagcagcagagcctgcgcggaacacctcccggttccctcagggcaggctctgccttcctgccccaccctctccatcccagccctccagtccaggcccgctggctggaacgttggccagcaaacatgtgcagagagtctgaggctgaccccatggtccctcaccgtccccgggcagttgctggtgtcaggtgtgagtcagacgggggacctcccattactccccaggccttgctcagtggatttgaaggaggtgactcccttcagactttgcgggccacagcctcaggcaagccatggctcactaaaatttcatgagtagccataggacctcagctaccaggacaccttcacggtccgctctggctcctaaaattcatggagtgctggtctcggacgtgatccacctgggacaagtgtgatcgggagtgggaggtaaagggaataactgtgaggtttgggttcatttaggaaagataagcttgggctatcgaaagcactgcttttgtttccttcatttaaacatcaaaactatttcatgtgctgtaaaaaaaatcaaatacagaaattaataggccaggtgctgcagctcacacttgtaatcccagcactttgggaggctgaggcaggcggatcacctgaaatcaggagttcaagaccagcctggccaacatggtgaaaccctttctctattaaatatatatatatataggtatgtgtttgtgtgtgtatatacatatatacacacacacacacacacacacaaattagctgggtatagtggtggatgcctgtaatcccagctactcaggaggctgaggcaggagaatcacttgtacctgggagacggaggttgcagtgagctgagattgcaccattgcactccagtttgagcgagagtaagactccgacagaaaagaaaggaaggaaggagggaaggaaggaaggaaggaaggaaggaaggaaggaaatgaataaagtgaaagtaaaacctcccccacccaacctacaggaaagtggttaacaatgaacagtttgatagattccattgagacttttgcctttagtcttatgttcacgcatgtattcatccacaggaagacaaagaaaagatggacgagagaatgagaactgggcaggaaggaagtgagctagtgaaggtcacagagagaggagtgagaaccatggagacccttctgacctctcacttttgcctgggaccccaggaccaatcctgtgttattttggatgcttcctgcaaagaaaagccaagatttcatgaggatggaagcagagtacaatgttctggcctttagtggattccctgttttttcagacaggagaaatgacaaacaaaggcaaggaaatgaaatgatcgcacaatctgtgcaggagggttttcttttttcctacttgaatcaccccagctaggtggagacaagagaaatctgcccaagcacaatcagacagatatggcccctgcaaagcagacccagtcgcactgggcaatgaagcgagtgcactccctggacagggaggaagtgcacccacgggagcagggaggaagtgcacccaggggagcagggccctgcctggcagccgcgtggcttgctccctccaccccactccccactccctgtattttatagtgtgttaggtcgttgccctttaaactgtctttctccgacacaagtgccttctgtcccttgtctaccaagcatatttatatgaataatgcaggccaaatatagaggtgacataacattcttaaacgtggtcatttgctgatggcaacatgagtctgagccagacaattgccctccagtgtatttcacaagcctgcagggagcacctgctggagaaggggcagttggccagctgctgcgagacggggggagggagggaaagaatcagcgagggttggttgccagactcactgtcccaggaggacacacatatgtaagaatctccagctaaagcaatctttaaaacattttgttaggtatcagggtacacaggaagtgctgtgggatctattttggttccaggaaatgggggatggcttcacgaaaaaccaaaggacatggtgtttcagttggcccctgaaccacacgtcctcctgatacatcatagaggcaatcccacagagacacaaagtcaggagaacatgtggcagttttggagagggtgcttgtagaagaagtggagagacaggtagcagaaggctgggaggagggatggggtgggcccctggaaaggtgaaggccccagatcggaggcagaggcttctcagagcgtgactttcagaagtttgctgctgggtgatacctggtcgtcactttgtggctgtagatactgggtcctcaatattcacatgtaagacagacaccacattccttacgtccctcttatcacctagcctagctccaaatacctacacacttgacttctctgaaagaaaaaatgttcaaggaggattctgtaacctgttgtttccctaatattttgcttctgtatggatgttccaacagatttcacccggtggcatttccactcatctgtatgggagagccctctgtatatgcgggactccccttcctcttccttcaattctgtattttcaatatgcattgggtggacccttgcagttcaggcccatattgttcgaggcgcaactgtgtttcatgaggagcagggtgggaacttgcgaagatcagctgcaccgttagccaaaccgctgtctgcgatgccccagctgcagagccaggccccctactccacctccgtagctggcaccctccttgctccgcagggatgtaaacactgacacattcactctccatttcaatgtgacaaaatcctataaacctaccagtgtaagacaatgcaaatgcattatcttccagttccagtgggtcagaagtccaggctcagcttaatcggactcacagctcagggacccaagagtttggctgggctatatttctttcttgggcttagagtcctcctccaagctcagtggctgttagaactcagggccctgtggtggtaggactcgggtctttctttccttttagctctcagctagaggcacctgcagttctttacatgtggcccccaggcagttcatgacaaggaggtctgctttcctagaggccatccaaagtctctctagccgcctcctctgtgactagctgtaggggtctttctaaaagcaaggctcatgtgtttaaataggcccacccagattatctccccatttgaatggcaactgatccaggaccttaattataaccaaatcccattgcagcagcactgaaatcagtgcttgagtaaacaactggcagatggtgtgtaggcgccagggccaagtgagcattttgggaggcatcttagaattgtgcccagcagaactggtgactgcatcagcctaagtggattagtctgcttggctgccataactgggagtcttaacagaaatttaacttctcacagttctggggcctggaaatccaaggtcaaggtgctggaggggttgttttctggtgagggctctcttcccggtttgcagacagccttctcctcaccatgtcttcacagggcagagagagcaagctccgctgtctcttcctcttcttataaggatgtcagttttgttggattagggccccatccttatgacatcatttaaccctaaaaaaaacgccttatcttcaaatacagtcagactggaggtgagggctaaaacaaggattttgagaaggacacaattcacttcataaaggtatgatgctcaactttgccattcttctaaatctttctattctgaacattgaatgactctccccccatttcattgactcttactgtaaatggcattgtcatagttttaggaaagatggtttctaagccactgctctattttagcttgaatatgcagatgaataactgaatttacagagatcccaaattgttcaggtctaaaattataattgaaaagattggtaaatttggctaaataaaacggaaagatttttatatgccacaaaataccataaatcaaattaaagctcagagtatgggggggatgagattacaacacacagaaaagaaagagatgtagataagtaaatgaataaatgaataaatgagtgaattaatgaataagttattaacttgcaaagcattaggagaaatcataccaaataccagggctaaatgaacataaagaggcaagagaaaaaggtcaataaacatgaaaaaaattcaaccttactaagtaatcaaaaaatgcaaattagtagagtctaccatctattaggttggcaacaattaaaaagaatgataaagccttgtgttgagaatgtctgattagaacagattccctcatatactgctggtgagaatataaactgatataaattttctaaaagataattctccaacacacctcatatgtattaaaaatatatacttctgacctattaatttaatttgtgaaaaatcttatcctaaggaaattatttaatgaatgtacaaagatatatgtacgaaaaacggcacaaaggtatatgtgctattgcatataattggagactatctagtagctaaatctgtgaagctatagcccaagaaatgaatgccaagcagccattaagacaagataaatgtgtagttagagacataaaacatgctcatcatttatttctatgcaaagcagcaggttacagaataaagtcacaccattttgtaaagaaaagtatttgtatgcataaatgtagttaaataaacatagagctaagttggactacagatgcctaggaaatcccagaaagaattttgccaacttgttaacagtgattctgtttgggtgattagagtataggtcacttttgtatttcccttttgtttgtttacctgtaatttacatgataacctgaatttcatattttcttcattaaacatccattgctcattttaaaatgatatgctgaactgtttagaaacttatctgaaagttaaggttacatcccccagttatattcactcaaagactttcaaatctactgcagatgataattcatgatttgtttactgcaattcacctccttcaaagaccaagcagtccccatgttagaactttcaggattgggaacggtcagaaaagacttatctggcaatccgcaaaacactccgtcttcgttgcctttttattctgaatatggcagactcttttcctctctctcctttcaggactcataatacaacctctacacacaggaagcagcccttgaataacctgtaatcctaaaaacctactgatattagactaggagtgatctctaaatcctaggcaacttctcctcagatttctaacatcctttggtatcttactagtatttagcataggaaactaacaaggaatacatggcagggagtcatctgatgttggaacaatccgctttggcatatggaagactgtgaaggtgtgtccaattctgaacttcatttatggctgacaattgagtagatgctctgatgctaccatgccgagagcagatcctttttagagacaactctgtttttccccatacgctgaagtttttatgtaatttttgttttcccatcttgttccttttttttggtaaaagtgagtagaaaaatgcaaaaatgaaagtagtgattacaatgataaggtcatattaatttaattttcatggttttattaataatgtgaataggcagagctaaaagaagaatcacaatgaaagtccatgtgacattaatcaactgtataatcatttgagtagaaaaagaacagaactaagtaacatgtataaacattgaaaatatattgatgaaaactgtatcttaaagataggatgcaatgaataaatggtttgatactttgtagctttcagaatcccctgcccccaacctaacaaaaaagttgtatattgccttcacattccacttctgcacatatttggggggacatattataaacagtaaacatggaactgtgtttatttatatttgtgttcactgtatatctgcccattgatttatatattcagtttggaaacccaaatctcaaaccaaatacattatccaatgccaactatattccagtttcttattcaatatttggcacgttgtgttaatttcacttaaattcaaatatttgcccacttatattctcgcatttaaattaaaatctctatcacttatttaagccacttaactgagtatgtgtggaatgaattaaggataaggtcattatcaatgtatctcgtggtcctctttgtacttttcctgggagtacgatatctttcaattctaagccactaatagaaagtgtattctgaataggggatgcctaattaattgcataaactttagctagaatccttcaacatctccatccgggttttaaggtttagctccttttgattggtcctgctgcaagcaaggaactagcattaactgaagggcagtaaatcatattcaaatgtatttttaacataagcaaattgatcattaaatccaggtatacactaatttctctggttcctcagtgatcttcagctacacttccttcctgactgtactgaccaagattgccacaaatgtgggcctctttgctgtggacataaagtataagtcatttacttgaaatgagctccaacagaaatgcatgctaggtaaaactgtaactgcttctccagttagtaccaccatctgcatgagctgcgtgggggcctctgcccttcaagtttaaaaaggtcccttctaacagaagcagaagaaatggaaatgttgcaaagtacctaatgggaccaaaggaatttaggaacaggcatcacctgcatcgactggctgattaactgattaattgattaattgattgatttgttcattcaaatggtatgtactgagcagctactacatgccaagcacaatgcaaggtgatcagatatagcagtaaacaagacagaactgaaaccctgatgttttcagcagctcagaaagcaaggcatccccttcactgcctccacctgtgcagtgatgggagtcgcagtgaggaagggcggggaaaagagtcgtaaggtgcatacggtgtttttgcaacaagctgtattttcttaactgaaaagtttaatgaaattttaatttgccagaaggcaacaagctgacttcttcaatatggtaagaagagaaactattaattatggctttctaaaattgaatatccttgtacacaagctgaagccaacagtagcccacacacccatgctcctccaaacgtgagagcttatctctgggcagctcttcaatgtccatacatgatgccttcatacctgctcactgaacccagcaggtaagcagactcagcttctcacaaagacagtcgacaaggacaaaagacaaaatggtccccaactcaccctgggattaacagaaaatttatagacttctacatagaaaagactttggagattacttagtggggtcaatccataatttgatatacggaaacctgagaaccagaaggtcgctgagctgcaagcattttatttatgtattaactgatttatttatatcctccctacttccaaaaaggttttgaggcaattcgccaagcattgtggttaatcactgtgttattattagaaatgaggcttttcttaaaaaaatttttgagtgtttctaaaactctaaggatttagatcatgttaggtatataattcaggttattgtgtatagactagctctataataagctgaatcctccttgtactttaaaggattcctggctgggtgcagtgtttcacgcctgtaatcccagcagtttgggaagctgaggtgggaggatcacttgagtccaggagttcgagaccaacctgggcaacatagtgagacctcatctctctttttaatataaaaaaagtaaataaacaaacaaacaaaccccaaaaccaaaatggattcctaagagaagctccatggttttctatcaggcaagtggcatgaactatactatagtgaagtgttacccatgtttacatgtttatttgtggtaatccatcagagtaaacttggtgtgaataaaatcaattatttggggacatttgctgtgtctttcataatgtatggattggtgtttgcaaacagaaccatggttgtttaatcagatatggcccttttcttcacataaatatggagctctctggttgcagtaggttaggcatacatgtaggcttggatttggagtgagctccttgagtgcacatttaaaatcatgaaagagcgatgtaggggctggatagaagcaggagtcccaagatatcacgaccagtgagcagctacccccatcagacctaattcatatattggaggatctgatggatatcttcccacgggctactccttgatgctttaaattttgtggggcactttgtcactgcttgccgctagaactcaagagaaggaatctttatctgtttctcctttcccaagggcaatgccattatttctgtctctcatacagactggctgtgagagctgcataaagggccatgtgttgctggagggaagaaagaaatgcaaaagagacttcttagttgttgtggtccagcatgaatagcgcatggaatcatgggcatgaagtgggaagatagctggaaggtggatggtacaactgatggggtaaaaagtagtcaagagatcaaatgcatttcaccggacttcttaggctatgagggaccaagaagtcattcagaaggtgtggtgccctccgcacaggaagcagacactcggccaccttctccctgacccactgcgatggctaatttcattaaccaatgtcaacttgccaggattaagggattcccagatagctggtaaagcattattttgggtgtgtctatgaggatgtttccagaagagactggcattagaatcactttaaggtcctggatagaataaaaaggcagaggaaaggtgaatttgccctctccttcccattctcctggagctagggtacccttcttctcttgctcttggacatcagaactccaggctctctggcttttggactctgagacttgcaccagtggcaccccaggttcttaggactttggccttggactgaaagttacaccttcaggttccctggttctgaggcttccagagttgaactgagccacactgccagcttcccccattctatagcttgcagatggcctgcatgcgactcagcctccataagcgtatgagacaactcctctgataaatcccctcttatatatctgtatctgtctatatctaccttctattggttctgttcctctggagaaccctgacttgtacacctcctgcttgaggacctcctctgagtctggccacacctgcttcctctgctcttagagaagagagccgcataaatggattcacagtaattcaggtttccactgtgtgacaggaggtatttagggtttgggtgtttctccagcaaccgacatgtttccttgtcaggcctgagttgataaggcagatgctaagtaccaggaggcttcactttggtcatctgatggcctgaatgttctttgtgttgaactaggttcacattgatggttgtcttgtccaattaatatttctttaataaaccaatcaatttagaaaagtaattgctcaagctcactgttgggcaagagaagtcttccccaaagcccatggggacacctctttccagcctttgttatttcacctaggaggtcacaggtctagcctatgacagtaccagtttcatgatgggtccaatatgctcctgcctacacagaataaatattgagtctcacaaccaaagagttccagtgacgatcttgatccaccatagccaagttaaagagactgggtttgctccttccctgtggatctgagctttccatttgagctgttcttgagcagaattagtctctatccaagtctattacagagttacctgcctgatcccagcattcctcaagctttgagcatctggagattttccaaataatgtcttcatcccagaaagcatcttcaatgccataatcaagcattctctaatttgctatttccattcagttgaattaagtgcctactttacataaatagtactagttccttctggagaagtgtgtttattggcaccatacacgtaaaacatcttggctgtgtctcataaaaagccttgattggtgtgtatgtaagcttttaatgaacgtctgagagagtaaatgaagcagtcaagtccacatattttctgttcataaaaacacctcgtttgcaaagaagaggtatgattcagaggaagcagactgggagcagaagccaagttggcatcttaggaacactggtctatgtttttctggagaaacaccctagggttggatagacccaaccctgaccccaggaattgtgtcagctaaggcctctgaggcaacaccagaacatcagtgtattcttatgagttgaggcaagggtggccccatacttctggaggaagaagccacattgattttgcatccctgcataccacagtcatttcccatgtaaatcaccaacagccatccacctgatgcatgttggctcggtgccctgtgagaggagaagtggaggtcatggcagctgatcatgatcattccctgagcactttcttcagcagggaagatgtgtgttaatccaaggggcttgggcccttttcaatttggataattagctcgccccccacccccacaatctcctcctgctgcttcctcccctcagcattgttctcctttgtcagaggcaccacagacccttggcacagaacctgacaccagcctgctctgcaatgtgtgtattaatatttctcactgtaaccctgtcttcacagattccaattctttatagaaataccatttttcaaccccatacatggtgtatggggggaagacatttactggaagattgcacatgtctgtgattctgcttttgtgttatctctctagagaaggtgactcaaatggtctaactgtattgtaaagagaaaggcatgtacaggcagtggagaaacagatggattttgactgggaagagggctggtttccagcagggacttcactcataaaataattacacagggggatgcagagaggtggccccaaactagacatgccagaggcagatgtggctgagtttagatggttgtcataaaagaagtcctaagaaacatcctcaacggggtagaaaggttttatggtcatttatctaccctaatagaaaatttctgggattataaggaactaacaaaaaggtacagggaagggcttcataagaatgtccccctaaagttctcttcccaggtcatggcagtgtgttgagcggacatacactgtggtaagacagggtggttctcccaaccctatctataggtaaagtgcattttcactgagcacacagtcctacaattggactatactataatttttaaagactgaatttttatggaccacactcaccagctggaacaatatggcacttgcagccatttctgcaaatatccttctatcaggcatatgtttgtagattaatgttttccagaactctacctaaattatcaatctgacataagtcttcttttcagagggtctcaaggttctattattaaccttttagtgttctttatcttcctaaagaaaactgtctttgaggtattatgatcaagatctctaaaagcaattctctgggtctgaagtgcctgagtaataaggaagaagatatgtgtttatgtgcttgtgagagcattttgaaaagattttaggagtttcgcaagtgatgtgtgtctgaaaatgtactgacaacagaacacaaaaatacggcttaccagggtaaatgaaatgcaccgcgcaccttttcaaaaatctggaataaagattctgtggttctcctgtaaaaaaatgcatactacaaacaacccaagcccacttttaaatttaattatgtctcctagggagaggaagcccaactgtaatacatcctttcagttagggaacatttgggaacaccagggaaggctgaccctggagataccacaaagaacaaggctgacttggttccgtcattttggaagccaccatctaccaatgacagtcttggagtcgactgtcattaaacaacaatccttctatgtaagtgccaccaagaaaaaacacaggtcccagtgaaagcactgcacagggaggccagtggtatttaggaagaaatctatggatgaactggcattggagaaacacgagagaggtaggtctcagaaagcaacatcttccagagttctggggtggtaaagaatcatgtgcaagaatcccaagagcaagagtgattatgcaggtgagaatgcacacagcaagtgtggacttagagaaagtacacagagaggaagtgtgtgctcacaggaagtgtatagaggaagtgtgggctcacaggaagtgtatactcataggaagtgtacactcacagaaagtgtgggctcacaggaagtgcactgagagaaagtggtactcacaggaagtgcactgagaggaagcatgggctcacagaaagtgtatactcacaggaagtgtacagtcacaggaagtgtacagtcacaggaagtgcacagataggaagtgtgtgctcagaataagtgcacagagagaaagtggtgctacaggaagtgcacagagaggaactgtgtgctcacaggaattgcacagaggaaggggggctcatgggaagtgtatactcacaggaagtgtatatcatagtaagtgtgggctcacaggaattgcacagagaggaagtatgtgtttagaggaagtgcacagaaagtgtatgctcacaggaagtttacagataggaagtgtatgctcacaggaagtgcacaggtaggaagtgtatgctcacaggaagtacacagataggaaatgtgggctcacgggaagcatgctctcttaggaagtgcatagataggaagtgtatgctcaaaggaagtgcacagataggaagtgtggcctcataggaagtgtgagctcacaggaagtatgggcttacaggaagtgcatagataagaagtgtgtgctcacaggaagtataccatcagaggaaatgtgggctcacaggaagtatacacataggatctatgggctcatagaagtataaattcacaagaagtgtaggcttacaggaagtgcacagataggaagtgtgtgctcagaggaagtgtacactcacaatgtgggctcaaaggaagtgtacacataggaagtgtgggctcacaggaggtaaacacataggaaatatgggctcataggaagtatacactcactggaagtatacacagaggaagtatgggctcacaggaggtaaacacataggaaatatgggctcataggaagtatacactcactggaagtatacacagaggaagtatgggctcacaggaagtgttcactcacaggaagtgttcactcacaggaagggtgtgctcaccggaagtgtacactcacaggaagtgtgggttcacaggaagtgagagctcacaggaagtgtaaactcacaggaagtatacactcacaggacatgtaagctcacaggaagtgtatgctcacaggaaatgtatgatcacaggatgtatacacttataggaagtgtacactcacaagaagtgtgagctcacaggaaatgtgggctcataggaggtgttcactcacaagaagtgtaagctcatgggaagtgtaagctcacaggaagtgtacgctcaaaggaagtatacacttacaggaagtgtatgctcacaggaagtgtgggctcagaggaagcatgcagggccagattgtgcaaggcttcttgaggaagaaaattagatccacacaccatttggatctgcacagatttgaccttgtgaagttcaaggtcacatggacccaggatgtgtgctgggacgggagggagcccagccatgtggaagaccctacaggaaggagcacatcgggagtcaggccatgtccccgccatgtcttcttccttccctgtgggcagcgctgtaccacaggctgatgctctcccgactccacacctccctgtacaaggagctgtggaagcatcagataatgtcagggcaatgggatcagagggaatgagcactagatcatagttccggagacttccagcactaaaattccaattcctcatcctggtgtttgtgctggaaagatgagtctcagcacaaaatgggaaaaagtagacaaacagcaaaggaacagtcagccttgctttgtgtgcacatcctcggcattcccctgggtgctatccagaaactacgtatctcactccttcacgccaaactgcccatagtgggaggaagtgttctcaatctgaagactgcactgagtggcagccctgtgcacagtggaaaaccaaattagccttttgaacctgcagccacaagtttccacaaagtctggtttgggagctcttccagcatggggtgtgtcccatcatgttggcaggctgctgagcagaggtgtggacctcattagcagaggccatggggggcgtggatgcagcctgtgagagactcactcggtcctgtgggtaccactgagttggcctctctgcctccctgggatgacgccaagtctttgccgggagaatgagtcactgagctgatgggagtagaagatcaagtgggcctcacagattcaaaagccactactgaaattaaacgactctgtcccagatacagtggggaactgctgccccaggtttagaacagccccaccctgacatttttcctgttgaacacacatttttctcggtttatctactctttaactccaaattgtacaaaaactataaagtgaggaagtcgaaggagaatgactttcctgtattctcccagcagtattatgcctcatgcctaactaatgtcatcctgtgtccactttcaaagcacttcctcatttatcccctctctccagctcgtgagccctgaggatgggcagcctatcttccactccctcagaatgtcttcacatctcctaacaaaggatgaacaaagaacagagcccttcagaacaacagaaacacagtattggagccaacctcacattgactaatccccaggaaggcacacaggctcaggtgggtaacagtggagaagtaacaggaagcaatgcaaagggtgacacggagcagctgggttgaatcccagctctgctgaccagctatgtgacctggggcattcaatttctcctctgtgaacctgtttctatgaggtatataataacatgacttatttttaaagactaaataaaataccatttctaaggcctctgacacattcctgtcccagagctacttttttttggaatgtttatgtatatcactgctagtgacaaaagagacatgcatgaatccaacggacaacgatataaacaatatagtgcagaacacaaaggaaggagtggtcatttaaggcaaagtaggatagcattacagaggagcaacatgagccaggcttgaatgaatgagcaatgttttgctagaagaaaagtgtggggaaggcattcttggaaagagaatactattgaccaaagggcagagacacaacaacgtgctgtatataccgggagggggagctgtgccatgtggtttcacgtgtggcatctcctggtggcccagtgagggataaagccagatagtcagggccacccaatggaagattttttgatgaataaggaatagggatgttatcctttaggcagtggaaacccactgaagacaagaaagatctttttatctgaggaggacaagatgcatttgaagaaagaatgggaagagagatctttcgagactactgaaccgaaatgaggacctgaagcagaggtgtcgtcatgggaagtgaggaggaagaagagaaggataaaaaatatagtgggaggggaggtgatggtaatttcagattacagataatggggtaaatgaggtgaaggggtaagaagggcatgggcagcttgcagcgtgagcagtggtggatggtgtcctcattaagtggcccatggcaggtgccctgtgggttaagctgaattgcatattgggtcttaggcaataactctagtcagttacttgtttccttttaagacttcgaaaacctctcttgatttatatatatttagtgagccaagggaaatacatagtcagatcaatattaagccagcagtaaaaccagcaaatcaatcagctgtccagccaaagttttctgataatgagggctgatgaagatttgagttcactggtttctgtctcaatacaaattgtgaccaggtagaacactaagacctagaattcaacaaatagtgactgaaaatattcttaacctaggttaaatttaggaggaagtgaataaggtctcaccctcatctgcaaaacttgccaaatttgtccctcaaaaatattgttttatttattgggaggaaaaagttgtgtgtatgtaagagtgtaaaaatgaaatatccaagtcctttttgtattttcaggctaatatttaacttttcagagagtacacaatttatgaattcaactcattcctattataattagaatttatgttgagtttcatgaaattgtttattcttttctccttgagcacctctatttgacatttacaaatcagagttgaaagggtaccttttccagatattttttccttaggctatcttcatttacataagaaacatagcttcctagtctatccctacagacgaggttagttcctccagatgtaattagtaagagaaaaaccccttagtattccacttactgatttaatcaaacattctgctaatccaatattctccaaacaggattttgataacttcctggatgcacattgtaattacagagcagtggttgggaagcagctgaaggggatgacctagttccacgtgggccttcccaatcacactgagcctctacttctttagcaatgagggcctctgacatgaaactctaattcttggcttccttcaagcagtcacagtcagagaatatttgaagggaaaaggcctttgagatcatccagttcagttttcccaacacgggtccaggatgtcatcagtcacaactgacgttcctggaaaaaagatatcatggcaaggtaagtttgggctaaaactgcatatcacaccccttctgggagccgtggagaatttcagcttaaaatagcttctaaatcttatgataaataagcaaattgcattgaatccagaattttccaaacttattagatcatctttcccctacttaatgcctttgaacattttttagaacttttggaaagcagagatctaacccaccctctccccaacttaaagctaagacccagagagtaaaggtgtgtgcctgagttccctcagtcaggacccttggctccggcttctgaaccggccactgacgaactgcctggtttatgttcatgttgactctcactacacctgcaaaaacttatttctctatgagcaatgtgtttcagaaggacctggacatgtctggctgaggcattttccatggtgatctgctccgtagttgttttggcgtcttgcaggggctactcttgctttatttttttgtattgtggagctgcaggctgaagtctgactctcaggttggtatatcctgcaggctcttgggacaggagctcattctgtggaccgcactggagaaacagaggctggaaggctttgtcctccccacctgcccccatctgatgtgagatctgaggcagggccactgtcaggcctgggattaaacatcaggtaaaacacaatgatgtgcaaagtcccctgagccctatatcagtgccatgagaaacatgagtgtttcggatacactttccctcatggcatccagcactcaagaaggtctttaaaagagaattgaggaaagtaacatcatcctgctttgaccttcttccaagttaagtgagagcattctcacatagcattaccctatgaaatcagggtagatagtgtgacataatcctacagatgaggaaactggcctacagtttaaaagaaacactccagatcttacagctggcaagttttagcaactcactagatgccaggtctgtttttttacaaagtcccatcaagacccatttttcagtggcaacgactaaggaacgaccttgaggaagctgaaagttctgccttctaggacacatccctgccaacagctttggctgatgtcacacacccctcactagttcctctttgtcttctagcttaagcttccatgtcctctttgaatttgtctatgttttcttttcttttttctttcctttttttttgtgtgtgtggggggacagagtcttactctgtcaccccgactggagtgcaatggcgtgatctcggctcactgcaacctccacctcccaggctcaagcaattctccagcctccacctcctgagtagctgggattacaggcgtgtgtcaccatgcacagctaattttttttttttttttttttttttgagacagaatctcgctctgtcacccaggctggagtgcagtggcacaatctcagctcactgcaagctccgcctcctgggtttgtgccattctcctgcctcagcctccctagtagctgggactacaggtgcccaccaccacgcccggctaatttttttgtctttttagtagagacagggtttcactctgttagccaggatggtctcgatctcctgacctcgtgatccacccgcctcagcctcccaaagtgctgggattacaggcataagccacggtgcctggccgctaattttttatttttagtagagacagggtttcaccatgttggctaagctggtctcaaacgcctgggctgaagcaatccgcctgtctcagcctgccaaagtgctgggattacaggtgtttgccaccgtgtctggcccatgtctatgttttcaaaaggttaagtcaacagggaaggagctaggagggtgaggttgggccccctgttgctttctgcttagcagctctgtcctctaaaaatgaactctggtccacagttttgatatgaaccattcctggctataagcaaaatggtactagaaatagctttcacaccgaggcacaaaactgactcaggctagctagataagcctcttgttaatgtcacttgttaaagttggtgacactagccacaatgagtgtattgcaggaaatgttcattaagttcctgaccagcttctataatcttcctctctgacatttccaggatgggatgacctctaccataaagttggagaacttctaaagatggcatgtgcgtagaaagaacttcccaggcttttcttcttgggggtgtgtcggggggtggcgggtttttaagaatctctgatggagatgttaggtcctcaacaaggtagagaagatgcaaagctcaactgacagtactcaccattcccttttctgcccaggacggcatattctgcagctctggttgctaagctaacgctgggaactgtggaaagttaccctttggtaagttgcaaatgctgcatgaatgattctgtagttacactccccagggtcagggagaagacccagcagtaacaatcagatttgagtccctgctaagattgcctttggagcagtgtcccaggcatggctgctgtcagatgagacaacttacttttaaatgtatcttattttgtaaatgtattttttaaaaatagtctcgggctgggcacggtgtctcacgcctgtaatcccagcattttgggaggctgaggcgggtggatcacgaggtcaggagatccagaccatggtgaaaccccgtctctactaaaaatacaaaaaattagccaggcgcggtggcgggcgcctgtagtcccagctactcgggaggctgaggcaggagaatggcgtgaacccaggaggcggagtttgcagtgagctgagattgtaccactgcactccagcctgggtgatagggcgagactccgtctcaaaaaaagaaaaatagacagtctcactatgttgcccagtcttgaattcctgggctcaagtgaccctcccatctcagctgccccaagtgctgggattacagatgtgagccatcatgtctagcctttttattttcaaaaaattttgttttagatttaatgtcaaacttaattttaattgtacggtccaatagccatagtccacagggctgcaaatgtgactgatcactctgcagcttgttccagcataaaattcatgcaattcgtatttcagggatgtggcaagtcatgcatggggcagagaggcccgctgtgcctgttgggggtaaggtaaacctcagagatgctggccatgtgggcctgctcctgtgttgccaggcatccctctgtggagacgttcttgggctttcttccaccgtcattgctactgtcagtcccattcgctcaggcacacttccgagccccttatctttgtgttaataggaacaaagatttcagcttctctctgtgaggtagaaccaacctcatgtccttctgtgggtcaggtgtggcttagcctgctgctacagcaaccacagacatcagagctggaaagcagcttgtgaaatgagggaacagctgagaacagcttcagaaagggaacgctgtcttcgttcttggacagaaacagatcacagtctggccaacattgggaaacaatgccattggaaataatgattccttcccatcctcagaaagagctgtgtgtgtgtgtgtgtgtgtgtgtgtgtgtgtgtgtgtgtgtgtgtgtgtgtgtgtgtgtgatgctgcccctgtttcccccaactcccccagcatgaccagaaagctggaggcaacagcagatagcagtcctgggctggactacagaggctcacttgggtgcacagctcgtgtacagcaagcagctcagctccaagttagtgagggccgtgcatgagcggaagtcttctccagcgcaagtaaagcccttttcttgactacatttcctcaccacagattttaatctatacctaaaatgcctcttatctgtacctaaagcaaatgcagtgtattcttggcaaaagaaaaatggttatattttgatatcccttttctcttggaaaatattttcttaaaatgtctacagcaatcattggaattagctttttgactttgagatattaatttaattgcttaaaatgacataacttagtataaaatgcccaaaccatatcaattatggctaatctgactgcaaggttagcgttatgtttaattgttcagcaacagagaatacttttttaaagtagtgaaatcccaaaggcaaagaagaagaggggatacagctgactgaatgtaattacgatggatttaactatgctccaccatcccatcttgaaatcccccaaggagctggaaggggtgggaagagcaaaagagactttgaaaaaagtgttatggtggcttggggtttagaagtgaagaaaatcggtataactagaaaatagggatattttgactcaaattacacagaaagtctttaacagcagcaaaatgagtatattcagaaggcaaactggggctggcctcatgagctaggggcctccttcttggcatacaaatccttttcaatgtctgcaaactgtttagacaggtttgaaatgctatcgttctgcaccaaatgtatttcaaccccatttccaggtgcaaattcaagcagagactgaagcatgcagcaaaggaaggtgacaagacagagaagcccctgaaaattcaggtttcgaatcgtgatgctcgatggacactcctgaaagctacacccatgttcatcttggaagcaaaatcctgtggacatgtttagctgatctaccaagagggcaggctcctggtctctccttgttgtgtaaggaaaaacgaccaccaaattgttcctagcaaatgacaagccctcataagatgagagcacgtccaggtttccctgtctcgacgtgaatgttttcatctgtctcgatgtgaatgttaatagcaccactcttctctctctaatgaccccatttggataaaaaattatatggtcaccctacttaaaggtcgatttccccttatgtcaactcatcatagccctatttcacaatcacacatttaaccaaccaaccaaccaaaatgctaaattctattcacatatatgattataaatggaccatttctagacagttttcctacctctcccagaaccaaaatgaatattgaagatgtttgaaatttcaccttcaagtccaaagatccctacaccatgaatagccgtttctctaatatctttctgattcagtatcccaaggaggtaccacttcttacagtgagcacataatggatggaatcaagaattgaagagcctgaattctacccagttaagaactgcatttggttcttccagatgacaattttcactgaattcctggagcaatcacagaactaagaggaccctaataatcaggtaccacaaagctggcaaacacttgtgtcaaagtggaaatggactgtgtcaggaggcaaccgatggctctgctagggaggccagaagatgatctgtttgtggcccattaactctaggttcttctgaacacaatagagtctctgctttaatctgtgcaatgtgaacccattatcttcaccctcgcctctagccacaggggtcatccgtaaacccaaggagccatcacaccgaatgtgcaccagcagaagaaagccagtaacagtgtgaattcatttttgtgcactgataaaataaccaaagcctgtgccctaccgatggggtgttagaacaatgacttccttgtaagaggccatggcacgtggattgactgccaggcctggaagcgtttgatgcattcacactcaggtgcattgctctttagtggtcatgttaggatccttacacatcatttcattaggtttcttagctttgctcttctctaatgcgactactttttatttaataaaagtaaaaggaacataatttaatatatacatgtttgttttacactagaattttcagaaatgtaggcggtatataaacagaagcaggtaggattctgaaaggacttcgaagaatgagttttcacgtcttagtttgcatcctgctgtgttcctggcttctctttgcagaaaggtttctgagtccacacagtggagtgtcatgtctccctcgtctcccatttaccctttcgtgtgccctgatctggtttctacaggcactgctcctagtgatattttagtaaacggttcctagtgatgtctccaaagacctccacactgcacaccaatgggctgcgccctgactgcatctcagctgttggaacgtcatcttttcttctggctgtcctccaactcaccacacacacacctcagccccctctgttgggatctctaagggccctctcctctcttttcctgctttttcttcctaggtatggtcattcatttccaggttcggaacacaatctgtgtgctaactactcccacattttatttctagtccaggccatttctctgagtgtcatttcctcagagctgacgttgccacttgggcatctcacggatctcccagcttcaccggccctgcacacttacccccatcctcccgcccttccctgagtcttctcagtgacagaaaatggcgtccatattcaaccaattgctcaaaaagcacaaagcatagatgccatcatacttctttcttccactctgtttgcaagtcaaatccatcaggaaattctacatattgtattgtttgggatatttttgaaaccatttactgctttctatctgcactgtttaaaacacatcaatgtcttccatggcatttagaagaaaacactaactccctgtccacgttcccatctgcctgctcccacagtgctggtgcaggctgcttcctgtccctctctgcatcagtccctggccctcttacatgtcccatgacaagctgcacccctgcccctctccagcctctggagatgcagtgtccctctcatgctctcaccctcctcccctgctcccgctctccacccatttggcttctcatcccttacactctgcttcagccaagggattcttccttaactaccagctctgtcaaagatcattttctcccagctcatcactgcacagccagcaccctgcatatttcttcatgatgacagcaaagacttgaaatggtgggagagacaaataaacaagaactaagcaagtggaggagtggaacttcattcccaggtaagccctgtgagcagacagcacatctgtccccaggtaatcatagtgagtgggtggcacatctatcccaggtaagccccgtgcgtgggcggcatgtctgtccccatgtaatcatagtgagtgggcagcatgtctgtcccaggtaattatagtgagtgggtggcacgcctgtcccaggtaagccccgtgcatgggcagcatgtctgtcccatgtaatcatagtgagcgggcggcacatctgtcccaggtaatcatagtgagtgtccccaggtaagccccacgagcgggcagcacaactgtccccaggtaagccccatgagcgagcggcacatttgtcccaggtaagccctgtgagcaggcggcacatctgtctcctgcacctggtgctagcctactgataagcacagaggccccacccgggggtgaaggagcacacgggtcactctccagtctaaccctgatgtttgcagccctggcactggcaccaacagccctcaaggaagaatagaattagatctgggagaagcaagctatcaggaagtaaatgatcatgtatcctggtttatgaaataccacttattattactagaaatgagctatacccctaacaattttaagagcaaataccttcatgtaaatgtggatcaaatgcttcagaaagagctttcagattgagctttaattgaatttaaactaaatataacaactttacaagactgcttcaaagaaagccctgaaattcattttgaaagcagaagtcattccggatcttgggaggacagaagtacaaggctcaggcagttatttactgatgtaattaattgatattggtcaaacacaaaagtctttgaggatcgttgaaggcaattcggtctgcgggagttcatattctttattacggtttgtttccctggagacctcattttcccctgttataaataaccccaacgtgtcttgccagtccaggtgtccgaccctttgatacgattctgatttttcggacagaaaaacagtgcccgaggatctgtccctggctgctgttggctgcttgttgaagatccactccacggctgctggtatgaggaagtaaggcgggcctgatggtcagagggaggaggaggatgggcagagggaggagagtctgatgccagagggaagaggttgatggtcaaagggcgcacagtgatgatcagagggaggaggatgatggccagagggggaagggtctgataattcgagggaggggtctcgaggctccatgtgaagtaggtctgatgaccagcgctcaaagttcataagtcagtctaataacctaaagaactatggacagtagaaagaatacagcgacatacaagagggctattacatactggacattataatctgtgcttcaagatattgttgccaattattacagcaaattgctaaagtgagtattattatgacttctattacccacatgaagaaacacaagctcacagagactaggaaacaggctcaaagtcactcagctagtaagtgatagggaatttaactcccatctctttctagtaacttaggtttattttatataatagatgggaggtatgcttgttaaaataagtcatttcaagatcatatcacaggtttgtaggccacttcttctttccttgactatatttggttctctttccagtgtgatttttaactggatcctcagtacccgaaattctttacatttccacgtcaccactgctgcccctccacaccacgccaccaccacctctgatcagtacacaacatgcaaatgcacaggggatgatgtggtgatccgtctgtgatgggaacaatcattcctcatccttattttatacctttgggctcccataaggtaattactgtcaaaccaactttcacataggtctggagagaaatgagtccattgtttctaaagctgtgtccttccttagctttacatgcaaatttctaaattgtactaaatgtaaaataagatattttagttgaagagaatagtctcatgtgtttattttcagtaattactataattgtgagaaatgtagtcagtccgttgaaaggtccctaggatgatgtgacactttaaatagacagctaaaataatatatattatagttgaactgggaatctacaatatggccttagaaaaagaaaacaatgaatttttgtttgttattgtggacacgacactggcatgctctggcgggaacacctacattagaagcgaggtatattagggattattagactccgccaagcccagcagaatacacatgtccccccagtgcacctgaaacattctctaaaatagactgtatgtgaggtcacaaaacaagtcttcataatttttaaaaggttgaaatcaactcacacaaagtgtcttttctgatcacaacagaatgaatttagaaatcaataacagatggaaaactggaaaatacacaagaatatttggaaattaaacaccctgataaattaccaaagtattaaggaggaaaccacaagggaaacacaaaaatactttgagctgagtaaaaacaaaaataccacacaacatagcagaacttagggaatgcaataaaaagagtaattggaaggaaaattatagccgtaaacatttatattaagaaagaagaaagatcttgaatccacaaactacactctgccttacgaaactagcaaaagaagagcaagctaaacccaaagcaagcagaaggaaggaaacaataaataatagagcagaactaaataacatagagaacagaaaaacagtggagaatattaccggattagtccgttctcatgctgctatgaagaaatacctgatactggttaatttataaagaaaacgggtttaacagactcacagttccacatggctgggagggactcaggaaacttacagttatggaggaaggcgccccttcacagagcagcaggagagggaatgagagtcgagcaaaggggaaagccccttagaaaaccatcagctctcctgagaactcattgtcacaagaacagcatgggggaaaccagccccaggattcaattgtctccacctggtcctgcccttgacctgtggggattattacaattcaaagtgagatctgggtggggaaacagccaaaccatttcattcaccaaaaccaaaagttgattatttgacaagatggaaatcaaacagagttgaaaaccctttcgttggactagacttcatcaactgttctgggtgcatttttaatttcacaagaatttccttcaactttgcatgaaaccagagttcctcatgtgtactgtttctaatcaagtgtattttcatgtttagaaagctattttctaaggagcaatttccatagttcttataaatcatgaaacttgtatagatgaccattttctactactttaatcaactctttaatttttggttcaagggcactatcattaaggaagacccctttgaaaatgaacatagatggccgggcgcggtggctcaagcctgtaatcccagcactttgggaggctgaggcgggcggatcacgaggtcaggagatcaagaccatcctggctaacatggtgaaaccccgtctctactaaaaatacaaaaaattagctgggcatggtggcagacacctgtattcccagctactcaggaggctgaggcgggagaatggcgtgaacccatgagagggagcttgcagtgagctgagatcgcaccactgcactccagcctgggcgacagagcgagactctgtctcagaaaaaaaaaaaaaaagagagagagaaaatgatgcaggaagaatgacgaatatagaaatcataacacagtcaagtatagtgaatgataaaagtaaaaaaaaattataaagtgtaaaaaacacatcacctcccacctggagaccacaggtaatgtgtcagtcagagttcaaacttgagagtgaaactctcaatatttggaatattatagagtaacaaccttttacaggaatggtgtgaggtgctatggaagtaaaggtctgtcgagtggggtacagcatcgcatggtggccctggactcactgcaagtcagcagggctggaaatcgggaaataaagacaggggtaaggaagagtgaagacaaacttgcaccctgtgtcagctccactgtgtctctcaccacttctgaccaattgtaactgggcagtttaactgcaaaatgcattttaaactttttacttatttctcgtgcgtttcaagatataaccttgaagcaaattgcagaagcctttccctctttgtcttaaaatgaactccacatccctccctttctcaccatctatactcccttcacattcatctacctgtatgctagcatctaattatgtccctttttagaagctcctgggggtaatcttgagacagatgaaccaagtctggagacccacctgcaaagttccagagatgacttcaaggtggcgagtcaacagcctcaccattgttgagatgacaccagcccgtgatccaggtaaactgggacccaagatagccaccagaacaaggtacacagacgttgtactcagcacaattcttgcaagcttttcacatcaagttttccttttttaaacccctgtcttcctctctgccaaattgaagtggttgctttggatgggaacccggccacttgttctttattagtttgagtgaataaagtcactttctttctaccagaactcattcttgttaactggattctgcaggcggtgagcatccggacctctgttcagttacacgatgaaaacctccagagcataatggcccctccttcattcacctcccaggtctcatggcttcactgtggccagctctagctcggaaccatatgtatatagggaaagagattctgagaaactcccacatcacaagttgattatagcccaatccatcacagctacatttcctaatatttctgagtttgcatctcatctgctcatctggtaaagagtatggtgacatgactgcatcatagcctggttgtatcacctgagatgatgtaaaactgtaaaatgccaggtggtatatgtattattattccaaccagtcggtcagcttttattttagagaagcagaatcagaggtaatagggaagaagaaacagtgtatgtatcaatggatgtgttctaagataagatgacgacctgacacagacagccagttctagttggcaggggtagggggtggcatgaatacttctagtttgatgttgtgagatttgtctggaaagcacgggttgcctgtgtggaagagttttgccttctttccacttctgccatagcccttcagatgtgcttctcctatatcccatacgtgatgtacacatgtttagttggtttgtatgagcagtggcagcggaggccaggtcttggcttcctggctgccactggccctggttaccatggacataagtatttccctttcattcagggcaggggttcatggcccctcctgcaaacaacagtgtgcgtccacgtgactattaaactgtcaaattcacaagacccactccaaaataaacccttatggtctccacaagcctatttctcctcactactatctgggaagcacagactttaggaagggcttcatgttttataaaaatgccagtgattatctggaaaaaatgacacccaattttccaccacatcctaagacctacgggtgtctacctaaaagctaatatgttgtcatgttcctgccatctcagatatgaagctgaagatatttcatatgtatgtcccagaaatgaatgaagaagaaatatacagttgcttgactacatgacatgcagctccctgttgcttattctgaatgtgccctgcctctaggaggagctgtagatctgtggtactggtaacactaggcccactagccttatcatcatgcacagcttttgtgttttcttcctccctcagcttccacacaacagccctgatgtttaccagcaggcgtctcttgtttagtctcattgtctttggcaagttcaatctcaaccagattgttgttcttctcaagaggactgatcccagcaggctccagccctaaagcggactgttcgggagatctgtgttaactttgtgtttcagtcctcagtctcacggtactgggtcctaccgtgagcggaaaatccctctctacatcagaacagccttctggccatgctacagtcctcgctcagaaacacggtatgtgtctctgctacccgtctgctcacctgcatctcctacatcctatccagcattctcccgtccacaccactgggcacatcagatttagcaaatgatcagttaatttacactcattaagcagcagtctctacgatgaatctcttctaagctcaggacatttgacacacactttgcaaaaatcattatgtgtcattgtggcgagctggcaggttcccagttatgctgaacaatgaaaaagggataaagctctgcaaaagatagagtggggagagaaagaaatctgcatcgcattgtcaggactaaacattctttaaagaaacctacagtgaggtaagaatggcatctgtgctactctagtccaaaacgtgtattcccttccccctaaaagacagacaaagacaccaaggtactgagcacatcaatataaaataggagaagaacaagacaggactgcagtaacttggtctttaaaagaatctctaattaaaaagatataaaatcatatttgctcagactttgaaggtaaaggcagagtgtcttgtaccttgatctttccactcaattattttgagttactaatttgtaaccatcctttaaaacttgtatttaaaatttaaataataaaatttaaaaatttaaatgatacaataacagagtgtcttaatcagatctagtaaatgaaatgcttgggaaatatgtgcactagatcaagtttctgatagtctaagcaagaaattcttttaatttgtatttttagttgagaatgtattcattcccaggggtttcaacctgttcccatagaaagtaaagactggagaagagaggccttttggatgctggaggatcttggggagtcctagggtcagcattttgggggtgcccctcccgtgaccagaaatggagaagaattaagaatgaggagtgaatttgccctgggaccaagctgagcttagaatttggttttcttttaaaaaatttgtattaccctatgttttagaattgttctctaaattcactttctgataaaagagacaggtcttgactaattgaggtatctgattaaacaaacatttggcttgattaaaaactaagcaaagaagaattcaagaaagatagatcagaaatgacataaggagaaacaactactctataaaggtagattggtcaaatatgtaaaagagggttgagatgaagggatatttatatcttgaacacacactgagaaaataatttttgagcatttattaaagaccaaatactttaggctttgttttattggggaaagtaaactgtttgcttgttcaatgactttctgggagaattagaaaatttaatcacaaatgaactgctgcaaatcaaatgtagtaaaagccattgtgcagtaatcaaggacagaacataaatggttcctttccttgaacaaggggtgtattcaaaagagggaccctgatttctaaagatcaatgaaaaataaagagtttgaagctagtgtttcattcttttgcaaaacaagctaaattatataaaaaggttttattcaagacagtaaatgtccattcattcattcattcattcattcaaccactcttcatgaaatttttccttggatgagaaaatttaaataaagcagaaaacatagtcctagacttaattttatgatctattcaagtaactaaccaaagtgtgtatgtcttacctaacaggcacaccatatataaatatgatggataagcagtgagtgtgtaaagaccttgtgactactgaatgttttgtaaaaggtaagaatttaaccatttgccacagaaacacatatttgattttacatttgactttataactaagctgttcataacaggaatgagatccttttcttctgttcagaacttgaactctcaaatgaggttaccttatgcattgatcgtttgtctatgattggcaagagttttaccagacagcaagcaagaaagtaaactggtcagctctgcaggtgtaattacttggatggttgtgtattcacaataacttctgtaagtttgtagtgtccccaccttacaattgaaagtgctgagactcaaagtcaaccaaccaaatgtgaagaatccaaaccctataggctgtataacactctaagagcagagctcttcccactacaatggacacaccgcaacaagtacaagtgtcatcggtagcaatggcaggatttacagtccgtgtgaactttttcaatcccaagacctcaggagtagaccccacccatggacaatcaagatgcagcagcaagtgagccaatctgcactgggctttttgcatcagggccctataacactatcacctcagaccaaatctctgataagagccatgagaatgaagatctggaaactcacgaaggtcactaatggcttcctagtctgatgattctgttcaactaaagccaggaggagtcctttgacaaaattcattgttgtttggctttgaggttcataatggctataagtaggaccctataattaggactcagactggtcaatgccttgagtggtgcctaagtggcctctgtttaccatgagctgatgagtggcagaagggggggacagcacctcccatatatactggttgcctttgagggcacaaaggcatttgtctttcacaccatctgatgaccgcagcactgttccaagggcagccaggaacctgccctcagtgggccatattacaggggcagcccgagagagctggtccttgagtttcttctgagctctatgaagtaccctcacctggagaagaaaacaagatgtgaacccaggtttacacctcataactcttgccgtcagcatgcccatgaggcagcagcacagaacatcggccgatgaatagtttcttacctctccttcctccactgctgcctcatgcctgtatttgaaggcaaggatgttttagaatgagacccatggctacagccagcatgtagcacagatatgaatgctcagatgttgccgaagtcaggtgtaaatcagggcggacattctggcagcaaaaaagactgcagaagcctcctgggtgcaggttggaacacttccaaaagtggaactctatgatcggttgactgaggtggaagattaattataacatcagtatggagagtgcagctcccaacgctctatacctgctgctgggtgcctgggagttgagcaatggagttggatgtgccttagctctctctgactctcactggttaaaggcatgagacaatgcagttaaggccctcctgcttgagatgagaaaactcatgaattgtttaagttcactgggaaataacttctgttctttggtcctgttctttatcctccttcctctacctcaataattaaataaaggttagtttttattattgtgtcaagctcaggacttggaaagattgctttacaggatctcatttagccttcatattatccctgtggtatagacactgctattccccttttgcagataacaaaaccaagagtcagaaagcttaagcagcttcctcaaggaaactcagccagtgcatgacagggccatgattctgccatggataactgagaattttccattgaactggaaattgtctgatgtttgctgagtgcctggtggtgtgtccagggctgtgctaaatgaagctcagtgtaggagcatcttgttactggccagaggggagaaatgatctaagctcattttctaggagctcaactcttgcaaaatattctgtgaagataagaaagtttgggttgtctacacataagatcatgtcatccgcaaacagagataattttatctttttctcatttagatgcctttagtttctttctcttgcctaattgccctggcaaggacttccactactatgctgaatagaagcagtgagtgtgggcgtccttgtcttgttcctgatcttaaaggaaaagcgtttaacttttcaccattatagttagtgccaataatacacgatgggaaaataacagtctcttccaaaaatggtgctgggaaaactggatatccatacaagagaactgaactcttaccttatgctgtacataaaaaacaactcaaaatatattaaagacttaaacataacacctgacattgtaaaactcccaaaagaaggcatgggggaaatgcttcatgacattggcccaggcaatgacttcttggatatgacaccaaaagcacaagaaacaaaagcaaaaatcttgaaaaggcatttcttcaaagaaaacatacaaatggccaacaggcacataaaaagatgttcaacatcattaaccatcagggaaatgaaatcaaaaccacaaagaggtatcacctcacacctattaggattgctattatatatctatatgtatgtaggtgtgtgtgttgtgtgtatgtgtgtgtgtgtatatatatatatatgtaggaaaacaaatgttgacaaggatgtgtagaaatcagaatccttgtacattattgggggggaatgcaaaatggtgtagccactttggaatagagtatgaggcttcctgaaaacactaaaaatagaaccaccatataatccaacaatctcatttccaggtacgtatccaaaataattaaaatcaggacctcaaagaactatctgcacttccatgttcattgcagcattattcataatagcccaaatgtggaaaccatctaaatgctcattgacagatgaatggataaagaaaatgtggcacatatataccatcaaatattatttagccttaatacagcagaaaatcctgccatatgcaaaaacatgactgaacctacaggatgttatggtaagtgaaatgaaccaatcacagaaggataaaccctacatggttccacttcctaaagcaggcagacttgtacagagagtagagaggtgcttgccaggggcttgggataaggggaaatgggaggcgttccatgggtacaaagtttcagttgtgcaaaatgaaataagttctagatatttgctgtatcctactgtgctttcagttaacaagacttaaacatttatggagagagtagatctcatgttaagtgttcttatcacaaaaaaaagaaagaaagaaaagaaagtttgtagctatgtttagttatgtttttttccctgttttatttagtacctactgagggattccttttttttttttctttttttgagatggagtttcactctgttgcccaggcaggagtgcagcagcataatctcagctcactgcaacctctgcctcctggattcaagcaagtctcctgcctcagcctcctgaggagccggggttacaggcatgcgccaccacacctggctaatatttgtatttttagtagagacggggtttcaccatgttggccaggctggtctcgaacttctggcctcaaatgatccacccgcctcagcctcccaaaatactgggattaaaggtgtgagccaccatgcctggccacgttttatctattgttgatgcattccttgctactaaacagcatcctagatttccttattcctccactgttgataatgtaatagttgatctaaatacagtagatatctgatctctctttcacagaaagtcactggggtgtgtgatgggaattgtaaagtaagtattggtgatggtttcaccataacaggtgatatgatatccactgtccacgtcatccaaaacctaagtttgtttggcttcagagttgcaggacattccaattattccacctttctcagcttcctacccttcgtgatccactccagccaacatgtaaggagaatctgggggagtaaaggagggcaaattggaaaatgtcgcttctgttacccagtctctgcccattttggccttaataaaattttgatcaaaatttaaaaattaggaatatgtgtgtttcaccatttatctgtgaaggaaagaatcctgccttatgcctaaaaatattttaataatgtggtaacattaccactaataatagaacctgcctacgcaccaacacaattccaatctaagagttagtcatatcctcccatcaagacactgtgtgcagattttcttcagtcatattcagatgggatttcaggttccagtctgaagacaaagagattatagatcagaagagacatctaatttcaactaaatcatgcttgcaaacaaagcaacacacacacacacacacacacacacacacacacacacacacacacacgaaaccctgcctgttttcatttttattatcccatctggcactacccagataagaaaataactaaaataaatattttccattaaccatttgcataaatcatgatttactctcacaggtatctcaacagtacccacaccggtgataggactgataatgttgattgactgtttactatctgccatgcacttctagaagagcttgacttgggttttctcatttgtttctcaaaacattcttatgagacagacaccattattatccccacattacagatgaggataccaaggcaccacagagctaagtggtcgagccgggagtgggcaccacccaatccagcttgtgctactgaacacgtgctctctgatcactggaatcctggcagtttgatgggagagacctacttcaaaaaatgcacagtgccatcaatgatggagctgacaataatcacaaataacaacaactgaatgtgtctgtcctttcaatcaagcacagcccatggtacttgtcaaagcccttctttctgtacccatttgaaaggatgcatttttaggcttgagctcgaagtccccattcagaatgaacagaacctccctatgtcccacagacatagcagatacattcaggtctttctctttggtttgtcctgcctcacatgcaccctcctctccatcccccatcctttcctaactatcctttatcctaaaactgctcattctaagccttcagcccacattaacctcttgctttctcttgtattttctcttctatccagacactgatccccagaccctggaaggttttctgactttgaataaaataacaacttctagatcttgtcctgggccatggtctgtctgctctgtgacctccagatgatggagaactcccgacccatttcctcttggtgggatgaggtttgcaaacttcctaggaaatcactacacatcagttggggctggctgttcctgtggaaaacccactcaacattgccaaagcctccatcccctttctcgctcatcccataaagaatggaagtttgtggtctcccttctgctctactgtttgtaccttatgataaggggtctgatgtgtctgtgtgtttctctctgatttctgtccttcttgtctattttaaaactctggctgttattgtgtattcaccgcgaggtaagtaccagattccaggggaaatcaagattcttccctgactacccaagcagagtgatgcttctttttgattcagtcatagtgttttctgtttcgtgtaacacaactccttagtaaagggtaagcaccatgtttcctacctagtacaagactgatcagagggtaggcactaatagcacaaacacaatttttagttggatggaattgaacaaactcattgcattgaatgtttctgcatttaacatcatttggagaacaccaggatgcaaatctggcccattttctcgcacaaaactccccacccattggtagcctgaaagccacagttgacaaatgttaggaagcaccagcaaaaaccagtttccacccctcttaccttgacttgtgtgactgcccacacttctatccagagccaaatgaaagcttccagtcaatgaaaaaatctagcaaccaatatttaggtaaggtactaagagctattttgcattctgttgctcccccaccctgcaccccaattagggttccctgcatgggccccgcaggtatctgaggctactgccttgaagcccccgccccacccactaaagacactgagtactggagggtcccctctccttgttctacaatcataacacgcccacacaggggcctgcttcttcaggggtttagtgccctccactgggggacaaagggtaatcaatggactattatgcaactcacaaaattcttactgtctttccccttctcagggagaattatgtcctaccagaggaaaaaaaaatgcacacatcatcaataaaatctttgtgagcagctttttaaaaaactattattatttttaaagattagaaaattaacagcggccaggcgctgtggctcacgcctgtaatcccagcattttgggaggctgaggcgggtggatcacttgaggtcaggagttccagaccagcctggccaacatggtgaaaccctatctctactaaaaatacaaaaattagctgggcatggtggtgggtgccccataatcccagctactcaggaggctgagacaggaaaatcacttgaacctgggaggcagaggttgcaatgaactgagattgtgccacagcagtccagcctgggcgacagagcaagactgtctcaaaaaagaaaaaataaaaaataaaaaaagaaaagaaaagtaacagcatactagagtataattttcatatgctcctcattaaaattttgaaaattgttagttttcatattttctccatatctattttaaaaattatttcaattgcatacaggtaccaaaacatcatgcctcgaaatcattcaggatgcatctttttaaaaaatctcagtgagcaacgctaaagaagagagaccacaagttctagacgttttcctgtataattaagaagaatctgttcaacaaacccccatgacataagcttatctatataacaaacctgcacatgtgcccctgaacctaaaataaaagcttttttaaaaaagaaaaagaacattttcacacttaaaaactgaatacaattttctaatctcatgtaataacttccccaattactctaaaatgactggtatagctggtttgtataggtaaggatttagccaaggcccaggaattgcccttggttggtggtaacgtatatttcaacttagaacgtgtctgccccagtggctccccagcccaccgcacattgctggcttgctggaaggaatgggcgagttgttgcctccacgtttccaccttctggatttgtctggctgtttcctcctggtgtgcattagctggacgctctgcagcctgtattagttacgcactgaaagttagacctaagagcttgattaagttcagctcacacatttctggcattacctcacaggtgatgctaagcaccgcatggggcatggaaggatatctgcttgtcccagtgttagggatgcaggaattgataaggcggagagcatcggtgttctccaggataaagtcacatttctccccttgcaaccagcagatgatccctggagtgatactttagcaccatgtaaattccctgagatgactgtgtatccattcatgacatttgcctacatcaattggtttactaaagatttctgcattttacaagcaaggaaagaaggctcagagatgaccgttgggccacttagcaaattggtggctgagaggctggcctgccagaggtgggatacttgctcacctcttgcccagtccctaacccacagaagtctcatgatgagagaaccctcagcaccctgagagagttaatgcatcatcctttggccccatgaatctgcccagaagccagctgagaaaagaaggtagagaacagggctgagggacaaggtgcccctttatatatttgggtgaacacatttttaaattttcctttcattgtccagtccccatgaattatttatttgttattaaattcaactgaatgagatttcaaagcaacgaaaattgaagttcaaatgaaaccaaattaccactctgagctccaggtggccctgacagcccagttttgtgaagggcccctgaggctgttcactgagtctgagatgtcaccaggcatggagggtctctgatcagcatccagagctccagagtagggagcaacccctcaccaccacttctgggccccaggcaaggcagagaccaaaagaaccctggtaaggttccccaacctccatgttcatttaaaaaaaatgtttaaaactgacaaataataattgcatatattcatggggtccatcatgatgttttgatatacatatacacatatggaatgcttatatcaagatagttaacatatatatcacctcacagacttatgtttgtgggtgtgtggtacaaatatttaaaatctactctcttagcaatttttgaaacatactttacattattaaatatagtcaccatgttgtgcaattgatctcaaaaacttatgcctcctgtccaatgaaattttatatccttgtaccaacatctccccaacccacccccaaccatccctgagctagtctctgcctctgtaattttgactttttaagattctacacaagtgacataatgtggtatttgtctttctgtgcctggtttatttcatttaacacaatgtcctccaggttcattcatgttgtcacaattgacagactctcctgcttttttaaggctgcatagtattccattgtgtgcatacaccacacgtttcttatccattcatctgtggatgagcacagggaatgtttccatatcctggccatccagaacagtgctgcagtgagcatgggagtgcagatgtctctttgacaagctgatttcagttcctttggttctaaacccagaagtgggattgctggatcatccagtaattctattttggattttttttaaggaacctccacactattttccatatggctgtaaaactcacattccctctaacactgtgtgagggttcccttctctccacatcctcgccaacacttgttatggtccacattcacttttcaaggtgaaatccattctctgcactcccctgcttgaaagcactcggcgtcagtgcgttgctccttccctcacttccggaggcccctgatctgaaccttcatccatccctccccacacgggtctcaatttttcctccagcctttcagcctcttttctctccagggactttgcacctgctctcacctgtgcctgggttgtcagtgagctccattgcacccttcattcccagcccagctgctgccttctcaggagagacaccttcccagacctccttcacccacgtgcacccccacccatcagcccctttcccatttcctacaaagtcaggagcattcacatatcacctgttgctcctctacccactgcctcttacctccacaagaacacagcagcagcatgagtggccactgaatctccagcacgcagcccagtgcagggacagagcagtgggtcctgtgtttgctcagccttttcaccagaatgtcaatcacatctgctctgctcaccccaccacactccatgtctaccatcacattctataaacacgcaccaaggatataacgcctggcctagcggttggagatgcagagaccagacctagcctttctgttcctcctcttaagaaactgagcccctcatggagaagtgaggcagacacatgaacataagttttgcaacagaagcacttttcaccaggtaatgctatgggagcaaagaaggaagtaacggagcctgggggaactcaagatgttttctgaatgaacttttatctctgagtaagaaacaagggcgcataggcagagtctgccacccctttctctcctctccattgggcctgtggagatggagtgggcaggcacataatctgtgggagcacagtgtattcaggggagttatacagttccataggtcacagctgggcccagggtacacatgagggacaagccaaaagtgagaccggaaagcgagtcggggccatgccctgaagagcctgcaatgtggacttatcctgatgcatcagtctgttctcatgctgctaataaagacatacccaagactgggtaatttataaaggaaagaggtttaatggactcacagttccacatggctggggaggcctcacaatcacggcagaaggcaaaggagaagtaaaggcacgtcttacacggcagcagacaaagacagcaagtgcaggggaactcccctttataaaccatcagctcttgtaagccctattcattctcaagagaacaacacaggaaagacccacccccatgaatcgattacctcccactgtgtccctcccaggacacttgggaattatgggagctacaattcagatgagatttgggtgggcacacagctaaaccatatcacctgactactgaccttttttaaaactgtgagttcaaaggacctcaaactgggctgtggtgggtgcctgctggtgggtgatgaggaaaggctggtcgttatttgcagccaaggctctggtcacacagaatcagacacaggctcagcagtgagcagccttggcaggcctggaatcccaggctagttgtgcctgtgattggttttgttatcagcacacttttcattttggattcttttggccatccctctcctcattaatgatgtcatcaaagaaggaacagagcatcacctcaggcccggtctctcccacttgccttctttgacacaaatacttctgacatcttagattacgtgtcagagggaacaagggtggagtcaaattcgatcttatgtttttttggttttgttttttagacagagtctcactctatcacccaggctggagtgcagtggtgcaatcatggctcagtgcagccttgacctcctgagcttaagcgttctcccacctcagcctctggagtagctgggaccgcaggcgtgtgccaccagtcccagcctcaaacctaatcttacattgaatgtttgttatgtaagcacacacacagaggtgtgccaccactcccagcctcaaacctaatcttacactgagtgtttgttatgtaagcacacacacagaggtgtgctaccactcccagcctcaaacctaatcttacattgagtgtttgttatgtaagcacacacacagaggtgtgccaccactcccagcctcaaacctaatcttacattggctgtttgttatgcaaaggttaagagctgcaatgtgtacaggcagatgcctgcacagcacaggtccagagccgaagggtccctgagaaaataccacgtgtcccatgtccatgccaccaaataaatacacggtagcagactgttttgatatgtcatgggatctttgaaatatgaatgccatgccttgttaatcatgaaaacaccttctctcatcttactaaagcacgttccaccatgggcactggcccgactttgacagagtgttgaaggaagagcccattagtcctccccagccatatatcatacatgtccaattttctagccactgacaaatgatcttcataaaatatgactaagttgtccaggaagcaaaatttctccaggtctagccaagaacaatatgagaaatgcacaaccccttcccgtccggggcagctgcatttccaagtgattatccatcagctacaggtgacgcatctccacgtggaggagactgcgattccagaaaggcaaggccacatgggttccgtgaggccccgtagaagtgaacgtggcaaagaagggacaaagaagggtgggcaaccgtattggtcaggaatctccagagggacagatctgtgggatgtatgtgtatatgaaacggagcttattagggagaattgtctcacatgctcacgaggtgaagtcccaccataggccatctgcaagctcgggaagagagaagccggtagtggctcagtccaagtccaaaagcctcaaaaccagggaagctgacaatgcagccttcagactgtggccaaaggctggagagcccccggcaaaccactagcataagtgccagagtccaaaggcggaggaaccgggagtctgatgtccaagggcaggagaagctgaaagaagcatccagcacaggataaagcaagaagccagaagaaccagcgagtaagcttatcttaccttcttctgcctgctttgttctgcctgcactggcagccgatgggatggtgcccacccacactgaggatgggtcttcctctcccagtccactgactcaaacgtcagtctcctctggcagcaccttcaccgacacacccagaaatcacacattaccagctatctaggcatccttcaatccaatcaagttgacaactaacattcaccatcacggcaacagaagaaaaattggagagcggggagctggccagtggtgccctgcgaggccaagcaggggtgcacttgtataatttgcacacttataatttgacatttataatttccctcctatactcaatgaggccctcgcttagaggaccaccaacatctaaattcactgcaggattttctcccacaaggaaaacccagatgttttaggagaacctaatgccatcagtatggctgatggaatggagtcgcttcctgcaatgagcagatggttttaggaacaggacagaaggaagaggcttgctgagttgactgcacttctgtcggaatcagctttctcaggagatgctccccttgagctaagcagggcaaccttcccctttgcaatccccacccacagaccccattggagcaataagtattgtgatcagggtactcattggggacagtaattaaatgtctgtttggagaacacaggctccacaaggctaaccaggccaaccctctgaccccacggggctggcctctgtgattcagaatggggatattaccccaggccctcagaggacaccctgttcactgctctcaaaatccgatcgcatgttgagtggaacatgacactgattagtattccataaaatcctgtggatggcttaaagtggcctgattttagagaactatactgtgcatgatgcacattaagagaggaacagcaatgattaaagcatcaggaaaaaggagctggaagcaaagctaagggagctagggttgtctgacatgaaatagagaaacaggaggttttatagttgtccattcagttatcctcttgtgatttttttgatcaatatgaaagtgcacagatatgagacttatcctaaggatgatactaaaaagtatgaaatgtttttcacactcaagccgaggagacaacttgagaacaaggaaaaacgcacatggaagaatgaagtggccatcgaaggggcaagtctgtggctgaatgaggggtccccacagaaactaaagaggggcttggccgggcacggtggctcatgcctgtaatcccagcactttgggaggctgaggcgggcggatcacctgaggtcaggagtttgagaccagcatagccaacatggtgaaaccccatctctacaaaaatacaaaaattagctgggagtattggtgtgtgcctgtaatcccagctactcaggaggctgaggcgggagaatcgcttgaacccgggaggcagaggttgcagtgagccgagactgtgccattcattgcactccagcctgggcaacaagagtggaactccatctcaaaagaaaaaaaaatggaagctaaggaggggctttatggagacagtacaatgtgtaaaggcccatcacccatagagcctcaaagtcctgacaatctgtgagtgtgagaatagcttcatctttgaggtccaagtgcctagaaaatcttggaggaggcaggaaatagaaatccaatgtttactgaatgaatgagtgacgaaggaagaagtgagtaagacagtaggagcaagaagtgttaacattcttttttttttttttttttttgagatggagtatggagtttcgctcttgttgcccaggctggagtgcaatggagtgatctcggctcactgaaacctctgcctcccaggttcaagtgattctctcacctcagcctcccgagtagctgggattacatgcacccgccacagtgcccagctaatttttgtatttttggtagagatggggtttcaccatgttgaccaggcttgtctacaactcctgacctcaggtgatccgcccgcctcagcctcccagagggctgggattacaggcatgagccactgcgcccagcccaacactctttatataaagctccatgcaatgtcctagttacagaatgtaaaggatttttttgcctgcatatttcttgcctgtgacaatattaaacattgctgatcaccccttttctgataagatttcctcactttgctcctccactttcccttctaaatgtcctgctttgtttactcttctctttccattgtgtggaattgtactgatgtgtgctgaaagaaagaaggaaagaaagaagaaagggagaggaggacaggggaagggatggaaggagaaagagaaagagtgaaatcacagatatttactgagctccaggctctagctggatactcgcacagtaaataaggcaggtctgttctcttcgaggtctttccagactgcagagaaagctgcacagacaattttaatactgcgttgtttgttgtggtagaattaagcacaggatgaggctggagtgcacaggatgaacaactgatctgaactggaaattacagaggaagctttccagaacaccacatggcattcaggttggtgagtgtccaactggtcagttagatacaaagacctggagacaagaggcggacctctggaggggtggaaaggccgaagaggtaaacacaggaccaaccacagctccgtgaggggcaccgttggcaggaccagcagcacgctgcacggtcacggggaggtgagcctcgtttggggtcttgacgaggaagggaaggcttcacagcagaggtggttcgaggcctgtcttaaaggcccagcaggctttttgttgatcagcaagtgcagacagaagggaaagtccattttagagaaagcagatcatcaccagcaggtcacacctgtgcggtatgtgcagtctgtgtgggaaatctcctggatggatgcgtgggttaactgctggcgtggggagggaggaggctggaaaggcatgttgggaccagacagagaaagatcacaaaccattctaggggacgtggggagcatctgccagcagtgcggaagccctcggaaggccagagcagatggtcttgccccgagtgtggctccatggaaagggacggagtaaaggaggggagggaggagaggaaggggtaggcttgagagggtccaggcaacaataggtctgggagacggcggaggctccactcactgaaagagaaatgaagtggggcagaggcttggcatgacgggggatggggcgaatcatccagaaaagtctgttgcatgaggcagagagaaacaaaattgctattcaggagctggagaggagttaagaacagaagaaaaggaaacaggcaaagacaaacaggcaggtggtcttcaattctatgtaaggactcagagaataactgggattttttttttcagtgtatgttctaagggactttcagtttgtaaaaatagcagttctggtaaaaaaataaataaataaataaaaaataaaactcccacttctactctggaagttgattttgctctattataatctaatcgaaaccttttctgtgaactccagattcatacatttatttcagtatccaatggcatcttaaactttacaaaccaaacataaccctaaacctgttcctttctcagcattcccaatctaaaaacaatggcactctatacttgcaggggctgggccagaaacctgactgttatgctccctaatatcccacatgtggtctgtgggtcaatcttggcaagtctccttgcagaacacactctcagtgctttcacccaccactgccacccggggccacgccagcaccatttcttgactcgattactgcaatagcttctcaaacaccaacaaccattcatcccagagatccatctcagattaggagtctcttccttcacaccctccagcagccacccagctcactttggttaaaaccaaaatccttaaataaccaacaggcacacatggtcaggttcttctgaccactcctcagccacgatggacttcgtcatgctcttgcacagaccaccctccccgaccaccccagggcctttgcacttattctgtattctcaaaatgctcttcctccagctggctgtggtggttcactcccttgcttcatttagctatttgggcaaatgtgaactttgcaacgtgacctcttggccacacttttaataattttaagccatttccctgaccctctatattcattccctgatttttttcctttataatttatcaccatataacatgtaataatttttactgattcatttgcttttgttccctatgcattggaattcaaagccaaggaaggcaaggttttttgttgctcactgctgtatccaagtgcttaagagagtgtctggtgcctggaatatatctggcattcaatcaatatttatttgtgaatgacgggattattaggaaagtcttcaattttatttttaatatgaatggacattattgcaattccacataaaggcaggataatagagtcgattatcctctattttcctctgagtcatatgagcccctatccttacatggagcaaacctccattttctatcactgaatttacatttttactctctgcaaaatatgtgcctatcttcctaaaaatcataaatctgtccactgcatcagtatattagaacaaatcctgatgtgattgtttgcaaaacaaatttaaaggctctttagtttctgcctgtatgagcagattggcatgatttaaagtgtagacattttatggggcaagaatgagtttagatatttgttttatttatacagacatttagaagtggacatttactagtgcaagtatcattatcaatttctttgcagaggaaaggttaagggagtatatatcactgccaaatgcaatagcgatcatggaggctcccacaatagggccattcctctctttcttctccttcttgacttggatcctgaaatgcaggcaaactatagacatccacccttcttctgccctcagtaacataaagagatggggcacatcaccctgtggcaagcagagccaatccctggagctcaatgctgtaagcaaaaagctgagcaagtccctaggagatctgtctccagaccatagtgtgttagacaaaatctttgtttccttcttggaggcccctctaattacctgcctagacctgagtctcactttattaattaaatctcctgaaactttgtgattttaaaaaagatgaccacaaattctttgatacctgtattcgtccattctcacacagctaataaagacatacccagtactgggtaatttataaagaaaagaggtttaattgactcacagttcagcatggctggggaggcctcaggaaacttacaatcatggcagaaggggaaggaaacatgtccttcacacggcagcaggaaggagaagtgctgagcaaaaggggaaaagccccttataaaaccatcagatctcgtgagaactcactatcatgagaaagcatgagggtaaccatctccacgattaaattacctcccacagggtcccttctccaacataatccaacaggattatgggagctacaattcaaggtgagatttgggtggggacacagcagaaccatatcaatacctctcccttcaagaggtggagccttgtgtctgggctggattttatgaattgctcctaatgtatgtggcagaagtgagtgagcacaacccataagactagatcacaggaaggggctgcgctgctgtctccaccaacctccctcccaccactccctcagtcacttgttctgggagaatccaaatgccacatgatgaggaagggcctacgtggctagcacccaaggcctcctgccagaggccacataagagagcctggacgttgccctgctgcctccacaagcccccaggtgacagctgcctcagccagcactagctgcgtgctcctggaaggcctgagctagagtaccagccagtctgctcccagatccctgctacccagaccctgtgggtaacaaatgtgcgtagttttaagccactaagtgttggggtaatttattacataagtgtctaatttcatcttcaaatagtgataatcctgtattttaaatacataataattctgtttagcaaaatcatctggagtacagaggaattcgatcatctgttttacattctcaagtttactgagcatgtccagtgtgaagccctgtccaggtatgctggagcaatagcgttcaatcagacgggtcctgccctcaaagggctcgcagcacggcgggagagtggaggtgtgccctgcacatagaggcctcggaacaagcgatcattgctgctgctcctgctgttgtcagactcagcctcttctttcatgggatgggccaaaataagcccacttctgagggtgtttgtaggaccctggctttgtaaactctggtaggagactgagtggccgcctgactgtggatatgtagttggctggttccaggtacacccaggctacagcaaagggagtgactcacattgcaggaaaaactgacgagactgctaggaggccagcaagcggaggctgggcatcctccaaagcaggctgtgcagtgtggagacaggcagctgcagtgaacgccaggtccatcccatcatctctacctacaaggggagcacacggtgaatacccaacaaaaccgtgggtctttcctctcagagtctgatccatttcttgagccagccttgctacacaaccataactactaatacctggttttctaaaaatataaatcacgttgacctttgctgttgttgttataaatataattgatgttaataatgaaacatctggaataatatagaaagaataaactagaaatcatttaatcataatttcacacacagagacagccaatctagtatagtcattatactatttttactagtatttttaatctattatttataagatttggtctctatatgtagttttagattttattctcccactgttttcacttaatgttgtaatatagagattttcttacataataaaaaatcttccaaagtatgattttaattatgaaatattttattatgcagacatagcacaaataccaagatttaaaatgttttactttataaaccaaaagcataaaggtattgcctcaatagcaccttatgcacactagcgatttccttttactgacttgcttaactgatccataatcattcttatataaatacccactgttggcatttacctcttgccattttctagaactggaattaccaggttgataactggagaactttatcaagttaactcaatgtccctgaaaaatttttcttatctgtataaaggggacatgagattatttacggcatttcactataatacacactaagttgatagcatgggtagataaatctttgtgtgcataaaaaggcacagtgaggacataacccagatcccactcgctttccacgacacccagctgccttcttgttctaattcatgtaaatcattaagggtattttaaaaggttctaatgttgcctctgaagtcagccccacccaagctataacctgggcaacaggggaaaccgggggcgatgtcacacctcagctctgttccttccccttcccagcccgcagctcctgggagagaagcagaaatccagtcccctcgactccctggtctcgcctggaacttagctctcacctgggactcagctcccagagtgaaagggattgtcctgtagcgtgaacgatgagtgacacccgcaccctcccttgtaaatctgctccaacaagctctcctccaggacgctgtcttttctgtgctatcgagcacagccctgacattacagctggccttgcagacatcaccagacgacacccaagaaaaatggcagcgccagagccgtgagcatcacaggaggtctcagggacacgccaaggccgcctcccaggaaaaagcagaacaccggaaaagaccttgtgaagacttcttatcttcccctccaaatggtgtctcttgctttggctcttgtcgagttggggcttgttggaagaccaggtgaaggcccagctgctaaagcttcccctttctacttcttgttactctattactcaattaggactggtgctgatttaggggaaaaacattatttgaaaacacagaggttccctctgctttgatcctacacaggcagagatatctccaagcagagagatccaaaaaagagcgccccctgcgggaaacgttcttttaatttagactttgccgttcctcctgtggagacgttgtcacagttacagtagtgggtgatacatccccaaatttctgccacgtgctcagagagctaaggcatatcccacacccacgacaagcttacaggtgtgaacctgggtccaggcaggtgccctgttcctaactctggtcttggacgtgtgatttaagccaggcctcagtttccttgctcacagatgtggatcccaggagctgcctcaaatacttggaggcatgaatggttctaaatcacgcatgccatgcctgacacattaaccccccattctcttcactgtgcagggtgaaacaacagacagcaacccagcctgggcagcacatgtcctgcacctgggctgtgcagatactgagagcttcctgcctggagtggaaattcctgcagcatgcatgcagaaaggagatggccaggaagtcccaggaagatgtagaaagtagaaagggaggcaagagcgaggagttctcatttgggagaaaggctcaccagtgaggcaggaagtgacctttggaaacatgcgagaaccaacgtgcatgggtcctcaccaacttactctcagcagcgaggcctgccaacaagaaggcataggctcaccagctgcacacggctaatgctcacccagcaccaccctgcctgtccgtgcatctgctgtgcacgtcagaggtcaactacacgtcccagtggtagccatatgaggacagtgctggtcccagagaacaacactgatataagacccagagactggaaatctgccactccacactccttccctcagagaaggtaagaaatgagaattttataccctctccagctctgaacatgcctcctagccatgcctcttcttcacaactgtgagatcaccgcaaacataattcagcacacagagcctgaatccttatttccagataacatgagcagaaacatgcagctctctctgcgccgaaccaagtcccagtgactatatcacaccacaccaaatcacacagacgtggaaaactccaccagggccagcactcttccctaagaactcaactgcctgcatgcaacggtgctaactttcccttgaacaatccgacagagccgcgtgttgatgggaacgtcccctgacctttcaatcaatgtttatgaatttgtatcgcaaagcatcccgggaaactgtgcatgctaactggcccgaggatgatcttgcatctattatgaagcgaatggcccattcctcaaggaggagttctcccggggataccgtctgtctagctaggattcaatatacatattttgtatacctgtattttatatagataatttctaatcattttaattgttcaacattcttaccccagagcctcccttttcagacttagaaattgctgcagaaaacctcattcttctatgccagcaggaattaaaggaaacacccttggcccaaacatgaaaggaactttaataggaaacacactgtaatgggcacacacaggacccagggtgggaaggacgcgtggcgggatccccctacccacacccacaccacacgtgccacacagccatgccgtggctcatcccagggttctgccgatcagccaaagcgcctccctgcctcacgcctgcatttactaacttcagaagacaggactaccaagtggaaagaagttgaggtagggagatgtagtggctccaagtggtgggggcacagcctcaacagaagtttgtgtgtgtgtgtgtttgtgtgtgtatggtgtgtgtgtgtgtggtgtgtacagtgtggtgtatggtatacagtgtttgtgtgtgtgggtatgtatggtgtatgtggtgtttgcatttgtgtgtgtggtttgtgtgtggtgtatatgatatggtatgtgggatgtgttggtataatatgtgcagtgtgtgtggtgtgtatgatgtcgtatgtggaatgtgtggtatgtggtgtgtgctgtgtgtgtgatgtttgtggtatgtatgatgtatggaagaagtgtggcatgtagtgtgttatgtggtgtatgtggtactgtggggtgtgtagtatgtgttgtgtgtggtgtgtatgatgtggtatgtaggatgtgtggcatgcggtgtggtatgtgatgtggtatgtggtatgtgctgtgtgtggtatgtaggatgtgtgttgtgtgtggtacatgtggtatgtagtgtgtggtatgttatctggtgtgtgtgtgtgtggtgtgatgtgtaatgcgtgtggggtttggagtgtgtgtggtatatagtgcagtgtgtgtggtgtgtttgtgtgtgtgctgtatgtgtggtgtctggtgtggtgtggtgtgtggtgtgtacagtgtggtgtatggtgtacagtgtctgtgggtgtaggtgtgcgtggtgtgtgtggtgtttgtgtttgtgtgtgtggtttgtgtgtggtgtatatgatgtggtatatggtgtgtgtggtatgtgatgtggtatgttatggggtgtgtgtggtgtgtgtgtgtggtgtgtaggatgtggtatgtaggttgtgtggcatgtggtgtgttatgtgctatgtgtcatgcgtgtgtatgctgtgtatgatgtggtgtgtaggttgtgtggcatgtggtgtggtatttgatgtgtgtgtatggtgtgtatgatgtatgtaggatgtatggcatgtggtgtgttatgtgctgtgtgtcgtgtgtatggtgtgtatgatgtggtatgtaagttgtgtggcatgtggtgtatttggtgtgtgtgtggtgtgtatgatgtatgatgtcatatgtagcatgtgtgttatgtggtgtgttatgttgtgtgtgtggtatgtggggtgtgtattatgtgatatgtgtgtgtggtgtgtgtgtgtggtattcgaaggtaagagtggtgcttgcctcacctgcccatgtactaaagttggaaatatgtggagaagctcagcatagccatagctcttgcacaaggtgatgcaagctcacgacggctccatattttcgtagaatgccaactgatgggcacagatggagaaatgaaattagaagattgccatctgacaaccattgtaataatacttgacttgggtaagaatcatcaatgcatgcccaaactaggaggtgaaaatttgatgagtcaaaagatatgaatatagtccgaaaaaatcgccccacaattacttgttcatttcaaaggaaatagagcaacctacggtgggaaaaccttacagacaccaccttaaataagatatcaaaatgactatccccagcaggacacactgatatcacgtgcctcttgatatgatgcatggcaaggacacaacatcacttctctaggattctggccaaaattctaattatgaggaaacatcaaacaaatcatagtgatgggcactgtacagaaaacctgttctgttctgaaaaatgtaacggccataacaggtaaagaaagagggaagaaatattctagttgaaaggaaattaaggagacagagcaactacacacactggaggcctgggtggatcccagaccaaggtggcagtggtccacagtgtgccagggagcaggtgaaactggaatgttgatgccaggttagacgccgatactgtgccaactgcgaatatcctgattctggtcacggtcctgtgcctctgtaagaaaatgctctttttattggtaaatacagaaagagagaaaataataaagtaaatggagcaaaatgtaaacaattggtcatctgagtaaaggatataaataggtcatagtatttttgcaactgttctgtaaattaaaaattccacctaaataaacagatacaatacacaggtgggagagcaggtaggcagatggtccagtctgtgagaacccctttctgcataagcacagctcccacccctgatgtcatgtcatggataaataaatgcaacatcctggaaattgttgagaaccaccaagggtcagccagcccatcatcccaatcactgtgatgtccacacgtcctagatgaaactgatgtgagatttttgcaaaatcctgccttttctgaaccttgctttggacagtttataaaagctgcacgatgaacaaaatgctgggtagtgaatgtccacatcacctccttgcgttactgacccagtctcttcatctggtacatcgggagggtcagcagaggcagtgacaccgccctatctcctaaggccatgtggtgagggggggaagaggaggtgaggaaggcagggcagggggccctttcttagggaccttatcctttctcttagggacccttgcctgtcagattcaccagcttctgctctctctctgtccctcaagcaaaaaactgccattgttatactgcgagagactttctcaaatgcttctgacgggacataactaacacagcaggctctctgctgcctacaaactagggaacacattttcttcctacaaggagggctgatagaaacttttcttctgccagggttacaagaaatgcattcagataacccaggaaatagaaacatgcccagctatgagaagctataagtctgctcaacagaaagccatagaccgctcaaaatacgtaagcccttggctgctggactgagattctacctgcacccctgaggaattgctggaggtttctaagcaggggaggtggaggattcctatttgctgtgagtgcccactgatcacaggctctgtttctttcttgttcccttcaaggttggctcagttcttctgggaacctaaaggcttcccaataaatacgactgaattgcacagaatttatttatttatttatttatttattttgagaaggagtcttactctgtcgcccaggctggagtgcagtggcgcaatctcggctcactgcaagctccacctcctgggttcacagcattctcctgcctcagcctcccgagtagctgggactacaggcacccgccaccacgcctggctaatttttttgtatttttagtagagacggggtttcactgtgttagccaggatggtctcgatctcctgactttgtgatccgcccgcctcggcctcccaaagtgctgggattacaggcatgagccaccgcaaacggcccagaattgaattttgaaagtagccacacaaactatttatggctccaggctaatatggaaaaagcttaaggacagtaatttaaacaaggtgagtaaaagccaaggattggattcagcttttcttaccagttccacctggggtccctggtgccctcaacaacccactgaacctctgtgcttctcagctcaacggaccagaagcagcaagtccagcctctgcaggcgcctctatgggcaatggtggtggtggtggtggctttgtattcccaaaaaaatatactttttgatacacaaggggtctgtatttaaaatgaaacatttttcaaggttttattcttcctgttatggatgggaatacaaaccttagatttcaaaacatacttctcaataggcatatccacatattaaactaaatgcaagaggatttaaatgtttcaagccaattagcaaccggatcctaagctacacagaacctgaacctttgtttgtggaccaacagcatcttagctccttggagcatgtggccagttggctcattgtatgaatttgcaggtcgggggatagcattaccacagcctagagcagaaaccccctccccaccagcagtgagggtcctcgaagtgtgaagactgggaaagatgaaggctactttgctgctcacgacccaacgaatggctccagagactgagatccacacagcacccgcttttgccaagttccatggccccatgcctggaagagtctgaggaactgaggcttccaaggcttgctcatcacatcttcacaggcatagaaatggaggagaagaaaggatgttttctttcttatagtatttacaacaaaatagtctggtctcacttgaattcctcataataaaacatatggtcttgaaccctatgccagcattggaacctctaaaggtggacagggcttaggatgctccaagaacggcgattctcacctttggggttctgacacttgataattgtgctagtgaaatctgctactgataatgattaaagtctcgctctgtaactaatttatttaaaaaaataaaccagagaagattaaagttgatacctcagataaccacattctgatttccttgcatttcacgtcgatttcatgagtggggtagagttttggtgcctgcgtgaggactgccgtgggaatgagctgtggatgttgtgggtcacggatgttgtcagtcagtcgtgtgtgtggagcagcaaggcagggtgagcctctgattagtgcaagtcacctgctctgggacaggcactgcctttgatactttactttgtggtctcatttaacacccaacacagtattgtgagacaattagtattgtcctcactttactggggagaacggaggggtgtggtgagttgagcaaagccattaagttagaaaatgatagaaccaggacttgggttaaatctacctagttctaaaatccacattctttgctgacccctcactacctccatctgaggcagaaatcccctccctagcattggcaataattggacagcagtctctatttgaacgtcttaaacgaaagaaaaaaatcacaattcctggagactcgcattccacgttttgaacacttctgatggaaatgttggacttgcattcagctaaaaccctctctttacatcccttcagttaatccaagttatgctgtcatgagtcactcttcagaaatccaattctgcttctgtgacatagattctgaattgtctgaggacaattttgtagggcacacaactttagtgttttcaactacttctcactccatgaggtcctggctctgtgacttccgggctggacgtgctctgagccacatccttccagaggacagggcatgctctccactgtgctgcctgacactccagccggagccgcacgtggctccagttcatctgaaatgtggccagtgccagagcaactgttttaaattttcattaattttaattacataaaatttaaatatccacaggtggttagaggctactgtatcagagagcacagacccggacctcctcaggaaagcacgagtttctcttaaaaatgtgtctcctagaactgagcacagtgctccagagataactggtcatcactgtgcctctattctacagactccatagcactagctgcccaggggccacatcccccagtgacccatctcacactgagactcaactgtaacctgtaagacctttgcacatctgctgctatcaagtcccatacctcccatttttacttgacttccccaggcaggaacttcagggcttccaaacagggtttagatgaaggaagtaactagcatagctggggagagttgcctgaattgcatggacactgatgagcagggaacggggctcccgcaagtcatggtgtttggaagccaataacccttgaagatggagttcaccatacagcagttctcagaaagccaccagtgtctcagaagagagggcaccgaacatctcagggaagacggcaggcatcgtggctggtgttgccacgtgatgggccagaatggaatgcagctactgcagcccaagccccactgggccagaagtggggatgttaggcaggcagagagcacagcccctcccagagcaaagccctaaaagatagtcaaggactctgctaggccaagtggatggttgtttccgtttcagccaatggtgctggggcaggtgctgtgccacgaggggcttcccatcactccaccactccaaaagtgtggtcacaagactggctgagagggtagattccaatgagggacataagaatctgtcctccaccccagcacacccaggaagacaagaggcacaagaaccaggctctgcagcaggtctgtgcattcagtgaacacccgatgaaatttccaacactgcgcgaagtgcatttttggcatttgtagaaggtggcccctgttctcaggatgggatgtcactccaatgaccttgcatacatgtgtgtctatatgtctgtatttaataatccccaaatgcagtagctttgggtaataaatacctgtgagtttctttgagtaccaccccatgtttacttgaccactgggctctaaaatttaacaaatcctcagagaaccatgtctggctagaaaagcaagaacggggcagcaaaggaccagaggaccttttaaactaagagccttcattctctcttggcttggattagggacggacagagagaaacaccagagaagaacgatcactcactgttaaaaaggctctctagctgagtgtggcttttagtgagaagtgtccttccaaggtccctagcctgcggctaattctctcctctgttcttacactccatgtttgctcccagctacgcttgctctcactctctccctccaacccatattcagtccttcttcagctgtaaagagcagacagagtagtctttgaaaagcacagttcagctcccattacttgccaatttaaactcttcagtgccttcctgctactcttataatgaagctaaaatctgtgccatactctgcaaagtcccgagaggttggtgctgacacctgctcggcttcatctcacaccactcctttcccttccttgtgtgccagccaagtgggcattctgtcagccccgtgacactccctcctgtcccacagcctcattcgagctgttcctttgcatggacaatgttctcttctgttccaaactagtgagcacctactgacactttagctgtcagcctatacatccctttcttgggaaaaaaatatgtaacatcaccctgcacctcattctcagcagccacatcccactcactggtctccctgaaccacatcatttcatttgataacagtcctcagatgtgtaatgttatatgtatgggtgagatatttaacagatccctggcttcttcactgggcccttagcaatatacaagtaggctctactttaggaggccaaggcaggtggatcatgaggtcaggagtttgagaccatcctggccaacatggtgaaaccctgtctctgctaaaaatataaaaattagccgggcgtggtgatgggcccctgtaatgccagctactcaggaggctgaggcaggagaatcgcttgaacctgggaggcagaggttgcagtgagccgagattgcgccactgcactccagcctgggtgacagagcgagactccatctcaaaaaaaaaaaaaaaaaaataagctctgtggttgtttctgctcactgtatatctgcagaactgtgcctagcaactggtccatgctcagaaacgagccctgaaatggaacatcgtgtagggcagcagatggaacagaatgagaaaggggttgtgtctgaggggttggtccaagtgccatgtggattcaccagggctcaccacagtgcccttcctgctgctgccactttctttatgggtaaagtcagtcctgtgtcagggccagcacagcatgaaagccaaggaaaaacacacctgcagcctctataccctgctcggcatgctgtgttttcctccttctttagttacagtgctatggctcctgtgtctagaaagtttctccaagttgcctaaccctgctcacccagggtctctgaatttctgatgagctatgcccttctcatatttgtattcattcatcttgacctgtctcaggtccattggattccaaggtctttgggagaaataatcatagagaatttatgtctctatctctaaataaccaggacaatgcaatgttttcttaacaccttcatcaaaggtctatattttgatttggcttagaaataaatgctggctgggtgcggtggctcacgcctgtaatctcagcactttgggaggccaaggcaggcagatcacgaggtcaggagttcaagacgagcctggccaacatggtgaaaccctgtcttactaaatatataaaaaattagccaggcatgatggtgagcgcctgttatcccagctacttgggaggcagaggcagaacaaccgcttgaacctggaaggcagaggttgcagtgagccaagatcgcgccattgcattccagcctgggtgacagtttgagactccatctcaaaaaataaataaataaaaataaaaaataagtactaagcatactaggaaagttaaagttgcaatagaaagccatggcttcttttttaactctcagttttttatgacataatttcagggtcagtttctcaattcccttctgccttaacttctgggactcgacataaacaacatcacagttccagaaaacaagtagtacaacaaagaacttactgtgttcgttcagcaaactttaaaaacttacttattaggtatcacatattttctgaaaataatagacattaaaaagaagtataaaatgcttactgtctagttggcgagatgcattaatgactaatcactatttaagagatgtcagaagacagtgaacggtaaaggccaattgagtacaagaggcgagagagttttcagttcagatgaggtagatattactgcagaatgtccggaaaagcttgagagcagcgatggggtattctttgggatggaaaagaagttgagaattggataaaatgaaatataaaagaacattccagatggagaaactatatcagcccagtgtgtaggctaagtcagtaactgctaaatgcctgtccacggattgctggtctttaaagaagctctttttttttctttattctttccctttcttactctagggataatgaagctcttctgaatttgtggcaaaattaaaacaaaagaaaaagagatacaacaaggttttataaatgcatctttttttttttttttgagacggagtctcgctctgtcgcccaggctggagtgcagtggtgcgatctcagctcactgcaagctctgcctcccgggttcacgccattctcctgcctcagcctcccaagtagctgggactacaggcgcccaccaccatgcccggctaatttttttgtatttttagtagagatggggtttcaccatgttagccaggatggtctcgatctcctgacctcatgatcctcccgcctcggcctcccaaagtgctgggattacaggcgtgagccaacgcacccaaggcatctttttaaaattaaggagccatgatatttgttctgaaaatgtttttcccactttttgatgttaaaatgtccttctgcttttgaaattacggtgatagaaatggcagttggtatttttttcaagctagatcatcaatttgttgttaggttagatcgcctctctccatgtaccattaaaacagaaatgctggcatctacacactaccaggggacctacctgcagccagggagtatgtgtttgcaggatgaggctggaaaggcggcttggttccgctcatgaacatttagaccaaggcttcccttctcatgctagaattatagaaatgcttttgagaaaaatgtgacatgatgaaaatggagtttgggggacacacgcagtctccttagaaaatatcacttgcagataaatcttgagaacccttgtaagtctatttgttcttttcaatgttatttttaccattttcctcctgctaaactgaaaccagcatccctcttcattcttctcaatgggcagaacccaagctctgactcctttggcaccctctggtgcttcagaaagccctgagctttgttctgaggcatgagttaaaatctctcctccagtatgttttctagctgaatgacaaattcagtttctccaacttcaaaccagagagacttagatggtagactctgcacagaaaagcatatttaaactcccaagcatcttatgagttatactaggcttcttgggacccctcagaacactgctccatctcaattctagcccccaaggtttaggtgaacctcacgattcataaggcagctgttctcccatttcccacacttcctctcaatacctgtgattcaggaagaacatggaaatatccatgcctgtcttaatggatgaagctaactgcaccaagagattggagcctgtcccaggaacaggctggaggcactgcatggaacctgggattggccgttccctcctcagggctctcataggaagatgccttgggcatgcatggctggtgagaaaacatgagatccctgttctcttctttctcctttatttgaaacagctgaagctaagtccctggagctgtccccataaccatctatacctagacctcagtcatgctgaagagaagtggtgctcagcattttgagctgtggcttagggtattaaaaaataaaaggaagagaagggaagagggcatgatggaggcttgggtgaccaggaaccagagactcagaggtgggtagggaggatggcaacgctattctccttcagaacttccatgtctataggcctctttcatttcctggtacctgaagagagataaacaagaggaggaaagacactgggtattctgcacagagtctgccaacctgagtggctgggatatttcttctgcaaggagggcttccatgggcttctgcaaggagggcttcctcatcccttagaacaggtagtcaaaatgaggcccatgtagcagcccagtgcactgcaaagaagcacaacaactaaccaactcctcgctaatccaactagtcaattaaatgataggcataggccgggcacggtggctcacgcctgtaatcccagcactttgggaggtcgaggtgggcggatcacgaggtcaggagatcgagaccatcctggctaacacagtgaaaccccgtctctactaaaaaatacaaaaaattagctgggcatggtggcgggcgcctgcagtcccagctacttgggaggctgaggcaggagaatggtgtgaacccggaagacagagcttgcagtgagctgagatcgcaccactgcactccagcctgggtgacagagtgagactccgtctcaaaaaaaaaaaaaaaaaagaaagaaaaagaaaagataggcacacacagcaccatccttcacagtgctctgtcctttaatactcctcaaggcttgtggaggctgactttcattaagggagttctaggcggcagcaggaccagcactagcaaacttgattctatcagccttgaaatgcaaactgagccattatgctgcctctgacagtggaggaaggggtgagggtccacaggcggttgttacctaagaaaggaatggcaactaatgcttagtgggccccttctgtgagccaggactttctgcacttcatgtcgtttaatggaactgggggtgttctttccattcctgaaatgattgtgttgttgaaattaggtgacttcttgccactcctcactgcaataactgggatttgactctcagcggtattactccaaaagccatgctttcctctccatcctctccataagttcagtgtttgaccctggatcaattttccacctttccctggattttgttttctcctctataaattaggatgtatggagaataacaaaacaacccctatgatacaatggctctgaagatgaatgtagaagagatataaaaggacttctgcagagttctacaactcaggcaggtgaaagtatatattaaataaggtttattcattcatttattcagccatggttgagggccaaatgctatgtgactctctagggggactggctccaacccttgagcaccatctcccgtagacaatggaacccgctgtccctgtgctgctgtgttcacatgcagagtaaggttctaagagggttgaagtcctccaagcagaccacacagtccaaggcagtctctgatgttttgcagagaaaggtcactcaagttgatttctaatatgaatcagtagggagacgtccccaagaaagaggtggctccagaaagccttcagtaatgaccttaaagtaaacatccattttccatcacatacactcagttgccacaggatccataacatacaaccttatttgctaacgtcaagagctgtccctttctataacaaactagaactgcagaaagacacgttcccttttacaattagcacttggcattgaaacacactttctggaggttttgacatgtctctaaatggcaactctagcagatatgtttctccccaggtagtaacaagctattaccacgctcttgacgtcccttgattttctctcctacccacatgaatcccaccacggatcatgaaccaaggcccgcctttcctaggagccttcattgcccagcctactccatgccacagtgaccgctccctcctccagcttctaatggcacaggtggtggggagggagcagaggaaagggtgactacatgtcctcattttgctaggagcattctggtagtgtatgtctgttgttttagcatcattattaatagcacatctactctcaaaagtacgctaataggatgatgttatgtggttttccatggcacagtgaatccaccctggaggcctcagagtctaaggtgttgcaaaggcttggccctttctacattcctgtgcactgatcacagtgcataggaaagagaggcacaatgcttcaaactgctaccaagcacactcatcccccacagtgggcctcactacagggcctttgctactccatcctgctctctgccccagcatactggctcattcggactaaccacagctgatcagggtctaggtcatgctaagtggctcaagcctccatcaacaccctcttcccttgtctttctattttttaataccccaagccatagctcaaaattctgacaactgcttatttgcaaaatttccaagatctaggtatagatggatgtagaaacatcttaagggatttagcttcagctgttttacataaagagagcagaaggtaatacacatctcatgttttctcagcatccaggcacacccaaggcatcatcttcccattagagccctaatgaggggatggccaatcccaggttccatgcagacctcctagcctgttcctcgaactggctttgacctaccagccagttagcttcatccatcaagacgggtatggatatttccactgcatgtttcaatcataggtattgagaagacatgcaggaaatgggaaaagagctgccttacactttgtgaggtttaccttgtgttccatgaaaggtgaacttacagacggaggtatgaccttgggtggcaccaagacaggtagatctctgcactcttactcccagacccaaggcttatataccatagggaaaagcatatgtgcttcagcaagacaattaaaggcaatcctctagcacaggcaggaatggtatatgtgtcatagcctgtaatttgtgcaataacatcaaggccgctttggtctaagggcaggatccatggtgagttaaacattcttacataagagaagtaaataaagtagaattcttggaggtattcccaggactggggttaatcagaagtcaacatggtggattgaagtctgagatgtcactgtcaactccacacctagatcttggatgctgattaagtaggaacctgggagcaggattagagtcaacagccaatcttctgccaagctcctacttcacttaggccaagggatgcgctggcagtaaatgaggtagggtcagagtattcacagcccacttcccactgtgggtcctcttgacttcccttgtactccttctccatgcaaagtgacctttttcataacatgttccacttctggcttctgatgacagctcctgcacatcccccagcctgcgctatctcgtgtggcttcccagcccgcaagtttcaaattgtatttggtgcctttcttaaacttccttgaagtcttcttatttgggagccccttctgtttctccaggtccctgactgacacactatatcacagaccaggtccattctccaggtcttatgtttgcaacacaaattctaagtcccagagaccaactgtgccattgtgcagttgtaaagactagagcagagcggggcaagaataggtagcgcaggtgggccaggaacatcgaagggtccatctgggcatcagggatcctgcagaggagcaaggaagtccagactctgattgtcagagcagtcttccacggtcacctgtctcctaaccccagcccaatttcattttccagcctctgcccacaacacttccccagcacaccctcccaaccctggcccaccagtctgttttccacctcaaaggggccatgcttgttcctttcacccgttatcccccatctctacgtccccagaatcactcactctagaatccttccagtgaaaaccgcaggctccaccttgcctctcgtttgaccattcttgggttttcagggtgaatctcttcccttcaatagctcccacccttcatttgcacagtacgcagtatttaacttttctccacaggttccaaaggctgatttcttgcaagcaaaggccacctgatgtgtctttttttacaaatctctgctgaacaggtaacaggtgcccaataaaactttgtgagttggcagtctaagggcatctaccctcaaaacagctaacgtagcattttatgggagtggaaacggagtcgtgtggaaagacgaccaggcactttcgtttttgagatggagtctagctctgtcccccaggatggagtacagtgctgcgatctcagctcactgtgggcatgcaccacaaagcctggctaatttttgtatttttagtagagacagggtttcaccatgttggccaggatggtctccatctcctgaccgtgtgatacacccacctcggcctcccaaagtgctaggattacaggcgtgagccacaactggcccaggcattttttttttttggaaaagaatgtattttcacttcctttgagataccctcaatgttttgaatttaaaaaaatttaaaaaatctacaatcattttggaaggaaaataaaatagggtttgttttataaatcattttggatgaatttgtttctccaaaattaaagtctaaaaccaggtgggtttccttgattccaaagcttttcatgttctttcgtgtgtcaagcgaaaacacagttgctatggcaaccactcattatttttcaggagttggctagatattttaacaacaaaaaaaatccccaaatctttctagcctccaaatattcttaatttatatcctacagtggtttctaattttcatatttccttcactaagtgctttgttgagctctaacaagcctaaccaacccacaactttgtcactaaatgagcttgggaataactcagttgctggctctctccccatattgttcgtatctaagagactttcaagattttctgacattttggaatcttgcttcatcttcaaggtgaaagatatatttgagtttagcaatgccttaaaatggtgtgtgtgtgtgtgtgtacatatgcactgaagtttgaaagtcgtaatataaattgagaaaacaaatattctttaaacattctatattaagccccttttctgtgcttttttcagaatctcattgtggtgctaaaatttctgaaggattcaatgaaagcagatgacaacacaactactttcagcacacttaatgtctgcttggaaaaagcaaatcaaaacatgaaagagatgatatataaaatacagtcctgaatgcattcacatgtaatttacagagagttgagatcatgaaggaaggaagtagacactgtcggaaatatctaagtttacagaggatacttgtacagccagggttttgtgaaagaattaataacagaagaattatatctataatctattggccgggagcagtagctcatgcctgtaatcccgacactttgggaggccaaggagggcagatcatgaggtcaagagatcgagaccatcctggccaacaaggtgaaaccccatctctactaaaaatacaaaaattagctgggcatggtgatgcgtgcctgtagtctcagctactcgagaggctgaggcaggagaattgcttgaacccgggaggcagaggttgcagtgagctgagatcacaccactgcactccagcctggtgacagagcaagactctgtctcaaaaataaaaataataataataataataataataataataataaaatctataatctatttaaggttctcaacagggccattctacctcctaggaagcatttttgaaatgaggagtttttcagttgtcacaatgaatcctagacttcactggcatttggggtagaggccagggggctggacaccctgcaatgggtagagatcctgcacggtgagaagtgtaggtgccccacatcccagttttcaacagactcattggaataaatccacagaactataaataaggagtacttcagtacataatgatactgaaagtttttatgggatgaaaaataaagggtccagggattcaggacaagctcgttgcagaggtggacgctggcttcttaattctacacattgtgtctattattgaatatggtgtctatggagtattgtgtctagtgagtattttataacccatccaactacaaagttaattggctttagtacagagttacaatcactacacaaacagtgcaacaatgcaaaggcattttaaatcaccttagtcaaataggaacattcttagaagcaaacattatttttagtgcaaacacatgaaacatagaggtcttaataaagtttatcaaaagcattgttttaaaacattttatagtgtttcctatatgcttcacaattatagcaccagaacaagaaatctacatggtaaactttaagtattgaaattatttcctggagggaggaatctgtgttttttcggtccttttctgacactgcccccaggatcttatcatacaacttctctagagacctatttcggtttctgtttcaaagagctgtattcctcattaagtatcagaggttacagtttacaaggcatttattaagcactggagactgagggtacaccttgtcaggtggtaggatcccagggacacttcattccccccatccatgtcataatttgtttcacgccatgcttaaaaagaagaagccacacctggctatcagtggagaatctcacacattttctcctctcaatctgtgatccaccttggtacgcatcctgtatttcaaatggagtgtgtccccattttcttttcattttcaaaataaaactaatctattattacttaatctcaggctttattctaaggttcttctgtattatctgctcttcccttttcctatattttttatatggaactatttctggtctgctttttaaaaatttattatttatttttgtgatggagttttgccctcgtcacccaggctggagtgcattgccacgatctcggctcactgcaacctccgcctcccaggttcaagagattctcctgcctcagcctcccgagtagctgagattacaggcacccgccaccgtgcatggctaatttttgtatttttagtagggacagggtttcaccgttttggcgaggctggtcttgaactcctgacctcaggcgatccacctgccttggcctcccaaagcgctgggattataggtgtgaggcactgcacccagccttttttttttaaaaaaaatattttaaacccagttttactctttacacataggaagaagcttctgacttcatcacagatgtcagtgccctagctgcagaccacctggcaagcaggacctgagcagtgacatgctgaaggacagataactggattataagttcattcctttatttagcctatatattgaaacttttaaagtggtatatgcatatacgttttatcacctatgaatttaatttaaattaggaaaggagcattaaaataatttgccaaaataaggaggtgtaggttctggtacagttgagagttattgtctatttcaacacatgtatctcttttttaaaaatttattttatgtttatttcaatagtttttgaggaacaggtggtttggggttacatgggtaagttctttagtggtgatttctgaggtgtcggttcacccatcacctgtgcagtatacactgtaccccatgtgtaatcttttatccttcatccccctcccagccttccccccgagtccccaaagtccattatatcattcttatgcctttgcaccctcatagctgagctcccacttaaaagcgagaacatacgatacttggttttccattcttgagttacttcacttagaataatggtctccaactctgtccaggttgctgtgaatgccattgtttcattcatttcttatggctgagtagtattccatggtgtatatataccacattttctttctctactccttggttgatgaacatttaggctggttccatatttttgcaattgtgagttgtactgctataggcgtgcgtgcaagtgtctttttcatataatgacttatcttctgctgggtagatacacagtagtggggtggctggatcaaatggtagatctacttttagttctttaaggaatctccacactgttttccatagtggttatactagtttacattcctacaagcagtgtagaagtgctcccttttcaccatatccatgccaacatctattattttttgattttttaattatggccatttgtgcaggagtaaggtggtattgcattgtggttttaatttgcatttccctgatcattagtgatgttgagcattttttcatatgtttgttggccatttgtataccttctttttaaaattttctattcatgtccttagcccactttttgatgggattatttgtttttttcttgctgatttgtttgagttccttgtacattctggatagtagtactgtgtcagatacatagtttgcaaatattttctcccgctttgacaacacatgcatctcttgatttccatttcttttcaagaaaatagtgacttgcttatgaaaggcatataccaatcataaactgagctggaactctcagcggggtctttatcctccctgccctggttcttgacactcccctccctgctgtggctataaagcttcaggcccagggagtagccggtgtgtctcttatgccaattcctcttatgtgactctttcagcaatttaacctttctttttctattttcttaaagcattaaatggagacctataaatgttacttcatggatagctgcaaagattaaatgaatttatattggaaagttgtttaaaacagcccagctggtaacaagaactgtgtaagtatgaccaattgtttctgtttggtccattgatctacttattctgtctccacatccatgtggggtatagtcatcagaattactaagactttataataagtgccatctagttagacagaaatgttcctcttcatgattgtcttgttagtcttggtgttttaatgctttcataatatttgctcctacctattttactaattaatatatgcagaaactcacaactcacacagtacagatcacataaaatatcatcttcatccttcccaccctatttccccgaaggttatgacatgcacctgttgagtatatatgttctccaggtctctttctctctctatatatctacatatctatatacatatatatagatatctatatagatatctatatagatatatagatatctctctatatagatatctatatatatctctatatctctatatagatctctatatatctctctatctctatatagatctctatatatctctatatgtatatatggagatacatagatagatagatagatagatagatacatacatacatacatacatacatatatattttagagacagagtttcactcttgttgcccaggctggagtgcagtggcacaatctcagctcactgcaacctcctcctcccaggttcaagcaattctcctgcctcagcctcccgagtagctgggattacaggcacccatcaccagacccagctaattttttgtatttttagtagagatggggtttcatatttatttaaaaataacttacttttaaataaattaagcaacagcaagtttttccagacaggaataccaatttctccttaggatctttaatgccaaggatgtaaaactaatggatgtggggagatttttagctaagaaatgaaaggttttattctggatcttggcctttacacattgcaattattttgctgaagttcattcatgtattaatcgcgatgagtactgagaccctatcttgtgtaaaggtaagtatggaaaagtactcatccttgagtcttctgggctggtgggcacggccgacacttaagtgaataactgatgtataaaacactaagtgtgatcacagatataggtccaggggctgcggaacaggagccggagccatggagaggagcaaaggagatgacaggaggaagcgcaggcttggaaaatccttggtagagagcacagatttagaggagaaggcagaccaggagttcccccactaaagggcatcctaaacagaaggaaggagacaaaggcagacagaggaccatggaaggccatgacggtgcctgaaagcagtcacgatcccagcgtcacagaccagagtcagggctgtcagagaggccgcccagggcacgaaggaacgtgctcgctgcacagagcgactttacatttaaattctttcttttgggcaattaagggaccacagaggacatgaggctgaggtgcagctactccagggtccctgaacctgcagatatgggcccgagatggcagcaaaacggggagcaggaggacccacgggagggtggatgaaccctggattctgcaaagtcacagtcgtcatgtctcacagttgctggcagggactgcgtgagcgtgtgggtcccccggctctctctgtgccagacaaccatacacgtgggaagagccatcacttaccactctgcaaaccacattaagtgagggcctgtggcttccgacagttgctttccttcatgttgctctgatggaaccaccagggacatcaagcccaagcccttgggctcattagcatggtgctgggacaagtcccccaaacaaacgggcacaggttccaggctatttttatttccatccgactcagcacagcctaataacccttggtgtgcaatgaaaaacaccacacttgcgtgcaagagcctattgatgtcctgtaatatcagggtaggcagctacctgctctcttccagtgcttactgttgggctggaagaatgatactggaaacagtgagccaactctgtgatgtaagcctctcagcagggagatctgtgcaattcatgcattacaaatgcacaatcagggagctttctcatgacaaaaaggaatcaaatcctgtctattattgagaagtcctcctttaggtgagcagcaaagcgcaggcggctttgcaaagcagcagcatgctgttagcaaggtctggagggccacacctctggaaaggatgtttgtcatgatacaaacatataaactaacaccatggataagcaattgattcttcaaagaagagcctttctcatgaaaatcctgaaataatatatggagtttagggggaatgaacagaactgcaagtggatataagctcttccatcttgccagttttcccttatgtaataatttccttctattgacataaggaataatgtttcatagcctactgcttttcctccccaagcctcattgcacttttgcaatgccaggaaactctaatcagtacactctaccctctggtgtccacactcaaaaagcacatcaccctgtttttttccctccaacattagcatgtgtaccaggcacgtggatgaaaattattagctactagggggattgtatttgtttgcttaaaactgttgatttttctgttttcaagggatcgagattttagactaatttaactagctgcatttttcccttgtatcacacagggaagttgaagaaagacgaaagccccctctcttttccccagcagtaagacaacggtgtcctcttttactctcatttgaagacatcctagaacataacttatgtgaaggcttagtataaaatatgggcacaaacaggatccaacgtaataaaatgtttttagcggaggaaaatgatatctggcatttgtttcaaatcatagtggtagtgaaatggatgaaacgagattgccgaagccttgataattatacagctgggtcatgggtacaaccggcttattgcctaattccctccacttttccgtatgtttggaaatttccaggaatcaagtttttccccatcttagtctgatgcagactgagctactatgtctgaaggataaagatgtgacattctaacatgtgaaccagggcagtggaaggaatacagctttagaaatcagaaacacgtaaattctcaccctgcttcgaactctcgctgactgcgaggccttcggagggtcactccatctctcttcatctaagctagtttccatatttgtaaaatgagaataatgaaacctcccacacaaggttattccggggataaagaaagggaaaatgcctggcacacagaaggcaaatgacgtagcttccctttctcctttttccagcagccctcagataaataaatcccaatggtcaaaaaaatacaaccagtatgaataactcattaggaataaccctggcaaaccctgattgagacattttgtttgctctatttcagtctttcatggtgaaattcatcataacatcattccacctttatcagcaaaaaacaaataaaatagcatgcatgcacatacatgataagccactattttatactatatgttgtcttgattggttttatattcaagcgttcctgctcaatagcactgatgtatctcaggcctctattatttcaaagaggatggattaaaggcaatatgaaagaacagctattaatgccatactatctttatataatacagttcatctggcaatttccagagtttggcccatgggtaattcacttattgggaatggtttgagtgaacactacaaatacagtttcccataccttcaattaaccaaatgatgtgaagaattatctgtgctaatttaaattttctgttaaactaagcattaaacagagggctgtctttgtttatagtggattttaatgaaggaaactgacttagctattttccttaagaattttgcatgacctcattaattaattatgtcattcaggaaaaaaaatcttagagaagcaaatatagaagttgatggaaaatttgacagcatgtatattagaggcaagccttttgccaattagcatgtcatctaactgatcacataaaacacttaaaatttgtcaggaccttttaaaaatgaacaaaaatgtcataaaataatagatgtatcacaactatcttctgagaaataaatgcatttatttgtctcactttttaaaggagaaaatcaaaccgaggcttaaggttttcttccatataattaatttgtgaccgagccaggattcagagccaggtggtctgactgcctaagaagctctttctgccactcacaccctgccaatctctgtacacagtgaacgacacagtccacaattacctgatacctcggtatggggctctagggaaactttcttctcttttgctgccttacctaaattcctgatagtacacagtgaacggcacagtccacaattacctgatacctcggtgtggggatcattgcatatgagaaactgttttgttttgttttgagacggagtctcgctctattgcccagactggagtgcagtggcacaatctcggctcactgcaaactccgcctcccgggttcacgccattctcctgcctcagcctcccgagtagctgggactacaggcgcccaccatcacacccggctaatttttcgcatttttagtagagacggggtttcactgtgttagccaagatggcctgaaatctcctaacctcgtgatccgcccgcctcggcctcccaaagtgctgggattagggacgtgagccactgcgcacggccccatagttctttttttaagttgtccaaataattgggcattttgcaaagctacctttaagaagatgccacttgaaggaggaataaacactgacttgattaattcatctaactctatcagacacaggaacactgatttgttattaaatgaagtatcatcaaaagaagataaataaccaatggtccatggcaacctagctctcagtcaggtttaaatttttgaaaaaacaaaatactgtgcttaattccaaataagaataaaaaatataaataatgggccaaagacttttaaaactataatttgaacattctcgaaaattatactttattttcagactctggagtccacagtttaactcttgaaaagtagtcactagagcatgcttgtatcaaaacatcttatgtaccccataaatatatactaggtgcccaaaaaataaaaaaattaaaaactttaataaaaagaaaaatagccaccagaaaacactcttcattgaattagtcctcttaattgattttttgacttttatattttatttctaagtcgatatgttttaaaaataatgattatgcaggctttccattcagaatatggaaatcatctggaatttggttttaggggactctctcttgacccagccgtgcccttcactattttacagtccaattatcttcctcccacgggggctggagccctgtgcattacttatgggacaggctcttagatgtgtggcattgacatctttgtggctgggtttttatctgtctcataaaagaggtgtgtgcatgcctgtgtctgtgtctgtgtctgtgtgcatttgtgtaagtgcacgggagatcaaacctcaatgtaatttgacaattctcataggttaatttccaatcatcagactttaaagcagtgaattaagcctctggtggcccagtttactaaatttccaacagtcaacatctagtctccaagtgtccttcagacctaagacccgcccggcgccgaggctgatcccgtgggcacctgtttgtgggcttagcggcatctctgcttctggcctttatccccccacctgacactcagcagctgctgtctgggaagaggagggcctgtgcagcagcccggaagaaacccccacactcatccccctgtgctacgtgcctcgggttcgtgttaatccgactttggtcacctcagcctcaaccacacctgtgctcctgccaaagccaccctccctgcagacaccagctgccctccaatgccggggccactgggccctttcccaattcaggttacttgtctgctatgagcctgccttttctgctttcttagaggtagctttctcctggattctaacagcatcttcttcccatccttttttccaggccttccctgaggccagaagcctgtaaacatgggagtcacccagcttgttctccagccctctcctcttattacactgcccattgcttctgggtaatctctcaattcttattactccaagaatcaacaatagaataataacctcaaaatacaaacacctccaccacaggattgctgtgtcaagccgatgcctcctcccacagtggcctgtgttcagcacaaatgttgacacccctaagggcatcctgcagctgccccttccctgctaacctctccttccccaactaagccatcgccaaattctgttcgtttcattcaacttcaaacgagtctcttgccaggcacggtggctcatgcctgtaatcccagtactttgggagaccgaggtgggaggactgcttgagcccaggagtttgagaccaggctgggcaacataggaagactcaatctttatcaaaaacaaaaaaaaaaaaaacaaacaaaaaaaaaccatgagtgggtgtggtggcatgcacttgacaggctgaggcaggaagatcgcttgagcccaggagttcgaggttgcagtgagctatgatcataccactacactgcagcctgggtggcagagccagacctcactgcaaccaataaaacaaacaaacaaaaactcttacactgctctccttctttccagcaacattactgctttttggaaaataccgaaatggaagcagaaaaacagaaatctcatgtgtctgcttccaattttcaaatgactccccatgaccttaaaaaaagtcatctgaggcctaagccccatggtgccctgcccatctccgagggtcattctgaatggctttgccccacatgcacgagtctccaggcccacatacctccctgaatactctgagctctccctgatgctgctgcttctctgataaccatggggttgttgcctccacctgagatagctttctcctccttctcaaggttatctcccattaactcttcaagaatcatcctaatcatcgaatctcccagaaaactctccctgacacccttgaagctgaatgaagtgtccctcctctcgctcccatgggctcctttgcattttctcagataacaataagataaggtgatgtgtttgacttgaaggcaaggactgctttatttatgcagtaccatgtattgaagccctagtacttgtgaaacgattaatatataggtttaaaaaaactaatcaatgtgtcttcctattagttattggatataaatttcttaccatgtgcctccagccctgtgctgcccaatatggtagccactagccccatgtggctggctatttaaatttaaaatagatgaaggttaaataaaatttaaaattgagttcctcaatctcacaggcctcattccaagcactcaacagccatatggggcaagtggctattggattggatggtatagatagacagcctttctgtcaccagagagtgctaaccaactgcactattctagactcttcatgggacagacacagctcatttatttgctcacatgcctgtctctccccagactgacactcaaaagcatttctgtatcccatggtgtcagccttgcatcaggccatggttggtatcgagtaaaagtttgttatagatgaatgaataaaatctttattgtacaatatccactatgatttatcttccctgttcaggaaggtgaccttgcccttctacatgagactctcactttcttcgctcctactcttgtctctgccaaactctagcacccttgaaggtcctgctcaggagccccttcccacacacccctcccaccacttaagctgcctcactcactccattcgcaatggcagtttcccatgtgaatgcctgcagggctgaccgctgcatgcccctcagcttggtgggtgttcttcgtggcatagagcacatgcgtgttaacctggctccagggcacaacagcagagggctctgttcagtagggacaagtccatttaattgcaatgtggcatcattgtaaaaaaatctgaggctgggcacagtgactcacacctgtaatcccaacactttgggaggccaaggcaggcagatcacctgaggccaggagttcaacaccagcctggccaacatagtgaaaccccatctctactaagaatacaaaaattagccaggcatgctagtgtgtgcctgtaatcccagctactcaggaggctgaggcaggagaatcacttgaacccgagaggcagaggttacagtgagctgagattgtatcactgcactccagcctgggtaacagagagagactctgtcccaaatttaaaaaaaaaaagtaaaaaaaaaaaaacaaatctgaacctagccgtggctgatatttcagtagtcacagaagtgtgaaggtgaggcttagaagaatgtgagggtctccaacaggaaaaattacgggtattctgggcctgcttaaggccagtgggataccaaggcggcttcttaggaggataaaacaactcacctcctgaagccctcatgcaggccagtcagaagacatccttggcccccaggaacttgccccattccctgaggaaaacccagtccctgagtaaaacctgagtccaactcagggcctctatgccactgatgtcggtggaacacaggactcaggcttctccaaggagctctaggggctgagtgacaggcaggtgtatttataccattggcctggtcctaatttgtgccttttgccattataccttgatggacaatttgcttacaatttctgctctcgggggtgggggtactaggaccatggtgtaactgcttacgtagtggtattcagtagggcctggcctgtgcacccggccagtgaggacagcaaagaggacagagctccacttcactgctggttgtgttttccttgggcccttcctgttttgttcttactggggggaatgttggaatggaatgtgggcactcaggctgtattgttttcaccctgtatggcagccagtgatgggaggtgtccctgcttgctcccagggccctctaagagtgatgggaggtgtccctgcttgctcccagggccctcacagccttgccccttcttccggtctatttcatctctgccttgttggagctggtttaagtggcagtgatgtctgtccttgcagctgctgctcatcacaagcagctatgattacaggtaagatagtgacgatggtgaggatggtgtgtcatgataatgctatggaaattcagatgcaggaacagtcacccatttagggagttgagacaggtagatgaggttgctgctttggaggtgacagcattagaatgggacctgaaaggaggggtgcattttgagaggaagctcttgtaaggaaaaggcatttgaggatgagacgctgcaaggtctgcagaaccactttgtcctaatggagattccctccctggccagtcctgttcctgtctgtgcaacgtgcttgcggtgcaggccctgacaacacaactgactccaagtggctgggccatgtgaccagtgctggatcaaccagaaaccctgaatgagatttcacatgtagaccctgggagagagcatgcctctgtcttcctctctcgttaggaagtgtaaaacttcatgagcttagagcagaaactacctttgctatctgcttgagattaacacccacagaggaaagtaaatctgagagttagggagacagacagaaagagttttgggaatatcatgtcagcaccacatcccagataagagtgaagtcccacagcctctggtcttcagttctaaagaacaataggttactttagtagaggtagtgg

SEQ ID NO: 774 - DNA, 158723 bp, Homo sapiens
ctcttttttccctacatcctaacaatcatcaccatatgtataatacatagtatgcacccaataaatgtttctattctacatagaggaaatgggagtctgagccttactcacagtgtgaattccaacaccaaactacaatttgcaattctccctttacattaatgtaaagcaaaaataaaattctaagccccccaaccatctgaagggaccacttctctcggccaagggcattccaaggttaacctgaaaaactagttcaggatatgaaaggaagggggagtcagacataattatactctccgaagggttggaattcaggcacagctgaccagcattaacatcaacaaagaccttaagactgatagaacagactcttttaagtctgataagcaacatttacaatcaactccccctgaagccggctacctgaaggtttcatctgtatgataaaaccttggtttccacagctccttatcttaacccagacattcctttttgttgattccaggtctttaactctttgaaccaactgccaattagaaaatctttaggctgggggtggtggctcaaacctgtaatcccagcactttgagaagccgaggtgggcagatcacatgaggccaggagttcgagaccggcctggccaacatgaggaaagccagtctctactaaaaatacaaaaaaattagctgggtgtggtggtcctcacctgtaatcccagctactcaaaaggctgaggcaagagaatcacttgaacccgggaggcagaggctgcagtgagccgagagatcacaccactgcacccccagcctgggcaacagagaatctgtctcaaaaaaaaaaaaaaaaaaagaaagaaaaagaaagaaaatctttaaatctgcctgtgacctggaagctgcctccacttccagttgtctctcctttctagacagaaccactgtataccttacatgtactgattgacgtcttatgtctccctaaaatgtgtaaaagcaagctgtacctcgatcaccttaggcccatcttctcaggatctcctaagggctgtgtcatgggccactggtcactcatgtttggctcagaataaatctcttcaaatatattacagagtttgaccctttttttgacacaaagaacaactgagctcaatagagacttagtaacctgccagaggtcactttgcccagtaaatggtggagctacaatttgaaactactctaaaatccgtgcttgtaaagcagcatgttccctgtcatcactcttctttctttaataaatctcaagtgttaatttccgatagatacacataaagcccaatgccgatggcagtcgaattcatacattaggtgaattcaacaataacttagcaggccaatcacccatgagaacagctggaggtcatgttttggcactggagaacaatacagaattggccaagaaaagcaagtgactgtacacaaactaacaaagatcttctgtctctggctaggttaaattaaagctggctaaattcatctcccagagaaaaatcttcttttaaaaagcaacccaaaagttaacctcccagagaaaaccttcttttaaaaagtaaggcaaactgctcatcaatttacaaaagtgaatcttcagcaaatcacttgttttgcctttcagagccaacattccaaaaattttgaaaccgtatggtgtatggagcagaaaaggccaggattcaagtgagggctctgagtgtgaatcccaattttactatttaccagctgtgtgagttttaagtgacctcgctgaagtattaaaatgtcgacaacaattgccctgttgttattgggaagagtaaataacaatgtatggaaagcacctgagcgttacagggcccattaaatggcataatataactaaggcacctgagcaaagtgcctgacccagagcaagcactgaataaatatcaattcctttccttttaggttaagtctccactccctttatctcacacactatcatgaacacataacctctgttgtgaggagctacatctagccccgtttcaaataaaaatcaagttccttcttccaaataagaacttttctaaagattcagatacaccctgaccaccaatgagctgtgaggttgcaggcagtctagggattcagtaaactcaaggcctaaggcaggccaaggccaacaaagcaacagtaaaaattaacatccgaccgggcgcgatggctcacgcctgtaatcccagcactttgggaggccaatgtgggcggatcacttgaggtcaggagttcgagaccagcctggccaacgtggtgaaaccccatctctaataaaaatacaaaaaattagccaggcatgtgcacctgtagtcccagctacttgggagaaatgcgtgaacctgggaggcagaggttgcagtgagccgagatcgcgccactgcactccatcctgggtgagagaggagactccatctcaaagaaaaagaaaattaacatccctccagcatggtctcttcgtcaatccagggcagtaagagcctttgagtgctgctgaagtgaccaaccgacattcatgtttcaggaaaacacgcagcaaattcattcagctctctacagtaagtgcaaagccagtggcctatgagggtctgcccagacactttccagtcctccttcccagagacatggaaatgtgcaagaggtaaactagcaaaattagagagcactgtgcttcagacatgatcgtgaaaaaagagtaggccgggggcagtggctcacgcctgtattcccagcactttgggaggccgaggcaggtggatcatgaggtcaagagatcaagaccatcctggacaatatggtgaaacctcgtctctactaaaaatacaaaaattagctggatgtggtggtgcacgcctgtagtcccagctacctgggaggctgaggcaggagaattgcttgaacctgggaggcggaggttgcagtgagccgagatcttgccactgcactccagcctggcgaaagagcaagaacaagactctgccttaaaaaaaaaaaaaaaaaaaaaaaagaaagcaaaaaagaaaaaagagtcccttatgccagttgataagcatatgcgaatatgggacaatctttcaagacttacaaagtatttcatatctaattatgaatcctaacagccagattcctgaggcgaaaagtgctgtttctccaagacatactaggatccatttcaacctgatgattctatccttacctcagtaccacatcgggagcctgaaaaacaggttttcaagctgcacaggggcaacataaccctaagactcaatgcacaaatcaggaaaacttttagtttcaaaattacacaaccaatttaaattcaagacaaatgtcattaaagaaaaagaaactttatgatagagtttttggtagctggggactgacacaccaaaaaaagtctcccataaatcaagagaataaacatcgtgtttctatgtatatctgtaaatgccaaactaagaatgttgattagaattaagagtatgttgtaatttaattttgcaaaaaaattaaaattataaatgatatcggttttctaagtttgacttcaagataacttaaaaactaaatctgagttttgaaacaacggatgaactcattagtttagaaatcactgtggtgtacccttcttccaaatagagaagactggttgttaaagcccaaacatgtctaaactgatgttttagagaatctagaatatcttcggtctttcctaaccttgtcttctaaacggacctgacaattccctcccttgtggtccccatgcaccctgaagacacacctaagtcagcccttctgcacttgctattctatgtgcttcattcctcttgccacgagccctccaagggacaggctgtctgtgtcacacctgcctttctccgctggcacttagctcccttcctggcccagaggacaggcacccaaggacagcctgtctggggctgaaaatacacctaagtccccactgccaaaaatagggctgaggacacatgcccaacgaccaacagtggcctgtcaaatgtttttaaaacccagaaaaccaatttctacacactattctcaaaaacacatgcatgtttaaaggaaaatcacctttacactgcatgtgaattctttattctttaaacagcactctctaggtcccccccaaatattttagacaggcgctatggaaaacatactggtttttcactatacataagtaaaagattttattttatataccaggaattaatatattaaggctgcaagaggcttcacacatccactaggtccaatcctttcatctttgggtctcgaaaaattacttgccaaaaatcattattggccggtcagaggaaaaatcaagaacactcttgctcatacaagagggctctacttcccagagctgcctcctccgcaagagtccaggagttatttttatgttgacatgtttaccagcactcccaagccctttcttaaatgctgtccaatacattttaaagttgacaacccaactttttcagaaaaataaaatataacctgattgtatcaggcacttaaactactaattatactaaaatattaaagtaacttcatttttcagcacactattaaaaggaacggtgatacttgatacaaaatactgaaattgaggatttttttttccatatgcagttttgttgtattgaaacctattaacaccccagtactgacaagacaatgaattaacaactaaatgtaaatctgcccacctggttctgcaatattattgactaatagataactaaatgctaacacatctcagttttctccacagttctctgaagcatgcaaaaaatatatatatattacttaccaaaaacagagaaccatattcaaaagtctcattcataatctcttgtttcagctcttgtttttccatagatgtcccattttctttttcacccttcttttcagggctaatcctatcaatgttgggaacataggtcatttccaaacattctgcactttccattttaacagggagtatgcctttgatcttctgaaacaacgcagaaacggacccggtctcgcatgctgagttagaagaactggctttgtcaacatcttcctgattcgatttcacggcagatgttgttcttggaaccctgtgtgaagcatttttagaatgagttgtaacatgcacagcctggctagtaatgagtttattaaactgctgcttatgtgtcttgttaattagaatttctgcttttttgtctgcattcaagtcagatctcggtgttctgctcaagactgtttgttgtcttgaattcactgatgagggtgatgaggcactggtctgctgaggtctgggcgtgacctttgataaagcagcatctttgggctgcaacactgctctagacataacttttgctttgacattcttgaagtttggtcttgggtaacttataatttcagtttttctaactttgcagcctattggggtattcgttttgattgttgattttcctaaactgggtttacacaggttcacaggtgcctccttcgagtctggtatgtttttaagccctcgattacccttctccactttcttacatttctccgtcgcttcaatcggtgaaacagaaaaggttacttttgtgggttctaggactggtgttgacatgcacatcgttttgtctgtgctaatgaccatatcatttgcatcccaagtcagtccaaatgacgagcccaccttttgtcctggcgggctacttagaatcaattctgaggtatgattttgggttcccaaatcctttcctttggagaccatttgtgtgtcttcagtctcagtgactttatgctctgggttcagcacttgagcttcgctcttatcaaaagctggcaccattaaagggcattcatcatcaataagacaataggacactgtctctctcagattttggcccatttccttgtgcctgtatgagctctgtgaatgtggttcgctattggattcatcatgggataaacaaaagaactcttgtaatgcagaatcattggggacttccatgccatcagaaactggtgttagtgcttgtgtctccttttctccaactagtctttgttgtgatccatctgtgtactcactggtgacctttcctgaagaacatgcacactgatttccaatatctgaaacaaaaacctcactttgcatcaccacatcagaaaatgctgtgtaagtcatgtcttgggcttctgatggtgtgacttgagggttttcaaagctttctctatcataagtagtttctcttgcatgcgtcttatcagaatgggaagatgtccaagtggaataggataaagaagatgtacttccacttctcctaccagttggtggcaggcttccagcagtatggaaggactgactctttccgatggcatgatgtgatataaaggtgcagttaactttatccactgtcatgtcaaatgtttggtttagctccaaggcatcacagtagcctgcacagttcaaattgtcattaggcttccacacaaaaggcaaagatggctcaacactctggccctcaactgcttctagggaatgacaactgtgttgcagatatttgggcttctcagtacctacaagtgcaggacactgacaaatagaatctttatgcatatctaacacctgcttactaatgaaatcactagaagacttttcatgaccaaatacttcaacaccctgaaggcttaaagaaatattttcaccagtaactacagcagggtcagtttcataatcaaccaccatgtcatctgggttggcagaattccagttcacactgctggctgaagagttttgtgtaggtggtgatttcgggttgtatgcatgtgtatttccatctttatcactggtaaagaaggtttgcaattcatcttctattttatcatctgaattatcatcagtcatcctgaatagtaaccttaaacctctgccattttatttcttcttcaattccttttaaatgagagggtgggcaaaatggtctgtcttctaggtttttcagcacagttgaaaggttttcagtctaagatgctctgaagattaaatgatttgttgttccctggaagaaataaaatgtttaactcaagtaactataagaaaaattaacaggccaccccttggtttcaatcactaagtgattagtttcaatcactttatgttcacatttagaccccacaactactgatgtgggtaactgagatataatcaggcaatctatcaccgcttttcaagatacttttttaatttgagggaatagcaaatggggcaaaatggaagatggggtcattgctcgttaaccctgtccctgactttataactgatatgcctctcccccactcccagggacttgtcaaagagaggaggaggtaaatctggcaatagtattttcttcttgttggctgacagagtgacaattcacccaaatttgcttatgacagtcccaaagtatgtctgttgtcccaggatgattagtaaacatgtccctttcattctcagaagggcccccctattatttccatgcagagtgattattagacaggccatgaaagcccagcaaatcagctgaagatcaatcaagaactcacgtttctcctttgtttttattcctatcttaaacatatgctatttccaaattgaaggggaaaaaaaaattgtcgattcttaaaggctccagtggtaccctgttggaagtcccttgaaatgtgagttaccttatgttatacactaaactgttccccacccctctccaattcatatgtcaagcccaaacccccaccccttatgtaactatgttggagacagagcctttaaggaggtgattaaggttaaaagcagtcataagcgtggagtgctgatccaacagagctggtgcccttagaagaagggaaagtgacaccagaatgctctcccactcttggttcatcccctctctctaccaaattagggtacactgagaagagtaggagagctctcaccaaaaaccaaaccctgaaaagaaccttaatcttcaactttccagcctccaaaactgtgagaaagtaagtttttgttgtttaagccatccagtgtatgataatttgttatggtggccgaagaagacttaagtaccacatgccccagcaattctactcctaagaatctactgaagaaaatgaaaacatatgtcaacatgggaacttgcacacaaatgtacatgattctaaatagaagcactattcataatagtcataaagtagaaacccacatgcccatcaactgaagagcagaaagcaaaatgtactcttatgcatttgacaaaatattcctcagcaatagaaaggaatgcaatattgacacatggtacaacacggatataatattacacttgaaatattatatcaaatgaaagaagccagtcatgaaagtctacatactatatgacactatttacatgaaatgtccagaataagaaaacctaaagtggctgctaattgggatgacgtttcttttgcgagtatgttctaaaactatgtactgatgatggctgcacaatgttatatactgaaaactactgaattgtacacttaaaaatgaaaccattaaaacacccacgaaagcatttaaatctaaaactttttgcaaataaattattattgcttttttgagatggagtcttgctctgccacccaggctggagtgcagtgatgcaatctcggctcactgcaacctccacctcccggtttcaggcaatcttcctgcctcagcctcctgagtagcagggactacaggtgtacaccttcatgcgtggctgatttttgtatttttagtagagacagggtttcaccacactggccaggctggtctcgaactcctgacctcaggtaatctgcccacctcggcctcccaaagcactgggattacaggcatgagccaccacgcccggccacttttgggaaataacttaaattttattatgcttttggtcaaactgcagtgccaaagaaaggtccaaatgttcaagctaggactgcaaacaggtcattgtgaatcctaaaatgagggctgtgtgatttatattctgatggaaagtgtaaatttgttaactctttttactactgcaaacagatacgcacacacttgaactaattttctaatcctagtattcaatgtcaatccgatgtcacagtactgttgtaaagaaaaaaaaatatccatgagggagggaaaaaatgccatttcgtgtgttaattcaacttgccgaatgaagagtaggtctcatttttctatcttgcagcgttttctctgcattcaaacttcagtggcctgaataaaaccagaataggaactatgttaaaactgaaacgatcagttttcttcgctaacagtgctctgtgtctttctggccaagcatcctgataccagcctttaatggaataaagaaaggctgcaatgttgatttcaacagcatgtgcacacatacacatccaaaaagcgattttgaatccaaaaatgaaggctgcgtgatttatatactgatggaaagtgtaaatttgtgaaccctttttaccatataactccttagtgaaatcactgaatagtttattggcaagagccttaataaaagcttttatgaaacataaattaacatttttaatcctccagtataaaatacatccaagctaaatgtttaaatcaagaaatatatttattcatttttaggcttacatgcaggggatataatttccaaaagcactaaatatgctacagctttctgcttccctaacagctaatactcagttaacagactgtggcataagcaaatatatgcaaagtgcactgcaaacacgcacttagcatagatcgtgggaactgtctttgtaaataattgttagcttcaattaatggcatttttattactcaagtttcctcttctgaagtgcataaaagatgatttttaaacctcatataaattgaattaagggctcatatgtcaaagttattttttatttatttattttgagacggagtctggcactgtcgcccgggctggagtgcagtggcgcgatctcggctcactgcaacgtccgcctcccgggttcaagcgattaccctgcctcagcctcccgagtagctgggattacaggcgcccgccaccatgcccggctcattttctgtatttttagtagagatggtgttccactgtgttagccagcatggtcttgatctcctgacctcgtgatccgcccgcctcggcctcccaaagtgctgggattacaggcatgagccaccatgcccggccccaaggttattttttaaataagtatgtaagaggataaataattttatcactagtcctatgtttgtttttaccagttgtctttttttatttttcttttttttgagacaaggtctcactttgtcacccaagctgcagtgcagtgatgtgattacagcttactgcagcctcaacctcctaggctcaagcgatcttcccacctcagcctcccgagtagctgtgactacaggtatgtgccagcatgcccagctaatttttttaaaaaactttttgtagaaaaggggtccagcttttctcatttataaataatactaaactgaaatcttcacaatctttgacatctgatcatttgccaaattgctatatttaaaaagggggcaggattctttataatgtgcatgttactatatatgtatattttatatatatatataaaagttctctttctttttatatatttatatataaaaatacgtaatataaaatatatatattatatactgagttttgcttttaagactcatatactgtggtcagcattgtctctgaagcattttcccatgtcattatactataaaaacatttttaacggttgtgaaacgccactaaagttaaggttaaatgttttagatttacaagctagtggtttacaagagtaacagaaaaataaagaagccatcaaccatttaactttcacttaacattttagtacacttgggtttatgatttttttttaattcacaaaaagagattgggtgtggtcgctcatgcctgtaatctcagcactttgggaggctgaggcaggagcatcatttgagcccaggagttcaagactagcctgggcaacatagcaggaccctacctctacgatttcttttctttttttttttttttttagcacggtggtgcatgcctgtagtcccagctgctcagaaggctagggagaaaggatcacctgggcccagtagttcacagctgcagtaagctatgatcatgccaccacacttcagcctgggtgacagggaccctatcactattaaaagaaaacaaaacaaaataaaacaaatttcaaattggtgagcaaagagactaaaaaacccacaaacatgtgttcataaatacttaaggattgtttttatataaaataaatttactgacatctcttctactttgtagacaagagtaaaaaaatagtggtacagggatttggatatcaaaaaggttctgcagttaagctgatcagttccagcaagatggaagatcaacctcaccattcatgaaaagaaaacaatggctttaagtcaccaccaccaccaccatgaagacaaagccaaggacagaaaaggggtgaccggccttcgctcaggagtttgtcaaaagagttaaaagttggccattttgttttactgcctattttatttctccccgactttaagaatgggtcctaagcttgcaccacttgctcgacatatatattctttgccttcatctcacctgactcataagcaaagtcttcatattgctgtagttgctatttgtaaagccttcaaagttgccatcttagaaatattttgattaaacaagatgcagaaagttaaaaaataaaaagacagagagtgtgctggagggaaaaaaaaaaaaaaaacttgaaacaaaccatcctcacccaaagggataatttctcaagttctcttttggtagtactacctaccagaacaaaggtataacaccagaacaaggtataacaccagaacaaaggtataacacttgtgtaacactccagaacaaagcagaatgatcaagtttcctttctaagagaatcatttgggaaaacaaggagatctttttcagagaacattttggaccagagagaacaaattccccacttattaaagagctgggaatgtaacagagcagctcctcttaaacggttaccaaaatatatatttccctaaggatttataaggattaaaaattagtaaatatgtgctgaaagaaatggtcaaagaactactagtacaagctttgaggtataattccaatgcctttggaaaaaaaactttctaaatcttagcttaagaaaagtgattgtttattccccaaagataaaaaattccattatttcttcatgtgaagagacacacctaaagaactgaatcattatattaattacaattattatcatataatagaattcatcatcattaccatattaatgctagaagaaattttaaagatccaattcaaacttcattttacaaatgagaaacctctgagaaatcaactgcatgacgtgaccaaatcagttgtcaatagcagattatacaatagctgtgtgccttatttcaccaactgaactagaaactcaatagaggcttatataagagtagatgtcttctatatctccctattacccacagtgtctagcttaataatttggacctaatatagttaaccttgtaacaccatattataactataaaatcaagaatgtttccaaaagtaaaacataagaactggcttcattactttataaccacacagaatgtaattttactacttatttatgttaatatatggcacgccagtcctttaagatgtgaatacaaatacagttataatttatagcttccaaatcataaagccattatcagtcttcttaaaagtttttaagaactcacaaatcacaatagtagtttagctctgtaagctttaaaacccaaaatattacctgatcttcaacctcccttgaatcaaaaaagatgacattggcacaacatctaagctatcattttatcttactaaaaacgaagcagttgaggcctggtgcagtggctcaggcctataataccaagactttgggaagccgaggtgggcggatcacttgaggccaggagtttgagaccagcctagccaacatggtgaaaccccgtctctactaaaaatacaaaaattgccaggtatggtggcaggtgcctgtaatcccacctactcaggaggctgaggcaggagaatcactggaactcaggaggcggaggtcgcagtgagccgagatcacaccaccacactccagcccaggtgacagagcaagactttgtctcaaaaacaaaacaaaacaaaaacaaaaattaagcagctgaacaaaatgtcatcagcagcatgtattataaaaaatatattcataagactccacctcctgttaaaaccattcaaggtagctaacagttctactctaagcctcaacttcctactatttttcataatgcaagcttacattcttaaatttgctcttgcagcctacctttcatcaaacttaatagccacctcaagcactacgtttaacggagcatgtctaccacctaggaaccgagtagaggagtacttggtggtcaatttcctaaaagcataacgatttcctatgaagttgcttaaatcaacagcaggaaactagagttgatttaatgcatttcaaaatggtggacggctatgaagtaatacaagttataccttaaataatttagaaaacaagtataaatttgaaattacatccttttattctgaaacagtatttctctgactttaatgtgcccacaaatcaactgggcctttggttggtcaactgactgattcagaaggcaaggatggggcctgagattctgcatttctatccttctccctggtgataccaatccttttggtccatgggccaccttggattagcaaagatgcggcaaagagctttgagaaacacctgtccagttgaccagatcaaaaacaacagtggctgtcagggctgactgctttcacatccaatggtaccttttttttttttgagacgaagtcttgctctatcccccaggctggagtgtaatggcgcaatcttggctcactgcaacctccccctcccgtgttcaaacaattctctgcctcagcctcctgagtagctgggattacaggtgcccaccaccacgcccagctaattttttgtgtttttagtagaggcaaggtttcaccatcttggccaggctggtcttgaactcctgtccttgtgatctacacacctcggccttccaaagtgctgggattacaggcgtgagccaccacgcctggccggtaccatttcttaaagtagatacagactttctctacatttggactcttaatttatgcttttgaatgctgctctcaagacagctcatattttgcatctagaaaataactggaaatgcagagaatgttgtttccataccacttcggcttattccttccacgtggagggagtttaatttgtataacactcctggcttttgactcactccatccaggagaagtgaagtgacttagtggatttttgtaaatttagtgagaattagctgcacaaacccagaatggcccgacctctttttttctcttgggaatgagctgcccaccagagccaggacgacggtgcactgagggagatactcgctggaggcactaaggcaacaggattaacagtaccctacccagcctggagccccaggcaaagggaaacacaagtaactgtggctggctggttatctaactcatctcctcttctttctagcacacagatattatgtttctatgtgttttgcaggtaatgctgtgtgttccagacagcagaatgtgagtggacatcatatgtaccacctctgggcctggaccatagaactcacacataatccttcatgttcttatgtgaccacacagatgaacaaagcaagccaagtgtggaaacgtgttaaagatgacggaaccacaagatggaacaagcctggatccctgaatccctccttggaggattagtgcccacaaattgtaaacagccacccagatctcagcgagcaagaaataaattatacctgaatgttttaaagggttttttggtggggaaagaacagtgatgatagatattcttaaatactgtaactactttgaaagaagagaacaacagttaagaactatgtcattttagtcatcttttgttttgtcaaaacaaagatgttacaggcctgtgcttgtttaatatgaaaaaactctatgatctacaaatccttggggatacagagaatcagggtagctggtgacatctgacctatcctcttactcactgatattgttcagaaatccaagctaagaggttctaaaatagcagggaaaaatggtaatttctatgcacttgcatttttatgaaagaaaactgcaaaaaaaaaaaaaaggtaatttctatgtacctgcaattttatgaaagaaaacccattaaacaatagtttataataatgcatcccctacacactgaacaatttccctgttcctgtttcatctttatatcttccccaggtctgcttcttttaagacgtcttcacacgttaatctagtccaagggctggcaagccatttctgaaaaaggccaatataaaatatcttaggctttacaggatgtgcggtctgtgctgcatttattcaagtctgctgttgtagaatcaaagacgccacagacgatatggaaatgaacaagcgcaactgcatcccagtaaaatgatttacaaaaaagaggcagtgggccagacttggccgtggactgtagcttgctgacccctgaactagtctatgccctaatcccgtggtccccaacctttttggcaccagggactggtttcatgggagacaacttttctgcggaccaggaggagggggaggattcaagcatattatgattactgtacactttatttctattagtattacattgtaatacataatcaaataattatataactcatcataacgtagaatcagtgggagccctcagtttgttttcctgtaagtagacagtcccatctggaagtgatgggagacagtgacagatcattaggcattagattctcataagtagctcgcaacctagatacctcgcatgcacagttcacaatagggttcacactcccaggagaatctgatgctgtcgctaacatgacaggaggtggagctcaggcactaatgcaagcgatggggagtggctgtgaacacagacgaagctttgccccctcgcctgaagcctacctcctgctgtgcagccctgttcctaacaggccacagcccaggaattggggaaccttgccgtgatgaatcaaaactagctgtcattggctgggcatggtggctcatgcctgtaatcccagcactttgggaggccgaggcaggcagataacctgaggtcaggagttcaagaccagccttgcaaaactctttctctacaaaatatacaaaaattagccaggcgtggtggtgtgcacctgtaatctcagctactagggaggctgaggcagaagaatcacttgaacccagaggcacaagttgcagtgagctgagattatgccactgcactccagcctaggaaacagagcaagactctgtctcaaaaaaaaaaaaaaaagactagctgtcatctatacttcaccatcattaaaatacagacaccacacacacacacacacacacacacacacacacacacacaaatgcacacacaatttttttggttttatttttatttcttggctctttcagagacaggtcaactcaattcaaggacagtatactctcaattttctcgtaaagtccattactacatctcttcataaaaataaccactcacaaaatcaggtaccatagggcttctaaattacctaacaacaaacagaaatagcaccaaaaattggttcttacttttcacaaatcctctccactaattatcatttaagatatcatttactatatgaaattatatactttacatactataaattatacactacaaattaagagacctttatgctagcattagtttacctttgtttaaataaaaaagcttaattgtcactttagaggcattttaagactggttgacactgggtgccgatttagtgaatttttgtcaccaagttcaagtttgctacagctgtcaaagatcataaaactgaaagcatacggtattagcaaaaacaagtcttatcagtatccatgcaattttaaaaagaacagaaacttggcaactaatgggtaattaaatgtctgcagaccatcacatgtgagtacacccagtacacaagtaatcatcatccttaatgagaatgagaaaatgtttaattcccactcatgccaaaggccacatacaagtctccttcctccatgagatctcctcctactactcaacatggctatcttttttcaagtttaataggcaaacctctctcagcacttgactggaataactgttgcaccatttgggagttatttttcttttagacatttgcagatcttatctgaaggtgactaagagcccagagttaagtatttgtgaggcaatctatgcgaactctgaacttacctagttggcttatatgaaatttgtagaacgcatggcaggagcctgtgtaagaaagtattgtcctggttttctggtggtttgttgttgttgtggggtctgagaatgtacagccaacccctcttttataacagagaattgattttgatacatattttaaaatatgatagtgcagagttaatggatgttaaaattttattttcttgttttggtaggtagattgaattgagaatcatataatcagtatatctgagaattgtatgaccagtatattttaaaatatgatctttcttttaatcatattttaaagtatgatagtgcagagttaatggatgttaaaattttattttcttcttttagtaggtagactgaattgacaatcatatgatcagtatatttgagaattatatgaccagtatataataagactggcacaaccatttgccatcttttcctgttatcatcacatagtgtgggtggggagaatgaatggaaatcactccagaataatgacaaatggtttttaaaactctatgctgaatacattccagctgataatgaccgacttttcttttttcactttggtgatatcatcctcagggtaaaaaaaaaaaaaaaaaaaaaaaaggcatttataaaaaacagtttcataaatcttttagttataaacaggaaagttttatattatgtgtcatttcatttctagactgttgatgatgatgataaggaatttggggccaattttgatatatgaatgtattgtttttccatgtggtgattaaagcttccattagcagtttaaaaaaaaagagtgagaggaggtaaaaggggctgggtacagtggctcatagctgtaatcccaaaacattaggagtccaaggcaggaggattgcttgaggcctggagtttgagactagcctgggcaacacagcaaaaccccatctctttaaaaaaaaaaaaaaatcaaccaggcatgggggtgcacacctatggtcccagctactctgaaggctgagggcaggaggactgcctgagcccaggatttcgaggttacagtgagccatgatcacgctactgcactccagcctgggtgatagagcaagaccctgtctcttaaaaaaaaaaaaaaaaaacggtgtgaaagagactgaagtgcagcaagatgctccaagtttgggggttggggaacatgaagataaagagccaacggtttggtcagctcaagagtttggcttctactctgagagcaatgggagtctgccaaaggagttatgatggagactgatgcttcgaattggctaaaggtggaagatgtcctagtgaggagagactagacgcacgaaactgctagggcagatgggaactcctggcagtggcagcacgaggcaaaggagaggacaagccagacacgcttaaaaggccactgctgtgtcctctgccctgagcagcagagaggctggcacacaatatgtgcccaatacaggtctgttgaattaaacattattttaaaagactacttcacttacattaatatttaaagaaggaagccacagcagatagtatcagagagctgtataaataatgtatcacattctagagagatacacgaaggatttacgctttgagtataaactaggagagttttataatgttctctcttctctttcttcaaataaactaatatgtgagctcaggatattaattcaggattttccagggtcttgaaggtcttttactcaatccaaaataaataaaagagaggttcaaaacatgaataagagatctgggttaaaatgaataatttattaagcatagagacagatactagtttaattatccaaggaaaactaatttgcttctttctaaaacacacacatttaagactttttaaaagaaaatcatatacaacaaagaaagctatgagagaaactctgtttatgccatggtaaaaaaaaaaaattaaaatgacctcaacaaaaatatatcaccccctttccctacccaccctcaaagccacatgaggtttgtatttaaaatatctttaagagcctttttgcagcaattagaacatttttatacaaacagtcaaaaattatcaagtgacttataagaagatagaagtctcctacctccaaaacaaaaaacaaaaacaaaaaaccattacaagaccaccagcagagaagagagagtcctggtgggcagacagcattccaaagtcctctaaaactgatatcaacacaccagaaaagtcaaagaatctcccaaaaaatcatgtttacaccaataaagattaaacaattaatggtattttgtttacacttctggagttttcgggggatttttgtttttgtttttttaatatggttacaatttaaatgggcattggagtggaaaactgacttactcagtcaatagcacagtatagtcagtttgtcttagataactcacactatgcaattaaaaagcctctgcttgggggtggaggagcaagcccctagctggtgatagcaaagacagcaccccgaaggagaagctcccagcaaagcctgcgggaagtataaagattccagacaaaatcaattcactgacctgctaaggttcaagaattctgattcctcaagttcattccaaaaaatgcttttattccttttttttttttttttttggctcaacaacttcctaaaacctccaaaccagcatgtggaagaccttacacattcacaaactcttaaaactgcatttctgaaggcttagtcagtaatttttttttttttttttttgagacagagtctcgctctgtcgcccaggctggagtgcagtggcgcgatctcggctcactgcaagctccgcctcccgggttcacgccattctcctgcctcagcctccccagtagctgggactacaggcgcccgccaccacgcccagataattttttgtatttttagtagagacgggatttcaccgcgttagccaggatggtctcgatctcctgacctcgtgatccacccgcctcggcctcccaaagtgctgggattacaggcgtgagccacccgcgcccggcccttagtcagtaatcttaataaggaaaatggtttaacattttcagggcatcctatattctttaaacatatcataaaagcagcagaaataacaaagttgtgtttccctcaatcctcatctcttgctgtgaagacgacatgaaagccaaattaaaatgctcagatcattttaaatcataagcactcaagcagtttcagttttcttctctctctgacccactgccacactctttgcttacacacacacacacacacacacacacacacacacacacacacacacggggggggttgggggggaagcactacagtcagaatcacaatgcaaaagtgagaaataagcaaggttctagacacttcagatgacatataaagtatataatacataataatttcctgccgcactccatacaattgttggtgtaaccataaaataaccacagtcatttgtaataatatacaacatttttacatgttgcttaatgagagtttttgtacttgatattttaacccaaagcagagccctgcatttgattattatcctttacaaaaagtacataaggggatactcacttttctgcataatcatcttagcattttcaaacgttctagaatttagcctgaagtaggggtaatctaataaagtatgataaataccacaaacaaaatataagcaggtggaaagcatctaagatttaaagagcagcttcaaaaaaaaatcccttttgaaacttgagtggttttaatttaaatgccccaaatcaaccataccaagctaacttacctatattcctcagaatatcaaaaccaactgctatcaacttaagcaagagatgtcttattcgagttatctgtccaaacaaaattttttaatgcctttggttgcacctcagagactgtctttttcatggagcaatgcagaaactgcaaccagactacaggaaatacaaacaccagaccgtacaatgaagcctctctggggactatgattattcaaagacagttcagccttgcagcagtaatagggctgagtgtaacgacttttttattcttccaaactaaagaattttccttggactctctgccaatgaaacatcacagacttttctgaggctttacaggcagaaaacttgtacgcagatgtttcttggttatactgtacacatcacttgcaataaaactgtaaacaaacaaaaacatgacaagttctttaagcaattttcagatcatctctgaaaacagaaggcacttttgcctgtcagattaaatcagcattcactgtggctgggtgactgcttctggattaaagaaactggaatattccagtgatttggataatgaaaaagaaaaaaagttttaaaggtaagatgttaagtatgcatctataatataattggaatttagatgtaaggaataacctacattaatctggctacaattgtacttctcactcccttgactaattacctataccaataagttcttaggagtgttatatcctttaaacttaggaacttcagactgctcaaaaattatcaagttaataataaataaaataatctgtgtaaggaaaagttcctgaaagatacataccttctcattagcagtggttcaccatctcaggtcaatgatgaggaaggggaggcagggggctgcactgtaagtttactttatacatttatataattatttaaatatttgtaattacttttggaattttgaatatcaaaacaaaataaatttatgctccaatggaatcaaatacatgcttcatgcaatgaagttttcaaatcaacgtttctttcacagacattgcaattaaaagatctgcaaatcttttattcagaatcttgggccagcgtatctgctctcagcaatgtgaataactagtgtcatcaaagctgttactttacaaaatagtcagtgtagtccctaaataaatgtctttcaaattccaacaacagattgtctgaatcagacacctgaaatgcatgccaagaagtcttgcaagcaggcagtctacgcatgaaaacaaaccctatgatagattctcttgaaattaaatacaactcttacaacaaagacaattttactattttccgataaacagggtccactcatggaaaagagatcgactaacatggataattcatcgtccagtgtttacagtggctgagttcatttaacccaatctactagttctgtatgtgagaaaactgagatctagagaaaagaagttacgatttctactagtgtctactgcataactctatgagtcaccattcacaccacattctatggacagaaacttcactggtccatttacattaaagatgatggccatggtggcccagaattgtgcagggtagtggcctggatgacttttaagatgacacaatgatttagaagcagaatcaggatcagaattatctccttcctctcctttagtttaccatcatcttgcctcataaatgtatgaaagaaagcaaaatacaagtgcatttaggataaaactctaatttttatccttgaaatggcatgaatactgcagactaatcctaccttcagaacatcgtatgtattaaaaggaatgcctatagaaactagacacacatgtacaaaacaaaataactgaaacatttaaagatgtcctacaccattatactatattaaatactttgtgtcccaaagctacaggtgaaaacaagaataaatatttcactcgcattatccaaacttgaatccctattgttttcaatatccctactgactgtaccacagaggatttaaagagattcataattatgactgtcatattatatctgctaaaacataattatctggtcctgcttcccagtagaagaggccagtgtactctctactgatgtcataccaaggaagcacttatggctacaatcactgatgtcaattaacataagaaaccagtacattcagtactctagtaggttgttgcaaagcagattaagttttcctacaaagagaaactaggcccaaaaccagacaaagtatgttcaacttcttcttataacccactatcattcaatgttagagaaaatctaggcactaagtaaaagcatttcagatcatcactttgtaaacagccagagtagttcttctaatttctgaaacaatcacctgtaattcagcaccaaaaaaacacacaaaggaataaaaggtaaggaaaaaccatatgaacataaggtgcccttgaaaagtactggcatggaaaagacttgaagattatataacaagactaatccatattagagaatcaaaaggagattaaactcccaaagatacgttcagaagaaaaactactatgaactaaattatccttcctttccatattgttcatgcaatatacacacatgcacaactttcccccactttcacctagttgggatgagatgttaatttaggctgaaggactattatttctctttactcctgttatgccagagaggatccaagaggaaaaaagatatacagtaaaataaaaagattaggaatcagagccccaaggaaaataaaagactgtattaaacatcactgcaaatcaatgtctctgaaccgaattttttaaatattttgcaacgtctcagatcaccatacgtagtgcaggagcaggggaagagtcttcaagagtcatgctagccacactgtcattagaggtggcctagagatgctctggggttacctgaaacaagccaaaaagcccagtgtctatatcaatggctttcctacataaaggcaaatctagggtaagatacctcactttgatgtatatgttactatgttttctgttgctacaccatagactgggtaacttataagccatcaaagttcatttagctcagggttctgcaggcttagagtccaagaacacaaaactggtgtctggtaaggaccatcttgctgtgtcataacatggagaagggcatcacatagtgagacagtaagagcctgccagctcaggtctctcttcttaggaagccaccagtcccatcatggggtccacacctgatgaaattatctaaatctaattacctcccaaagactccacctccaaacatataaaatttgggagtcacattcaaatcatagcaatggagcaccaaaatcccacagggtctttccaggaagaactcttgacatgtccctcatcactcctgtctatgtcaaccagcttggacacagatctacacatgcatggatcaatgactagcatttctgaggtggaagccagggcccacagcacactatataaaaataagactaggaggcacacctaaccattccaacgtccatgttcttccccactgtgcagccctcacatctacattctctcctttagctccctcacctcattatatgaccttaacaatcctgctggtaaaggcagtccccaacccacaagcatataatcttccaaagtttgcctggagatttatttaacttaaagctcgttttcctagataaacgctactaacagcatttctctcttaatagcattctgttaagaagctcccaggctggcctccaatctgaaacccatttaaaccacaatgcagctactactagtttgggaaaacactagcccttcacatctgcataaacgccaaacagctgaacaccagttaggactttgtttccatgtgtctaaaagaaacaaaggtgttgcttttcctacttgattctggctagtaccacctcagtctcaaatcagaagaggataaggactggggaagaaaatgaaagtaagtttacccctttctaaaatgtgaagaaaaggaagcggaggtgatgccaccaggcattggggtgaatctcatgagaagatgctcaacatcattagtctttagcgagatgcaaatcaaaaccacaatcagataccacttcatactcgttaggacacctatgatcaaaatgctggtgaggatatggagaaattggaacccccttgcgttgctggtggaaatgtcaagtggtgcagcagctatggaaaacaattctgtggttcctccaagagataaacatagaattgccatatgatcaagcattccactcttatacccccaaaagcagaaaatagagactccaagaaatctgtacatccatgttcacagcagcagtatttacaataaccaaaaagtggacaccatcaaaggtgtcagtggccaccactgacagatgagtggataaacaaaatgtgatctatacatacagtggaatattattcagccataaaaaagaatgaaattctgttacatgctgcaacatggctgaaccctgaaaatattataagtaaaaaaaaaaaaaaaaaaaaaaccagaaaaggacaaatattggatgattccacttacataaagcacctggagtagtcaaatgaatagagacagaaagtcaattcgaggttaccaggggctggggcaggggaacatggggagctattgttaaatgggtacagtttctgtgtgggatgatgaacaagttctgaaaatactggtgatagttacacaactttgtgaatgtactttatgccactgaaccgtacactcaaaaatggttgaaaacgtaaatttcatgttatatatattttaccataattttttttttaaagcaacaccacaaattagaagagtcagagctaatggcttcacctttggatacctcaaccttcccaatctacagaataggagaaaaataccgtaccacctccgggatcctgaaacttcaggctgcatcatgagtatctgagacctcaaatgctaaatcctcaaatgtaaagggtctacacgacagcatgcatcacgccctacacacctgccaggtggaagcttttctaagctagatggtcgcacagaaagcagccatgtgtacatatgaacaagtttcctaagtttgcaagttctttgttaaaatcttcaatgaaattctcactctattaacttaactatcataaaagagacattatatcatagaagagtaaaattatcatagtaaccacagcaagtatgctgacaaagatgttttcgatgtagctgtttagaataaattactaggacaaacatctggacccatggccaccaggcactgggcaaacagagctcaggtacagtctcctggtgaggcagcctggccaacctgggttaccccagtgggggcctaaaaataaaagtgacaagacacacagcccgatactgagtcgcatgactacgcaggcatttcagagtgaagtcaaggtgcttaggttcctactgggccgccaagccattcagcatcagcgccggtcccatctgcaggcaaagaatgacacaactacctcttcatggaatattcccagtcaaagcccacttaataacgaggtccttctgcagggttaaacaaacctcagttagaatgcagcatggtgctgagtggtctttcaaacttgcttgtatttacagtcagccaactgcagattgaacatagtcgggagaaaaaaaaacaacaatacaaaatacactataacataactagtataaatgtatttacatagcacttacattaggtattaaaagtaacctagagatggtttacagtctatggaaggatgtgtttttatatgcaaagactacaatattttatataacgaacttaggcattctcagattttggtattgacggtgggggcgggggtgatcctggtaacaatccctgcagagacctacagacaatacacagaagtctcacatacgaggcccagtgcagtcaggcctgtaatcccagcattttgggatgccaaggtgggcggatcacctgagctcaggagttcaccagcctggccaacgtggtgaaaccccgtctctaccaaaaatacaaaaatgagctgggcattgtggcacatgtctgtagtcccagctacttgggaggctgaggcagcagaatcacttgaactcgggaggtggaggttgtagtgaggtgagactgcaccacggcactccagcctgggtgactgagtgagactctgtctcaaaaaaaaaaaaaaaaaaaaaaaaaaaaatctcagatacaaggcttacataaagaaagcattcaataaatgttgactgtaaattagattttccttgctattaaacattactcataggtgacgatgagtgatatttaatcactattaacaactgttttcctatctaaatacaaatttaaggaaatatatgcgtaatactccctgggctctctcctcttttaagacctaattgtaattgcgctttcggagagcaatttcaacagctgtaagacttgatttcatgatatcttacttaaaatggaaaacctgggtgtgggcttagtccacaacaaccccctttctctgaacacagcccctcctactcactgaggtgggttccactaaatgaactagtgaattagccctcgtgcagacacttaagtctaacagtatgcaattttcccacccccagcatttggatttgaaacaggtggctatggccgggcactgtggctcatgcttgtaaccccagcactttgggaggtcaaggtggttggatcacctgaggtcatgagttcgagaccagcctggccaacgtggcaaaactccatctctactaaaagtacaaaaaaaattagccagacatggtggcgcacaccggtaatcccagctacttggaggctgaggcaagagaatcgcttgaacccaggaggcagaggctgcagtgagttgagatcacaccactgtactccagcttgggtgacagagggagacactgtctcaaaaaaagaaaaagaaaaaaaaaaaaaaagatgtcaggcacagtgtgtccctggaactaaataacataaatccaggcgctgtgcatcagccaccttctccacacacccaaaagcagagaaagcaaatctctacagagacgtggatgggaccaacataccaaggggagcagaaatgaaaaacagtgaaggttagattgcctcactgacttggttcctgagaacctgccagacactaagttcttagaaggactccatatccttatcacacccatccagtttttgtccctatttgcttgaatttttatgactttccattaagagtctcaagaaaactatcgtcagaaatttattataggaaatatttcagcagattttcagtatattttccacatctgtgaagacttagaaatgatgaaaatgttgacaagaaggaattagaaaaccacagtacagtgattcaataaaatgcaactatttataaattatgcagtttacaaaactaggaaaaatatttttgtgttttatgattcctgctatgtaaaatatgtagaaaaagcaacacaggaaaacaaaaacagatgtgggtgggggtatggagctgtgggtcactgatgccattttattatcttgcctgtgttattaaactaggaagaaaaatctaattgccaaaaacttgaaataacccaaatgtccatcacgggtagattatttttttttaattgtggtacattcatctgatgaaataccactccacaacagaaaggtaaaccattgatacacaaaccacacagatgtatctcaaacacatacgctaagcaaaagacgtcacacacaaaagtctccatactctataactccatttatataatattctggaaaggcaaatctaagggaacaggattggtgtttgtctaagaatgggcaaagactgaaaggggcacaaggaaactttgaaataatgaaaatctattttgctgagtgtggttggtggttgcacagctacaggtgtttgtcaaaattcattgtactatacacccgaaaagtgcaaattctgctatatgtaaattatacctcaataaaccagacttaaagaggagggcaggtgtggtggctcacgcctgtaatcccagcactttggagggaggaggcaggcggatcccttgagcccaggagttctagagctgcacggtgaaaccctgtctctaccaaaaaatccaaaaattagccaggtgtggtggtgggtgcctgtagtcccagctacttgggaggctgaagtgggaggatcgtttgggccctggagggggaggttgcagtgagctgagatagcaccactgcattccagcctgggtggccgagtaagactctatctccaaaaatatataaaaataaaaataaagaagacactgagctcagacaccaaaccaaagctactgaggcacctgtaaggtgtctgttttataatattggatgacattcatcattcatcaaatgtactgagtgcccatctaatgccaaatgctctgctatgagctagtacagagtgaacaaaatagacaaaaaaatagacacaactatacaaacaaactacaggtcacataggaaagcatggatgctctgattgctattacgggattaggggtcaaggaaggcctctctgaacaagtcacacaagcttagaccccaggaataagtagtaggtaaggaggcagagactggaaaggtttctaaatgtgtcattacagcagtagttaacagcaactcaactgtttcaacatgtgacgggtggttacagtttactattttgctgtgataaggattatggcctcctacataagaagccctagtaaatgaaggttttaaaacagcctaaagacagtgaccaggagacgtaatgatgtgttttggatttcagggaccatcaaggagtacgttcctccaatccttgtcaatatttcaaaaatgatcaacacatgtatgtatttccctgaaatgaggttgcctatgggtaaactaaaacccatgttctggtgtttaaaagatttgttgtatttgttcttacttctggctgaatttgccattatttatttaacaaggtttcctgaagcttatcaacgtttctaaatgataatgacactcactcactctctctctcaccaaaaattggaaaaaatggtcccagtttgacaaatcgaaacctcttcacaatacgggaatcaaccttaaagaaggcccccttcacttggcttcagaggccctactctatcttggttttcctcctaaactcacagacttctctttggcaaatgcctctaagagattcttctttgatcaacatccaagtgttggagggggggcgggggcagccccttattccttctcttccttcactcactcttgtttcaaatacactccgataacaattcccacatactcatctctagcactgatctttccccaaagctccaggtttgaattctcaactgtcaatgtgacatctccacttacatgtttaacaggaatctctgacatgggttggatgtgtgtcccctccaaatctcatgttgaaatgtgatccccagtggttgaggtggggcctggtgggagatgactgggttatgggggtggatccctcatgaatggcttggggctgtccacaagagggagtcagttcttgcaacatctggttgttgaaactgtgtggcagcggactctgggcacacttcctatggctttgccctgctccacaagggacagccaaaaaaaaaagtgtggtacctcccccgtccccttgctcttgctctcaccatgtgacatgacagattcctgctgccttctgccatgattggaagctgcctgcggcctcatcagaagcacatgccagcaacatgcttcctgcacaaccatgagccaattaaacctcttttctttatacattacccagcctcgggtatttcaatctagcaatgcaagaacagtctgatacaatctcaagcttcaagtctaaaagggaactctgggcttccagacccctgcccatttccttcttgtcctagtgttcctggttttcaacaaaagacaccatgaatatacctcaagccaaaaacctaggagtcagcaataatctgcctctttccctctctccccagtagcaactccgacaggcactgccttcaaaatacatttcaaaagcaagcattcctcaccttcactattatcccaggtccaagccaccactgtctctctctgggactactaactggtcaaatcatgagcctctgcctccttacaatatattctcaaaacagcaaccagagtcatccttctgaattgtactcagttcctgccattcctcagtccaagccttctaatggcctcctatcacatctaatacaaaaaagggacccagtgacctaagacaataattagcaacagactaacctttatgcaaaaggtgacgtgaggcatcatcgaaggtaagggagtgctcactgccatgacaaatcagatgacacagcttacacttcatagtcaatcctgaggggctgtggaagaatctaggaaactcaatgacatttcacccctaaatcaacaggtgtgcaaacagaattatcctcttatctaatcagatctccataagtaccctgaaggcttcaaggaataagagtgtgcctgtttttgaccacggattatttacttgcacaacttctcaagtgatctgtttccacctaaaatggaacaaaggagtctctaaaagaaatactacgtttcaaatatctcatagccaatcagcaaacaactaccattctgaaaagattttgtctgaatttccaatcaaagtttcttccagcccatatgacttcaacatacaatttgtaccacattgtaaccaaagagttattagtaagaatgttaaataatcctcccctaaatttcaacttaaaatgtgtagtctttgtttaaatggcctgttgtctgcaagttttgaaacaaggcttcactttgtgttcaaaggcagtataaggaaacaagacatgttactgtttcgattcctctgaatgacagtgattaatattaaacacaagagtttcttacaaattagaattatccagaaacatatcccagtaagcctagcctcataaaatgactaacttcaatatttactttcatttctaaaattttttaaatcaaccactaagactttaacctccccctacacacgccaagaagaaatgctggctctcccctgcactggccacacctgtctttagacagcacccctttcctgctcgacggcctcctgcccccatcatgtgatcaacctctggcatcaggaaggcagtggtggctctgtgccatgaggtccctctttgtaggctgtggctatttttgggctggcagcccctctgattcctgacttggccctagataatcatgaggccgcctttagagagaaacccttcagaagccaggcaggtccctgtgggattagcaacactccactgctaacacagcaagtctcaggtcctaagtgctataaaggccctccaaggacagcgccctctaacctgatggccctcggttggccagacccaaggctgggctcccatttcaaatgggcaagtccgtggttttatggggctaacaaatcaaagctgacacagatatactactcatacatggattttagccaggaaatttcaaacaactcaatgatgggatttttttccccccttaaatgtcatgtccattcataacagtgagatttcagatgtgtgtaacagctttgggaaaaggtattgataaaaatattcaaagaaaatgttagtcacttttcaaaaaaagcacagcataccaagatgatgtagtaagttaaatattcccttgtgctatttatagacataaccatatactgtatcatttctaattggaaaaggtctaccagagatactatacacctgatcctaaaactatacattatcttctgctacgcctctaggaaacaagactataataacttgaattttaagaactacaaattcaagataaatatttgattggtttttccatctcactattaaaatgaagcataagaccctcaaattaggtttaaatgttttaacagtgaagttttatgggagagtacatccaaaaatacagagaaaatacatttatgtatttcatatcacacctttcctccaaggccatcatgacatcaaaactgatcccttttctttatccctaacttggattttgtaaagaattgtaacatcttttctgaaaccacaagtctacagtgtaaaaaatgtttcattcccaggtttctactggcaacattaaatgaagaccttatgaaacctggccgggcatggtagctcacacctataatcccagcactttgggagacagaggtgggtggatcacctgaagtcaggagttcgggaccagcctggccaacatggtgaaaccccacctttactaaaaatacaaaaattagccgggtgtggtagtgggcgcctgtaatcccagctactcaggaggctgaggcaggagaatcgcttaaacctgggaggcggagtttgcagtgagccaagatcgtgccattgcactccaacctgggcgaagagagtgaaattctgtctcaaaacaaacaaacaaacacacacacgcccttaagaacgcaatgaggataacatgttggcccttgtatttgagaaggcaacctggcttgactctgagctacagctccaagaaataaagacgatttgctcactggtcctagctctgacaataagcacctgcccagtgaagtctctggctgtgaaggtgagtgaggtgttctctccattccatccattctggagttggaattttccaaacactgctaaaggtgggggtgtgccaggaaaacaaaggaacacaacatggaccagccaagttccctctcttgccctcataagcagaacaaagtctcagcactccaggactggccgctatttgcctttcttagatgggagtgtaggaagagggagcataccaggccttagaatctgtcctcactagacatggaggaggagatgatgtaattttttttttaaataaaaagatatgcaatgcgcatgctgttgtgctatgagaagaatgtggaaattcacaagttgggcattgtttagctttgtatccctgtggctactgtgttcaactcagcctgaggctccatgaagacggtccttgagtctgacttccaagggcctgacagcctattggtgacagcctttacaatcactggtatctgaagctcaagcaagacagacaccaactaagtacccccagcagtaatttctcaaaaaacaattcagtaacatgcagactccatccttaacggcaatctgaggctctgctgtggtcaacaaataccactgacagtggcccggaccaccactccaattcccaaagacctatgggccccgatgacatgaaggtcactcagagcttaaaggcagagatgaatgcaatgaagatttccactgaaagatggcagagaaatgttctacccacactcacccaattgagatttgtggaattcaacagcccccaaacgttttaaaagcaaataattcagtatccattcatgcctttctccaaatgatttcaactcttcataaagtaatcataagttaaataaaataacatctctccttttgatactaacttcctatagcttagccgttataggcaaaatggcagtgtggtttaactgaatccacatttacagttgagaatactcctactccctgctgttacatcagtgtaagatgttttagttggcaatctaaaccctgctaattttcttacaactgtttttttttttttttttgagatggaatttcactcttgttgcccaggctagagtgcaatgtcgccatctcggctcactgcaacctccacctcccacattgaagtgattctccagcctcagcctctcaggtagctgggattacaggtgcgcaccaccatgcccggctaattctgtatttttagtggagatgaagtatcaccatattggccaggctggttttgaactcctaatctcaggtgatctgcctgcctcggcctcccaaagtattgggattacaggcatgagccaccatattaagagactttcaagaatgaaatgatccctgtgtaatttttacgattgagttccaactggctacaaagagaggaatgtatacaatagcatgcagaacagtctccgagaagttccgtggctacagaatgggggcatttctcacaccactctgtcagcttccttatccctgttacagagtgacctttttataacaagaagaactttttttttttttgacacagaggcttgctctatcacccaggctggagtacagtggtgcaatcttggctcactgcaacctccgcctcccggcttcaagtgattctcgggcctcagctgcctgagtagctgggattataagtgtgcaccaccatgtccggctaatttttgtattttttgtagaaacggggtttcaccatgttggccaggctggtcttgaactcctggcctcaagtgatccacctgcctcggcctcccaaagtgctgggattacaggtgtgatccactgcgccccacctataacaagaacttttattcatgcaacaaacattcctaggtcctctatcacatgcagcttctttgctaggtgatggggacacaatgctgaacaagatggtcccagccttcaaagagcctccaaagagcctccagttcagccaggaagacaaaaatgtacaagtaaataattacaaaaactgcaaaggtagaagcgactggaggctaaagggacccagagaataggctccactgttacagatatggagaaaacagtgaaatgtcacttccagaagaagataaagcttgagctgagactaaggcataggcaggtgagtgcttctcagcctttcagattttatggacctgtgacatccacactccaaaactctgcagagacagcatggggatgtcagctttaattttgccaagaggggcacttcagacaaaatttgtacgactgccaacacatcataaaaggacattattttaatacaaaaagtgaaaggggtacaaaactgcagcataaagaacattcctttagtttacgtaatatacatttagccttatgaaaatcttggtacactgtatttttattccatctcaccgtgttcaagtcaacattctgtcaccaggtaccccagggtcacagatgcacatttggaacctctgatctagatgacaaaggcagatctggagggcagtttctcacctctgcaaagatcaaagcaacagaccaggagagaaagaaatacaccaagggaagtactgagagggccgatggatcagcaaaggcctaaggccaggtaccatgggtcatgcctgtaatcacggcactttgggaggccaaaacaagagaatctattgaacccagttcaagaccagcccgggcgacacagtgagactctgtccctaaaaaatttaaaaattagccagccatggtggcacatgcccatagtcccagctactcaggaggctgacaccagaggatcacttcagcccagaagttagaggctgccgtgagccaagactgtgccaaagcactccagcctgggtgacagagcgagaccccatctctggaaaaaacaaacaaaaaaaagcagcttagaacacgtcaaggaaggtcagtgtattctgacccttcttgcaatggaagccacatcaccaacacacgcacgagcctaggacagaggcacccaaagaccaagcccgatgagttacttccgtagagaccagagaggtctggaaggcagtgcctggcagcagacagtcctcacccgctgccatgatgctaaaacctcctccaggacccaggcaccatctcagataaaagctcttcaaggacccaggcaccatctcagaagtgggtgagccgctgaggaaggaggaaatccatccttcagaggagagaagagcctcagataggaagcgtgaactgaccacacttaaaatcctcaaggagatatttatctgcaagcgactctttgaaaccaaaaaacactgagttatcttgaggttgccacattatatgttctctacaagtgaggtgaaatgaggatgtgtgaggcagttgggttataaagaaataaagttccatttggggtcacaatgtgaatgtgtaagtgtcccacctgcttccgtagttgagagactggctggggctggaagaaatggatccacccgagcggtatgaaggagctgggtttcatatgtgatattaagagttaaggtgctacgttaacaaccaacatttaacactgcaggggtagcgctttatcacaagagactttcgctcaggccacagtacatcagttcttcggatcccttatgaactcttccacctcaaaccagcatatactgttttgtatcacagctatacatttcagaaagaaaataaaagttgaatttttaaaaaagactctttcctagtacacttgacaagcattgtggagtgaggctgacctcattgctgaaaagcgatcggaagcttcaggacatcataagggctggtgagagaaagcgctgtgtaaacacagtgtttggcaaatccaaggactgccaaggaggggccaccgctccctgacaccctgtcaattccactgctccacgccaggccagcacagtttgtgaggccaggatgaggaacaggccacagcctccagcatgggtaaagataacgacatcagtgcacagctcttcaaagtccacagtgttcccacagtcatcctcccagtagacagtcccatgtgacagacaggtcacatgacagtcacattcccccatccctcctcctctgagatgctaaacctgatgtttccagaagttgagtaccttgctcaaaacacagagttaataaatagcagcaatggacattaaactctactccaatgtgtaatcttgatctatttccaccttccttctcacaataacgaaatcacctaaacacctggtaggtctgcacagctatggaccttatagccacctgatatgagaagcatacgtttatcaaggagctcctaaactgactcaggaactgggttacctgttacaagccaaaaatattcttcgcctcattttcctcatggacaaaaactgattcaacaatccatctcatagggtcgttttagagttaaataaaatttttggaaactttctaatacacaattgtacattgctactgttatgccaacaaccttgtaaaacaagccttattatcatcctcacttttctgatgaccaaagctcaatagtttattcatccagtcacgaagactttctggctgggcacagtggctcacactgtaatcccagcacttcgggaggccgaggcaggcggatcacctgagtaaggagttcaagaccagcctggccaacatggtgaaaccccacctgcactaaaaatacaaaaaattagctgggcgtggtggtgggtgcctgtaatcccagctactccggaggctgaagtaggagaatggctggaacccaggaggcagaggttgcagtgagccgagatcgtgcccttgcactccagcctgggcaacaagagcaaaactccatctcaaaaaaaaaaagacattctaaggtgatggacacattctgtatcttgattggtgtgatcgttacaccaatatgtatttgtcaaaactcatataattgcacacttaagccaggtgcactgcatttcatcacacttaatgttatctcaaaaattgtttcaaagatcatgtggtagtgaacagcagtgtgtattctgagacatattcatgaattcttattggaatctacagattttttccgcattctttttctgtaatctgcttgccaactaatccttcctacccaacagaaacccttaaatgttgacgatagctactagttaccgtttctgtctctttactcagaatttcatgttttactgttacatcctgaacatattcatctagaaccttccactgaagtaggtctctgtccacaacccagtagggtacgacagccacagactaaaccaccaccttgaaaagcaggctaggaaggatcatgtgccagctgcctgcagtcctaactcagccgacttctgagaatctcaactatatttctcaatctaagtcaacattccttcaacagtttattgaacaaaaataaaaagcacaattctaaatactcctcccagaggaaggaacaaaataaagcccttgctctcttagatatcacatcatattgtagatgattttcaaaattccatcagaaagtaacctttgtcatgaaaatcagtaaaaaagaacaagaggcaaaacagtaagtttcaggatagtactgggtccaaagtatttacttttatacaatgagctgtttgtatagaagtaaataattaaaagcaccatctacccccagggcttatcaaaggcactctcaaagactgtacagttatgctaaagaaatgatttgatgtacagactgtgcatgcttttagttgtctttttttttttttgagacggagtttcactcttattgcccaggctggaatgcaatggcacgatctcagctcaccacaacctccgcctcccaggttcaagcgattctcctgcctcagcctgaccagtagctaggattacaggaatgagccacctcacctggctacttttgtaattttagtagatacagggtttctccatttggtcaggctggtctccaactcccaatctcaggtgatctgcccgccttggcctcccaaagtgctgggattacaggtgtcagccactgcccccggccacttttagtttttaaattatatgcagttagtttttaaaaactacctaaaaggtagctcagactgtttgagggacgtgggggtagatcgcgtgggcagggcagagtttacagctgaaatataaaatctttaccccaaagtgttaaatgaccatgaacatttccttgtttagaaacttcagagttgtcctctctctccaaagtccacttggtgaaaaggaaataattttccatttgaatcacgccaacaccaaatggaaaatgtctttatgtgtgtgtagttacgcaagttggcacctcaccttatacctcccaacctttattaaacatcgacttcctgcacccttttcttgaaaatgattacctatgttaggctttctgctagcaagagttctttaacagaaggtgactgtatatacacatttaactcacagcagcagcccaacgatagccaacctccaaccagggcctatttatacagtcctaaccctatatattccttagaagacaatttggaaatagagaactgatgacttttagggctaaaaatcatgactgatattcagctgaaactgtggttttgtgagggcattcgtctcttcccagttctgacactggcctcacctcctacttcagtttccatctgggattacctccatttcctccactaattacctgccgctcagtagcttacaataaggaaacagaattcaagatttctacttttaaaaaaagtttcaactgggcacggtggctcacacctgtaatcccagcactttgggaggttgaggcaggtggatcacaagatcaggaaatcaagaccatcctggctaacatggtgaagccccacctctaataaaaatacaaaaaattagccagacatgatggcacacacctgtagtcccagctactcgggaggctgaggtaggagaactgcttgaacccgggaggcagaggttgccatgagccgagatgaagccattgcactccagcctgggtgacagagcaagattccctttcaaaaaaaaaaaaaaagtttcaggaaaaaaaatagtagttgctatccagcatataagaccacagactgctaatctatgaagtgagatacaaaaaatctaattattcaaatgattgtttctatacagttctattaggacttattgcaaaaagcagtctgaaagctataaagtcctatgtaagtggaattcatgattgtaatgatctctaactgtcaatttttcacttgtgctactaatctgaatggcttacaacatttaacattcggctttacgttctgtgattagaaaatgtgaaaataaaccgtaattctcagctatgtcatttgaaattttacatatcataactactgcatgacttggcctggcacagtggcttactcctataatcccagcacttcgggaggccaaggcaggtggatcacttgaggtcaagagttcgagaccagcgtggcctacatggtgaaactccatctctatcaaaaatacaaaaattagccgggcatgatggcaggcacctgtaatcccagctacccaggaagctgaggcaggagaatcgcttgaatccgggaggtggaggttgcagtcagccggatcgtaccactgcactccaacctgggtgacaaagcaaactatcggtgggggcggggagaagttttatcccatttcagcaccaatgtatagaaaatcctggcaacagaaacttattacttccactcgcattaaaactagtcaaataacagcatcatactgggtgtgggaaatggaccggtacaagtccagtcccagttccataacttactcgccataagacaaaacatttatccaaatagttctggtccccagtctccttcagtataaaagaaagcactcatgacctgctctgcccaaccgcagggctgatgtgatcagttcttaatatcatatttacaatgtgcttgccacaaacatagggaattaatatttcactatgcttaaaagatgaaaatacaaaattgcttttatatttaaatactgtatattaatagtaacattttacaattgaaactctaaaatacaaatattctggactatgttacaggtgaaaaatcagaacagggaaccttagtactgtaatatccacaagtccaagattagttcaaagtgatgactcaattgtctttcgaatgtgctgactgatagcaaagaggcaacataatttacagactttaccaaagataaaagtatctacattgattttttgaaaacacagttcaaatggagtatcagcagctcactagacttaaactttcaagaaaaacaagaggtgacaaagctggagtctgagaataaacaatctccaatgtttgctacaaatcaattcctcctaaggaagagggaaagttatcagcctcctgagcctagaatttaactcccaaccgacagcaccagcagatccaagcaacacctccaaggctaagcagcagaaattaaatgaaacacctatctatgaatcagaagatttaatttaaaactagagactaaggaaggttattagcacccattgatcattttctatatacctggcacctgtgtcagaataaccccaggagacaaggtactacccccaccttccagcgtcctgatgagccaactggggagcaaaggtaatgaaatttcactcaaggtcacatggctaataggaaaatctcagacatgaacccaattttgcctgttaagtctgtgcactctctatgacattactgcaccaaatgtcctggatacccattacatttttccaattctataataaagtatgtccccagggtttcataatggatgtcatggtgggcaaaatctagctaaatggtgaaatacctctatttattatttgaaattcaataaaaacaggaggaaggagagaagaaaagcagtccctagcactgaaggatggagggctaatcattcaagatcaaaacaactcacaccatataaggagaaaatagttttcatttgattatatatctacaaggttatacatttttaaatgttcagcctaataagctgtaaccagaactttccaacaaaatagtcttatctgcaatataaaatggtttaggttttctcatagaaacagaaatgtaggatttttcttacctcccttttcattaactgaccctactcttttaaattcaaattaagagtaagtaaatccctttgcagaggtgccatcaaaaacactataaagcaacatcagaaggctgggcatggtggcttacgcctgtaatcccagcactttggaaggacaaggtggacagatcgcctgaggccaggagattgccaccagcctggccaacatggggaaattctgtctctaccaaaaatacaaaaattatccaggcgcggtggcgcatacctgtagtgccaggtactcagaaggctatggcatgagaatcacttaaacctgggaggcggaggttgcagtgagccgagatcacaccactgtcctccagcctgtgacacagcaagactctgtctcaaaaaaaatctgaaagcaaaacaattttttaacccttaaacagaaaatacttcttcacagcattaaatcaagttcaataaccagcaagtctagagaactattgaaaagttttacataaatgcaaaactactctgaaacacaaatcttattagatgtaatgagaaaaaagaatcctagactgcaaagttatctgaattcctaagttgtacatacatttttctctaaacagaaaacagcccaagtccctagtcaaaagaaattgtcaacttgcgattgtctgcacgaatagggaatgtcataaatcatgagtggaatcaattacgtacatgtatttgcacatgggtatgccagatgttctcaaactgactcttcataataaaacagtaactcagaagcatcaggaaacttggcaccttccagctctgatgctctgctcccaaagccatggccgttcagtcggacacaagactgagggtaaactaccttccctctgcttgctgagtatgaaacaatggatgagggggtgagggcaagaggagagggcaaggagcaaggcacagaaaagcaataaggaaattaatacctgtggtttaaaagaccttccagtagctgtgactatctgacaaaagaatttcaaattcccatgccatcagagctctagatgatttattccagaccacatctgggagaaataattataaaagtaaaaatgtacccagcatccgaacatttagaccctatccttaaggagcttacaagatgtagcaaaaatatactggaaaaggtaactaaagattctcattgagagaaattaagagacgccaaagagtacagtgctaagtattttccttcttaatccttttggtgagaaggaaaagggtaagcatgattaatgacaaggatgctttatataaccaagaatgtcaatacaacctacgtgaccaaactttggtcaagtcagcaggtggaatttttaatgcaaagcccaacgttaacaacctgggagaatatttcgaacaacacaaacacttactaacatctccaaaactgcacttttcacaatgattggggtttctctgactcctccaagaaaagaggtcaaattcttttttttctcttctacctcagtgtttggcccatagaaagtgctcaaaaatggctgaggctgaggaaaaccaaacacaggccgggcacagtggctcacgtctgtagtcccagcactttgggaggccaaggccggtggatcacctgaggtcaggagttcgagaccagcctgatcaacatggtgaaaccctgtctctactaaaaataaaaaatgaagacgggcgtggtggtgcatgcctgtaatcccagctactcagaaagctgaggcaggagaatcgcttgaacccaggaggcggacactgcagtgagccaagatcacgccactgcactccagcctgggcaacaagagcaaaactctgtctcaaaaaaaaagataaaagaaaaaaaaatcaaacataatattctaacagcaaggatttttactcatgctttttatttatcattttacatgaaatataagcctaactatacactacgtataaatgacttggttctgtatgtggggcctagattggggatctaatacaacacgtgaatttttcttggtagctaggtcttggcatggctcagcccttttaaatccatttctcattctccaatatccttctaccctatcctgacccaccagcaaggaggacttctgcaatcctcacttcaattaaagcctgttggcttagggtcacagtaataagcaaatatggttcaattctgtaatttgattaacaacgaaatgattaacagtatagcagtttacagtataataaaaaataagattttaacagtgcaaggtgacttaatcagaattctgggaaatatgactcaaccaccttgacacagaggtcaggggaagggggtaggtctatgtttcaatgtcatctcagaaactgctcatatctatgctggcttctattttcattccgtaaagctagccaagggagctatgttttacgaggacatgcagtttcaacttcgtatcattcatagctaacaatcatgcaaaaatctacaaaataaacattaaggaaaataaatttcttatttgtcactgaacactgctgaatacctcctatgaactgcttatctgaaataaggtgaagaaatattgattcttttcatccagattggtatatgtgtaaataacacctgagttaaatattaccatgtttccaatgtacaaaaagcataaaagataagctaactacccaacagtcaagacttaatgaacactgtcacaaacattatttacacaagaatgtatgttacgcctcttcttcctagtctcctgataagtatgagtctttcccaagattcccttttcaatgtcattttaggacacaaaatgtccttaaatgttttagttaacagtagaagatcagaataattatatttgattagtcctcaaatttaaatactaattttcttttcttctgcatcatgcttaagacacaatttacttataaggtacacatttatgcatttaaaagaataaggtcatttaatggtttaaaaacctcttccaatacatcttacctgaaagactgatccattcctagtctgttcttccctttagatgagttcacactgtgtcctagcaataaagcttctaggttagaatgagggtaaaatgtgtgtttttcttacttttatttatgtagctaatgtgtatacaagaatattccttttattcctttttagacagagtcttactctgtcacccaggctagagggcagtgatgcgatctcggctcactgcaacctccgcctcccgggttcaagtgattctcctgcctcagcctcccacgtagcggggatataagcacccaccaccacaccagctacttttgtatttttagtagagtcgggtttcaccatgttagccaagctggtctcaaactcctgacctcaggtgatccacctgccttggcctcccaaattgctgggattacaggtgtgagccactgagccaggcccaagaacattctttttttctgtttttcttttggagacaaagtctcactctgttggccaggctggagggcagtggagcgatctcagctcactgcaacctccgcctcctggattcaaggaattctcctgcctcagcctcctgagtagctgggattacaggcgcccaccaccacacccagctaattttttgtatttttagtagagatggggtttcactatgttggccagggtagtctagaactcctgacctgaagtgatccgcttggcttggcctcccaaagtgctgggattacaatgagccaccacgcccagccccaagaacattcttactttagatatgggcctgctagcaagatttaaatgcagtttatctttgaataaatacatttttattactttacaatatacagcttgaagtctaaactttaatgaacaaagttattttgtaatcaagatttatatgcaaatacgtacttctaaagtacctgaaagctatttacttaagtgaagcacttccaagttcgaccttgttcacactctaaacttgttgagaaaacccaccctttcttccttgattgtgtaacatttatatatcagagcaatcacaagttgccaatctgcttctagggtatgaaaaggaagttttatcttatgtatccacatggcaaagagcccccaaatctgtcacctccaaaatggaagtctcttttaccatttctaaggccaagtgagcaagaaaaagtcatgattaatgtcatcatggaaaattgccccatatccaagagtaaattcaaagattactgagggatttttctctaagaaaataaataaataaccatcatcagggcaatcatctacaaaacttggtttagaaataaatttttaggccggacttttaggccagacacagcggctcacgcttgtaatcccagcatttgggaggctgacgtaggcaatcacttgaggtcaggaattcgagaccaagttggccaacatggtgaaaccctgtctccactaaaaatacaaaaattagccaggcatggtggcgcacacctgtaatcccagctactcaggaggctgaggcaggagaatcacttgaacctgagaggtgggggttgcagtgagctgagatcgcacgcaccactgcactccaacctgggccacagagtgagactccatctcaaaataaatttttaggctgagggcggtggctcatgcctctaatcctagcactctgggaggctgaagtgggaggatttgcttgagcccagcagttcaaatccagcctgggcaacatggcaaaaccttgtctctacaaaaaatacaaaaattagccaggcatggcggcacatgactgtagtcccagatactcaggaggctgaggcgggaggatagcttgagcctgggacgtgaaggctgcagtaagctatgatcatgctactgtattccagcctgggtgacacagcaatatcccgtctcaaaaaataaaataaaataaaataaaataaaaagttagaagaaattacaagtcaaattcaactcctggttatactggaccatccaaaaccaggtataaagtctccctggtcaaagtaggcttttcggggccagatttcaagctagctgagttcataccatcccatctagtccttcatttcctgtgggtgggatcgctcatcctccttctcaggaggccacagtcaccactgtatccgctgctaagtggtcacctccctccggggcctgccttcttccagagaaagtctgaggccatttttaagtgcccctaagcacgcagatcctgaactccaatttcatccttatggctcaaatatggtcctatcgcttactcttacgctctaagcttggggaataaaagggactcaggctctcatggagaacacacttcctttagtgaggactttcagggtatattcaagctttcacaacacagagaaagaacccaactttgagatatcaggaagacgtgttcccccgcccccccaaataaatactttgctgagtagcagtattggaaattaatccaggaaattttttaactacgtatgcagtacatttgtctggacatcaacaagtccgtatgaaaccacaataatgactataaaaagaagaatctggcaaaatgatactacaaatagattactgacaataaatggagtgtgagcctactttgtataatcacagaataacagatctgaaaaacattcagtcttagggatttaaaactttctgctctgatttcaaaggatgttgttcctaatagtatataccaggcccagtggcttctcatcaacaaatgcaattagttttgcaacagtctctaacccaagatatggaagttcttgcaatgaatttgaaaagattctaatttagaatttggggaattttttttttttaagatggagttttgccctgttgcccaggctggagtgcactggagtgatctcggctcactgcaacctccacctcccgggttcaagcgcttctcctgcctcagcgtcccaagtagctgagattacagatccatgccaacacaattgactaattttttgtatctttagtagagacggggtttcaccatgttgcccaggctggtctcgaacccctgacctcctgatccgcccgccttggcttcccaaagtgctgggattagaggcgtgagccaccgcacccggctggaaaattttttttaaatcttctaccacagtcacatatagttctgaagctacgatttagaagtgttaaaaattctgttttgagaaagtcaacagatttatcaacattaaagaaatttgtgtatgtcaaaactactgtaaatatataaagcaaagataaaatgggaaaagtatctgcaatatgaatggcaaagatttactatcaatccataaaaggctcttatgaattaatggaaaaatactaatatcccaggagaaaaatctggcactacatcaaatttcaaaatggaaaacaactagatttctttggtgttcaaatcatctgtaatcaaagaaattgaagtttaaatatagagaaagcactgttcacctataaacctgggaagaattttttttttttccctttaaggatgattctacatgttgacaagaatacggtaacaccagtattctcacagagagctggtgggaacataatttggttaaacattttttggaaagcaaatggtcaatatgtatgaggagatcttccaaccatcaactgtatttcaagggcactaaggatattaaccctgcacataaagttttaaaaacgtatttgttgcaaaagtatatttagtaagtggaaataaatgaaaaccagtttgatacatctatgtaatgtaatattaagtagccactaagatttctgaagatttcatgacatggaaaatttttcatgatacattaatcaggaaaaaacctccacgcaatagtatatttagataaactatataactataaaaaatttttctatatattaacaagtattttcttaaatattaactgtgattatctttgctgaaattgcttaactcacttttctcaatctacctatttttatacagcaagcacggattacttttgaaatcaaaacaaacagggttaacagaacagggctattaagtaacaggctttttaaatgcttgagtgtaataactgcaggttagtttccaaaaaatataagatattatctagaatcttataatcctattatactccaaaatgtaaccttgacttattgacataattaaaaggtcttgttccaagcatgattttctaccaagcagatttaccaagaattattttctcttcataaacctgattttaaaaagaacaggtgaaaaaacgtggtgcaagttacataaataactacatattattttaaactaaattccacttctaaggttttttagctttggttttaaggataagcatgtagttctaatcttttctttgtatagctttcctaatggaatatattgcctatgaaaaaaaaaaaatctgtaacagcactttctacactgtaaagcactgtactaacaggacatcaccattttaagttgtgtatcatttcctgccctaaccatccctgaaaaagcaaactgtctacagaattgcaattccgtttatgcaattccttttaaagttgtccatgcactgttatcttgtatataccctccttaaagaggtcactggttcccaggaagcaatgactctcttttttaatcccctccctcctgcattgcctcccttcctcctgaaattcactggtaacacccctactcccaccctccagccccagcgctgtgatttagtgatgattgactttcgatcacctgcacctggcaaaacttgaaagcttccacgcaccgttttgcctaagactttggtttcattgaaacaaacaaaacacactggatttcctttcttagaacactgactacttcaaacaaacagtatttaacagagtatgtgtaactacgcaggctaaatgaattaacctcttccttcctagtcccaaattactccaagtcaaaaatcaacaaacaacttggtagaaaggagtacgtcttcaaaaaagaacaaaaacgttcctcagtgaacacctaagtccactaagcactatagagtagtcaataaggtcaccttaattaagatgagatttttctagagcgtgaaaaagtgcaaacaagctgcagaaagtagcgaggcgccacgaggggtctttgggacctgcagcaaccctattccacccgctttctcggccccgcttgcttctgctgagaaggggccctgcgagaaggctgggaccgccgggcccgggtgggcggcgtaaggagtccacagtcaagcccctcggtcactttcaaggtgacagcgacgagatccgcatccgtcccttccgcaggctctgcgctggcccacgtgagacccgcctccgctccgccggcgctgccgccccctttagccctcagcttcggcccccaggcccctggaacgccccctcccctccccgaggaccggtcccgtcaccctgggcggcgcgctcgcctgtcccctccccaccccggccgccgggcagcgggaacagattccagcgcgcacttacccgcagctccttcaagcgctccgggagcaaagacgcagaggcggggagggctggcgccctttgcaccactggcggggtcgccgagaacccgccccggaggtctcgggggcggcgtctgcacctgggggcgcgcggcgcggcaccaccccacgcctgcggcggctaccaggcgggacccggagccccggcctccccgcctccccgcctccggggccgccagggggtggagcagggcggggagttcgggaaacttgtaaatagccgaactcgggcctcccgccccaacccggggcggctccttccgaaggctccactccagcggctcgctgcgggagaccaaggccagccgccgtcccaggggacggccctcggggaacctgaatgacgtgcgaggccgtacctcggggcgctggactccgctcgggcgctcccgctctccgctcccgctctcgggtcccaatcccgacgctccgcgcgctcccggactaagtgcggacgcgccccacgccccccggcgccagcccgggacagcgctgcacctgttgccacgtgcgacgcggcgctcagcggctgccactgccgccggcgcacctggctgcaccgcgcgtcccgggaccacgctcgtccccgcaggagcccggggctccgccgcacccagcgctagggcccaggccgggccgcggtaggtgggggatctgactcctgcttgcctctggccacctgcaggccgaggggcctcgcaccgcggggcgtatagaaggtgggaaggttgcagaattatcagggcggaagcttgcaaggaaggagtcgtgattgtctcttagaagggctgattcgcagtctgtattatcttcatgcttctagcaagtttactagcaagtgtgtattaaaggttaaagaaagtagctttccagctattagagcttgagatacaacgtggaaaggagtctagaaccccagggagataaactaggctcgacctacttttctctaaacacaaacacagtccttgctgtttgctaaactgagcaaatttcatcgacagctgtcttctaggtccgtaaaatattttcttctataaagcatatttttaatagaaaacttgtccgaagatgctattctgcctgtgagagatgtcacattgctgaaccgtgaaatgtcagacaacctgagaacaaaattttaatatttcctttttaattacctggattgtggtttgctaaaagcttttaaagagaagtgaacttttttggagaatagacgtaaggactctgtatttcacagttttctataccatgaatattagaataactgacagatgtcttgccattgatagttgtaaagacttttcatatgtacaatgatccattatttcctgactacaaaacccaggggtatataggtcagattatctccattattcaaatgaggaattgaagctcagaaaggtcaagtgactagcgcaaggtcacacagccagtgagggcaagtgcaaacccagccagcctaactcctaatcttctcttttaattccattacataatgacacctctcatttgcttcagaaatccctgttgtaaagatagatgcaactagcatgatccgtgttgttaggaaaggcatgtgattaattttaaatagatatagtatttaacaccaccagatgagtctccctctgaaaaagcacacaaaaacaaaacaaaacgctgacatagtttccgcaagtcacgaggcaattatgctaattagcaacaagcctccatccctaagcagaatagttcttgtgtgaaacatatcatttaatctttataaccctgatgtgacctagatgatttggtctaaaccccacaatcctattgtgtggcttagttatatctataaatatagaacctgttttacttcatttttgtgtcaggtggtttgaaggggggaaacatacaatgctctgctaagtaattagagctacttacgcaggcattggggaatctgaaacttagcttctaattgtctccacataaaaacagaagttaacttctagggacatcttcagggactcctcaaggcaaatattcatgaaatggggcctattggcttttcttttcatcttggttctgggcatgttgccatgttcctgatctctgaactctgatgctgacctgctacagactccaggagcaatattaaggataaaataataactcacataactttgtggctctttattctaaaaaaaaaaaaaaaagttggctcaattttttttcctccataagaaaatgcaaattgcaactgtattgagaaaccattttttcacttatcagattgtcaaagattagaaagtttgataatcacagtgttggtaaaagtgtagactagcagtcacaatgaaaatgtaaatgtaaattataatgacctccctagggggaaggtcaggatacctaacaatattgcaactatacgtataagagtttatcttggccctgcgtggtggcacggtgactcatgcctgcaatcccagcacttggggaggccgaggcgggcagatcacctgaggtcaggagttggagaccagcctggccaacatggtgaaaccctgtctcaactaaaaatacaaaaattagccagacatgatagcaggcgcctgtaatcccagctacttgggaggctgaggcaggagaatcccttgaacctggaaagcgaagtttgcagtgagccgagattgtgacactgcactccagcctgggcaacgcaccgcgactctgtctcaaaaaaaaaaaaagagtttatcttacaacacacaggagaaatggtatgtatctacaaccttgtttatttcagcattgtttataataagatatatttcaaatacaaatattctttagtaaaggactgataaatcatgatataggcataaaatgaaatcttatgaaagcttttaaaaagactgagaaagctctttgtacttttatgagatgatcttcaatctatgtcatgtgcattttttaacacaaaacaattacctaatagtatgctacaatttctactaaaagggaggaaatgatacaaacttgtatagatacatatatagatatgtttgtataagcataaactaagcataagccaccaggcatggtggcttgcacctttaatcccagctatttgggaagtctaagggggaggataatttgaacccaagagtttgagacctgccagggcaacttagaccctgtctctataaaaaatacaaaaattagctgcgcatggtggcatgcgcttatagtcccagctactctggaggctgaggtgggaggatggcttgagtccaagaggttgaggccatcgtgagccatgattgtgccactgcattgcaagctggtgacagagcaagaccctgtgtcaaaagaaaacaaaacaaaaacccataaaatatctggagagatataccagaagcagataacattggttgtgtcttgagatgggagttggatagttaaatggcagcattagaagagaaatttgttactaaatacaattttgtactttttttggattttgagccatataaataacagaacccattctaatattttaaaatgttttaccgcatgaagttttgccatcaggaatgaccaaagtttctctgtgaacgaatttcacttatagataaaataaatgattggtcaggcatggtgccgtggtaggtgtatcacctgaggttcggagttcgacagcagcttgaccaacttggagaaaccccgtctctgctaaaaatacaaaaattagcgggggcatggtggtgcatgcctgtaatcccagctactagggaggctgaggcgggagaatcgcttgaacctgggaggcggaggttgcggtaagcagagacctcgccattgcactccagcctgggcaacaagagcgaaactccatctcaaaaaaaaaaaaaaatgttcaatagatgcttctgaccctatttcttctctagtttatctaaaaaagacaactttggtacataaaactctaacacaagtgtggtgaaaacgatgaattagcaaattgtaaattccttgcaatttgattagcagtgacatctcccttgggtagggcttccagataactttaccaaagttgcattcaatcagaaatgaaaaaagtattccaggccttaattctcaaggggaactccatggagtcattgcctttgttcccaatccgggtccctttttttttatttatgtttccttatggcaccatctcactgagaagggagttgaacatctttaaaagacagaaacagtacattttaaaaataaatatttcaaagtgtaagtatttttagtataaaatggtattcccggaaaagcatacaggtaatagtaaacatactattgagcaacgaattaaaacactgagcttcctgagacccaggtacgccaaccgcttacataattgtcattttcaaaagaggctgaaagtttctcaaaggaagaaaaacttttcctagcactgaattttaagaaaaatttttgtcactcattttcaattcaagactacaaaatggaaaatgacaatatactattaaaataccataaggaacttcatgtggctatttttcatagtgactgtgaataaaactagaagtttttttcttctttttttttaatagagacggggtctcgctatgttgcccatcctgggctcaagcaattctccagacttggcctcccaaagtgctgggattacaggcgtgagccactgtgcctggccaaaaaaacaaaagtattgtaataaaactcaacttgaggaagttactcacccagacagggaccggtcttataacagcataatgagatcaaggattggctgtaaatagaagtgtggaaagacggcagcttcttcagatatacttctgaaagtcaaatatgctcatggtaaaacgtgaacatctccacaaatcccttaccacagaggtaaacacagttgctttatacaacattccagaaattttctagtgagcactcattagacaggtgctgaagcattgtcagaagttgcggtaatctctggcaaagtcccagaatgctggaattttgtgatactgtcgatgaccttttctttgtttttgtgaagagaatgtgtatattacacatagtcatatgatttttttttttttttgagacagagtttcgctcttgttgcccagactggagggcaatggcgtgatctcggctcaccacaacctctacctcctaggttcaagcaattctcctgcctcagcctcccaaataactgggactacaggcatgcaccaccatgcccagctattttgtatttttagtagagatagagtttctccatgttggtcaggctggtctcaaactcccaccctcaggtaatctacccgccttggcctcccaaagtgctgggattacaggcgtgagccgccgtgcccggcctatgacttttaattcttgtgtccaaagatggtgagacatgtgtggtaagatacccaaactgaccagctgtagcaatggctgcataacaagaaagagagaacgtgagagcagtaaatggccctgatttatttaccaataactcccaggttcttgattatctattttttttctcagtggacttgaagacccaactggactctcctcttttttcttttcttttcttttctttctttttttttttttttttttttgagatggtgtctagctctgtcacccaggccagagtgcagtggcacgatctcggctcactgcaacctctcccatccaggttcaagcgattcttctacctcagcctcccaagtagctgggattacaggcgcctgccaccacacccagctaatttttgtatttttagtagagacagggtttcactgtgttggccaggctggtctcgaactcctgacctcatgatgcacctgcctcagcctcctaaagtgctgagattccaagtgtgagccaccacgcctggccttcttttttattttcttatttttgagaaaggatctcactctgtcaaccaagctggagtgcagaggtgccatgatggctcaaccgcagcctcgacctcctgggctcagttgatcttcccaagtagcagggaatggagtcatgtgccaccatgcccagctactttttgtattttttttatagagatgggatttcaccatgttgctcaggctggtggccaacttcttagctcaagttatctgcccacctcggccttccaaagtgctgggattacaggcatgagccactgcacctggccctggactgtcttcttaatgccccagaaggtgactagcagaatagaaatgttcttatgccggctgggcacagtggctcacaccttgtcatcccagcactttgggaggctgaggcaggcggatcatgaagtcaggagatcaagaccatcctggctaacatggtgaaaccccatttctactaaaaatccaaaaaattagctgggcatggtggagggcacctgtagtcccagctactagggaggctgagggaggagaatggcgtgaacctgggaggcggagcttgcagtgagctgagatcgtgccactgcactccagcctgggcgacagagcgagactccatctcaaaaaaaaaaaaaaaaaaaaggtccttatggcaaagtctgaagatttttaagtatctcaagaaaggagttttttgttgcaagttcaaagcagtagaaaaaatgaagaaatatagcttcctcttatcaaaatgacctgcagaagtttgaaaaactcttccatctccccatcccatggaaggcatcttcaacagtcctgttccatttatagactctgtagaaggaacagttcttataacatgatgccaaaattattctagttcacacacaaacaagttgtcctgtaattctgctgtgggcctcctcatattaggaagaaattaagaaaaatatagtaccaccagtttgttatgcaaccacttcgaaaatgtttactttgcttaaaatgtcatggctaaagaaactactcgtctgcataatccactcttgacagtgattcataactgtgtgacatttgggcttggtcaggctttactccagtcagattgagtctttccttaaaaaggggatatattttcaatttcagagtatttactgcttcatgacaaatattaataacaagtctgtggcttcgaggcctcatacctttgagactaccacagtctacttagcatttttttttttttttacttagaccttttgaatttgcttttaatttatacccctggccttgttctcttgaccaaataaaagccctaagagagcttccactgccagcagccttccaatttgctctgttcccccttgggccctgttgattgggcccagtgatcacctaaaaagagtgcaaagagtcaggaaggcttgtgggttcagtctttctgtgctaacaccaggccacatccaggcctgatgtactaactgatctccagttcattccttttgcaatttttggccttgattcatagttcctgattcttgattggctctgaaatcctccccattttcaaaagggatgcagtcaagcaggccaaagcgctccatgttagctaacaaatgtttgcaaatcataataatgtaggaagagaaccataaactaaatgaacaacaggcattagccctcatgctgtcacataagcattcctcaaaatataatcatgcttctaaacatgggctggcaattcaggaaagggccactgaaaatattagcctcgttcttttctctgtagagtgagcacagactattcctaaaccacattgcagtatgccaacattgtaaattaatgcctgattggttacctagaagtaagacaatcttacttttaggcatctagaacactgagaaatccaggatggacacttaacactaccaaagattgatctattttgggtaagtatacttctgatctctttttgaggactgtattagtccattttcacactgctataaagaactgcctgaggctgggtaaattataaaggaaagaggtttcattgactcagagttctgcatggctggggaggcctcaggaaacttaacagttatggcagaaggcaagggagaagcaggtaccttctttacaaggcggcagaagagacagagagggcaggggaaactgccatttttaagctatcagatcttgtcagaactccgtcactatcacgagaagagcatgagggaaactgcccccatgacccaatcacctcccaccatcccccgctcaacacgtggggatgacaattcaagatggaattgtgtggggacacagagccaaaccatatcaagtacctacaaaattatggtgactcttcactaatttgcaaactgattatctgcaaatcttaaatagggaataaaacacaaaaatatcattatccctccagaactgaggacgcaaattggatttagaagacttagctttgacacctagatatgttttcattgatttgacctaacttgatctcagtttctcttttatagagttagttctttagatcagaggtccccaaccccaggactgcggactgccactggtctttggcctgtcaggcacccggccacacagctggaggtgagtggcatcaagcaagcattaccacctgagctccaactctagtcagatcaatggtggcattacattctcataggagtgtgaaccctattgtgaactgcacatacaagggatctaggtaacatgctccttatgaaaatctaactaatgcctgatgatctgagctgaaacagtttaggccaaaaccatccctcctgcaccccattttgtcttccaagacaaaagattattcaaggttgctatgaacacctttatgtggacaaactagaaaacctagaggagatggataaattcctggaaatatacaaccctcctatattaaaccagaaataaaaataaatcagaaactgagcagaacaataacaagtagtgaggctgaaacagtaataagaaaaattgccaagaaaaaataatcgaggaccagatggattcacagctgaattctatcagacattcaaagaagaactggtaccaatgctattgaaactattccaaaagatagaataaaaccagtattaccctaataccaaacccaggaaaggacataacaaaaaaagaagactacagaccaatatccctgatgaagatagatgcaaaaatcctcaacaaaaggattctcaacaaaatactagctaaccaaatacaatagcatatcaaaaagataatacaccatgatcaagttggtttcataccaggaacgcagggatggtttaacacatacaggtcaataaatgtgatatacaccacatatggttgtcttatgaaagtttttgtcaagtagatgcctcaggaagtgctcatggaaacaatattccctgaatttttgcacagtgattacatttcgtatgctgcctttatcttggaaagctactgactcacattttctttcattgaatatcttaaatatgttactccatttttcttctacctaaatcattgctgttaaaaaaaatttgatggcaaatctgatttttttttcctttataagtggattttttttgcctagaagcccaaaataattttttcccctttaaaatgtgtaattttggtgggatgatcacttgagctcaggaggtcaaggctacagtgagctgtgatcacaccactgcacttcaggctgggggtcagagagagacactgtcttgaaaaatatatttttttagctactaatttcattataataagttatggtgttactagtcctgggtcagtttttccaggtatgtagtataacctttcactacgtagcttcaaatacatatattgttaatttgaagaaaatgttcttcattatagttttttggtagtccttctgtgccttgctttggtttttcttcttgagaaactcttgttaaacatatttttgtatatcttttttgcctgtctctaagtttgtttctttctctcaagccctttttattactttccttcaattaaaaaaaattttttctctttcatcttctcttcttaaggtattctctgtgtttatttattcttccattactttcagtttagttttttttttttttttttttaagagatggggtctcacttgttgcttaggctggtcttgaactattgggttcttgaactactgggttcaaaggatcctcccgcctcagcctctcaaagtgctggggttacaggcatgagccactgcacccagcctagtctctgtttttgactagtgtttctacgtctttttccttggcctagtgtctgtttttgactattgtttctacgtctttttccttggcctagtctctgtttttgactattgtttctacatctttttcctaagtatatctatcacctcatttctgatatttcccaattctcatttttcttgttttttccatatcttggatgatttctttaatgtcttctagcacacattgaaataataagtcatggtttgcatctgctctgtaggtatgtctttttagcatctttggcattgtctgtagggatgtttttcagtttcttctctttttttcctgacagtaattttgtatgagatttaatcttggtatttttttgctcatttaaaaaaatatgaaataattttcttaaactttcaggaggaggtaggatttgggaaagcatttccaatttcacaacctgatcgctctctttttttgttgtatttgtgtggtggttaaaactatcggggcttactttttttttttttttttttttgtttgacagatctcgctctgtcgcccaggctggaatgcagtggcgtgatctcggctcactgcaagctctgcctcccaggttcacgccattctgcctcagcctcctgagtagctgggactacaggtgcccaccaccacgcccggctaattttttgcgcccactaccacgcccggctaattttttgtatttttagtggaaacggggtttcacctgtgttagccaggatggtctcgatctcctgaccttgtgatccgcccgcctcagcctcccaaagtgctgggattacaggcgtgagccaccacgcccggcaatcgcggcttattttctgagatggtcagactctgttttctttccttgctttcatctggaccccgtctttccttgatctctatcgtcccagttccgtacaatgagcattcttttccaagaagtttcttctctgtgcagtgcttgtccaggagtggaaatttgggtggttagtttggaacattcattgtgcccgtcagacactttgcattcccctgactttggagtgtgcaaaactttttccagtttcagctgctgttcccaagtggaacctccaagctttccagcaattgcctgcttgctattttgagattatcagatttatcagagtctcatgaattccctccactttctattatacagttgctgataccacctagcccttgtatctgtctatggctttcctcaattccttatgttctagggttcgtggagacacttcatcacctaattttgttatagatgttgtccacgggttttttattttatcttttgtcctttgtctatatttgtggcagaattttaaggttaaaaaatgatgacccccggatacaggtgaccattgtaagggtacaaggaaaatatcccctttgtcctctgaagatttgcttaaaaatcaactcataaaagtcagattaattggagtaaatgtatataaattttattaacgtgtacatgagagcctttagaataaagacccaaagatatagagaaaattatctttttttgtttgtttttgtttgagacagggtctttctgtcacccaggctggagtgcagtggtgcaatcacaactcactgcagcctcgacctcctggactcaaggggttttcccacctcagcctcccaagtagctgggaccacaggaatgaacaacctactaattattttatttttagtagagacagggtctagctatgttgcccaggctggtcttgagttcctgggctcaaaggattcccccacctcagcctcctgaagtgctgggattataggcatgagtcctcgaacccagcctggaaattatttttatgtttaggttcaataaagtatggacaaccatgtagaaatgtaactggacaaaaagggtaccatctaatgttaatagacaaagtagggaaacccaggaaggcctgggttaaacggtaagcttagatagtaagacctgtgtattagtctgttctcatgctgctaataaaaacatacccgagactgagaaatttgtaaggaaagaggtttaatggactcacagtttcacatggctggggaggcctcacaatcatggcagaaggcaaaagagaagcaaaggcatgtcttacatggcagcaggcaagagaggttgtgcaggggaactcccatttataaaaccaagttttattcactactgcaaaaacagtatggggaaactgcccccatgattcaattatatcaacctggccccactcttgacacgtggggattgttacaattcaaggtgagatgtgggtgaggacacagccagcccgtatcagcccatgtgtctctctgagtatgtatgtttttcttttgcatgtagggcaggaccctttctagaatggggatcgtatggcctataattaaataaggtagctcagataatttttttatgaccaggttttacacagaaaggtgcaggaaaaattagagtaatatttttaggttttttatggctggctttggggcaaagaggttctcatttgtatgacccgccttggggaagagggattctagtttctatggcaagccttgaagcagaaagggaccttagtcttagaccagtcttagtcttagacaagaagacatgagaaaattagaaaaaaaagttttacttgtaagactattttggaggcctttattttgggggtgtgttttgagtccaaacaccatcagatagatcttggtagccaccagctatatatggtgagtactccttgacagcaccaagcatgaaatgctcaaacaggttggcagaagtccctgtgaatgctcagagggtgccatagagaggaaaaaagagcagaaggcaaccagcttttatctgagatctatgtgccagatattttgctagtagcttccacatatattatttgatttgatttaatctaataatcacccccatcttctgaagtagaatcttcaggtcttcctaagtcctatgctcattcaacatggaattgtgagaaacttaatctccctgatggaataggaatcagttaaagtgcgacagagtagaggcacctgagtcagcactaatgaaccttgtgaagtcctttagtgtttgtcaaaactactgtaaagatactacctgagactaggtaatttataaaggaaagaggtttaattgactcacagttctgcatggctgctgaggcctcaggaaacttacaatcactgtggaaggggaagcaggcatgtcttacatggcggcaggcaagagagaagtaagtgcaaccaggggaaatgccatcatatctcatgagagctcactcactctcatgagaacagcttggaggaaaccacctccatgagccgatcacctcccaccaggttcttcccttaacacctggggatgacaattcaagatgagatttaggtggggacacaaaagcctaaccacatcaatattcatcatggattcaaagatttcttgattaaaattacgagatattaagattaattatgatgattataaaaataataccaaaccttgattatgtaccatgcacgattttagtcattttacactttacatgtattaattgtttaaatattcataacaattctattaggtagatattattattgcattcttcttctttttcttttttaagagacaggtattgctatgttgcccaggctgctgctggcctcaaagccctggactcatgtgatcctcccaccttggccttctgagtagctgggactacagtcatgtgccatggtgcccagcaagtagatactattatattcattttataagtgatgaagttgaaacccagtctagttataaatatgcccagtgtcacgaagctaataaataacaggattaggattgaaatccaggtcagtctgaccttgaaccaccaaatacactgccttcttataactcagctctttggagttctacatttgatttacttttgtgtttcaaccccagatgtatagttcaaaaataatacataactttaaaaataaagataatttttaatgaaaagaaccagaattaattgtataatctgttgttagaaaaatcttttggccaggtgcgatggctcacagcggtaatcccaacactttgggaggccaaggcgggcagatcacgaggtcaggaaattgagaccatcctggccaacatggtgaaaccccatctctactaaaatacaaaaaattagccgggcatggtggtgcacacctgtagtcccagctactcaggaggctgagacaggggaatcacttaaacccgggaggcagaggttgcagtaagccaagatggcaccactgcactccagcctggtgacagagcaagactccgtcaaaaaaaaaaaaaaaaaagaaaaaaaaactcttaatgaagaaatacaagtcagaaacacttgagccaatttacttaaaaaacagaaacatacagagggtacccctacgaccactatcactaaacagagaatgtagaaagatttaagtgtgttttacatgttacatggttgcatacttaaaatgtcagcagaatcaaacaaaaaatagttatacacaactagaagacagaatttaccgtatcaataatacattaaataacccagcaataaaattaacttgaaacagatgtgtttcttaaaaaaattgattgaagggacagaaagatttcctgacaaagatgccaaaagcaattgcaacaaaagcaaaaattgacaaacggtatctaattaaactaaagcacttctacacagaaaaagaaactatcatcagagtgaacagacaacctacggaatgggagaaaaattttgcaatctattcatctgacaaggtctaatatccagagtctacaaggattttaaacaatttacaagaaaaaaatgaacaatcacattaaaaagtgtgcaaaggacatgaacagacacttctcagaagacatacatgtggccaacaaacataagaaagaactgattattagagaaatgcaaattaaaaccacaatgagacaccatctcacaccagtcagaatggctattattaaaaagtcaaaaaacaacagatgctggagaggatatggagaaataggaaggcttttacactgttagttggagtgtaaattagttcaaccactgtggaagacagtgtggtgattcctcaaagacttaaaggcagaaataccatttgattcagcaatcctattattgggtatatacccagaggaatagaaattattcttttacaaagatacgtgcacgtgtaaaaataaaaagatacgtgtacacgtatgttcattgtggcactattcacgatagcaaagacatagaatcaacctggacgcccatcaacaacagactggataaagggaatgtggtatatatacaccatggagtgctatgcaaccataaaaaggaatgagaacatgtcctttgcagggacatgaatggaggtggaagcaattatcctcagcaaactaacacaggaacagaaagccagtcaccgcatgttctcacttataagggggagctgaaccacgagaacacatagacacatagacggtaacaacacacacgggcctctccaagaaggtgggatggtgggagggagaacatcaggaagaatagctaatggatgctgggcttaatacctaagggatgggttgatctgtgcaggtctgtgtagcaaactaccacggcacacatttacttatataacaaacgtgcacatcctgcaaaggtattcagaacttaaaagttgaagaaaaataagttgattaaattctaataaaaaaaggtaaacatacctaaataactatgctacattcttttttagagagattaaataagacatcaattaaaaatgtttaatatataaatttattgcagttataaattcctgtgagaaccaatagtgaaaaataaatggatgacattatcaaaacattttcattgggaataaggatgaactcagcaaacttggaaaactgaacacactgcaacaatgatcaaaatcttatggccttgggttattacagtcggaaaaaagaatccaacctatagggcaagggaaaaccacataataagttgtcttccaaatagttggctaacaggctggaaaaaacatcatgttagatacgtaaatacacggaaacaaacagtataataaattccagctgtatcaaaaagtaaaagccctttttaaaaaatggaagagtggtttatctatttcctatgagaaaaagaacatgcatttttattttcttttttgagacagtgtctcactctgttgcccacgttggattgcagtggtgtgatcatggctcactgcaacctcagtctcccggggtcaagcaatcctcccatctcatcctcccaagtagctgtgactacaggcatgcgtcaccatgccttgctaattttttaattgtttgtggagacacagtctcactatgttgcccaacctggagaacatgcatttctaatcactgcagaaaacaaaggttgttaccggaagcaggggtgattaattgagcagatttaaattttttaactttcatgcaacaaaatgtaaaataaaaatgctataaagaaaactttccagtatagaatagatatattacaaatataacgtgataatagctttctcccaaaatatatgaaaaaataaatgattatgtaagtcaataaccactttccacttgatgaatggacagtttgcagttaggaacatttagactacatcattgtgtttttaaaaatcagttttattaaaaaatgaaaataaaggttaattaaactcacatgaagactctcttacagatgcattaaactggaagacattttttattttttattttatttattttttttttgagacggagcctcactctgtcacccatgctggagtgctatgatgcgatcttggctcactgcaacctctacctcccgggttcaagcgattttcttgcctcagcctcccaagtagctgggtttacaggcacgtgccaccacacccggcctgtttttgtatttttagtagagatggggtttcaccatgttgtccaggctggtctcaaactcctgacctcaggtgatccacccgcctcagcctctgaaagtgctaggattacaggcttgagtcactgcgcccagcctggaagacattttttagcttgtaaaactgaacctggacaagtctttgggaggaaggcagacgtacattttgtatgttaatggtagaaatgtaaaatggttacatatttctggggggtaatctataacatgctctttgacctattacccgttccttcccctgagaaaggaaaactaacttataaagcaattttcattgcagccttacctataatggggaaaattagcttcagttcaaatgcccaatagtattaacatgtttaagtaaaccatggtgtattaccatatacaaattaaaatgacaagtaaatggaggatgtaatacatagatatgtttatgtgaaacaaggtgaagtaaacaacttgaacccatgataactttatacaattatatagacatatataaatgtaggccaggtgcagtggctcacacctgtaatcccagcactttgggaggccaaggcaggtgaattgcttgagtccagtagttccagaccagcctgggcaacatggtgaaaccctgtctctgcaaaaaatacaaacaaaattagccaggtgtggtggcacaagcctgtagtctcagctacgtgggaggctgaggcaggaggatcgactgaggttgaggctgcagtgagccatgatcacaccactgcactctagtctgggctactgagtaagacccagacatttatattgctttttccaggtatgttttttatatacacatatatatattacatatgttatataatgtacataatgtatattacatatgttatataatgtacataatgtatattacatatgttatataatgtacataatgtatattacatatgttatataatgtacataatgtatattacatatgttacataatgtacataatgtatattacatatgttatataatgtacataatgtatattacatatgttatataatgtacataatgtatattacatatgttatataatgtacataatgtatattacatatgttatataatgtacataatgtatattacatatgttatataatgtacataatgtatattatatgttatatacgtatattaatatgtatatacatattaatatacatattaatatatgtatattatatatgtatatgtatatagacataatgtatattatatatgtatatacatatgtatacatgtttattatatacgtatgttatataacatatataatatacgtatgttatataacatatataatatacgtatgttatataacatatataatatacgtatgttatataacatatataatatacgtatgttatataacatatacgtatgttatataacatatataatatacgtatgttatataacatataatatacgtatgttatataacatatataatatatgtatattatataacatataatatacatatgttatataacatatataatatacgtatgttatataacatatataatatacgtatgttatataacataatatacgtgttatataacatatataatatacgtatgttatatatgtatatatgtacacatatgtttatatgtatacatatatgtatatgtacacatatgtttatatgtatacatatatgtatatgtacacatatgtttatatgtatacatatatgtatatgtatagatctacacacatatacatatatatgtgtatatatatatgacagcatcagtcttaatagcttagatgatttctatttgctaattgctttaattgacctccaaattctggtccttacatctcatgtctacatctccattcatttctctagtgtgaaaaaaaaggaaaaaactgaaaatctcaagaggattccaggaaatcaaaacaatgaattattgaatcaagaatttgaaagagaaaatagatgcatactgaaaaaagaattttgtttagtgagatagatgtaataatgaaggcatgttgataacgggggagctatgtatatatgaggggagggatatattggaaatctctgtatcttcctctcaatcttgctgtgatcctaaaactgctctaaaaaatattttgagaaggaataatgatgtggtaaacatgttctgttatttaaaaagagagacttttcatagccgcctccctccccctctacacacacacagagtcctgtccgtcttcattcccttactcaataatttgtacagacacagccactgggctccagtaatcctaaagtttctagaaaatcaagcacagaaaaaggttaaaaccctgagggaataaaagaattcctttgcatccattgcatttctcaggaagtgaactaacaaattcactgcttttaaatgaggaaattttctcagtgaaattgattccaaaccttcgttaggtcaactgttcccagatttcttagctgatgcctgatctgactattccttatctttagtacagaaaccaaggtgaatgacctttaaaaaacatattagactgttgacgtgtcttctatgttgtactctaggtaaaaacgataaaccaggaaaaagaaagtaaaattcaaccttaggctcatggatccagagtggataattatgagtctgtagtatctacatgcatgtgatgaggttcaaggacaataaccataaagcaaagacttaaaaggttttatcattagaataattgtaattcacttgatctctcaatgtaacaatacttcggtctactgtctcaagccattattatgtcttacactcagcatattggtttgtctaccattaaatatttattttctacagtgctttctggaaggcaaacaaagcagccactctgctactttatattgattcctgagttgtccttcggaaacgctttcaggaagtttaataggtttgaaagatatttagacctgtgactggcaaatatacttccttctttttatttcaataagagagtactagaacttagatctttattgtttaatctagtcagtgctgtcattgtcaatcaagttctcaaatgacacttgtcctgagctgtaactgatctattcagaagaatatgaaaatagtaaagacggcaactatgcatgtttttaccggacacgattttaattgctttaaaatgaagttatgcaaccaatgaggaatggagcttttggagtggcctgaagctaaaggtttcaggtgtatttttgctttctttgaagaaagaaccaaatcattttatttaataaaaaggccatttatcaagaatttcttaaagctgttttaaacctgagtttgcaatttatagaatatgttcaagcagcctcagtgcccttttaattggatggttttcacagatttatccaatttgagatttatccagtgagaattccctttgttcaagtatatatgtcttctcttccataaagcagattcaaatgaaagagtgcaatctgatatatcagacatgtcagttatacatttgatgtggtaaatttataagagaggccaattattgttatgaaaaaatacaatgaaatacatgatagtcatttactgtttttataactaatctaaaagtatttactaaaaagaaactatttcttttcatatgtactttactttttactttaacccttcatatgtcctttaaataaagagaagaaaaaaagtcatttatatttatccacatattttctatttcaggtggtcctcattcattcttgtagatccaagttaccatctgttattattttctttgtcacctgaagaattttcagaactatttcttcctatatgtagcatgtatagatactctaaaaagtccattatatgatgtataaaacaaagcatacaatgtagtctctgccctaattatttgtaatttatataaaaccttttattttttatttttaattgtttattttattttgttttgttttatgtttttgagatagagtcttgctcttttgcccagactggagtgcaatagcgtggtcttggctcactgcaacctctgcctcccaggttcaagtgattctcctgcctcagcttctccattagctgggattacaggcagcaccaccatgcctggctaatttttgtattcttagtagaaatggagtttcaccctgttggccaggctggtcttgaactcctgacctcaggtaatctgtccgccttggcctcccaaactgttgggattacagatgtgagccactgcacccagcctaattggttattttattatttagactccacatatcaattttcttactatggcgatatgaaatagcaattaaccttgaaatatcatttatttttccctattattacatttcccttaagaactacaataagttattttactgaaaaacattgtccttaacgtaccatgagctaatcattcaagaattgtgactaaattatctaaattatttcagtgtaatcacctgaggttctaggtaagccctccttctcattctctgcttcacacatgccaatgattaaaagatcagattatcagccaggcacggtggctcatgcctgtaatcccagcactttgggaggccgaggtgggtggatcaggaggtcaggagttcgagaccagcctggccaacacagtgaaacgcccccccgccccccagtctctactgaaaatacaaaaaaaattagctgagtatggtggcaggcacctgtactcccagctactcaggaggctgaggcaggagaatcacttgaacttgcagtgagctgagactgcgccattgcactccagtctgagcaacagtgcgagactctgtctcaaaaaaaaaaaaaaaaaaagatcacattatctttaagtaaaaaaaagtagtcaactggagttccacttttggtaatggtagggtagctggcatcaaactagatctcctgcagatcaaaattatatactgtgaaaaaaatgtaaataatgtctatctgaaggcactggagggtgtctagaagcaggcagaaataagaagggaatcctttaaagaagggaactaaatatggtttttcagttgaggatactccccagaccttgtggtagaaagaagctagaactgaagctaaaaccacaattttaattgcttgaagggttaaaggacagaatttgggactgccaatatggctggattatgaggggagaaatttcagaaagatggtagccacagatatgggagcctctaaatccatgtgtaaactctctgcacacattcctgcagatctctgaactgtgtattgtgtaggagactccaaggaacccaaacaggaggctgaaaaactgagtagagatttcagctaatgccttgacaagggagaaaaaatttggggtttgagtccagctaggtaactgcctgctaaaacaaaactcaacactcagccaaaaaaataagaaaatcaagagtatgtaaaatgtctcatcaaatgcaccagacgcaatcaaaacttactagacatgcatgcaaagaaacagcatatctcttgacccagagtcaagaaaaattcaatcaatagaaatctattccaatatgtctcagatgttggaattaacagaaaagatctttttaaaactgttttaaatatatttaagatcttaaaagataatatcagtggaaaaatagaaagaaccaaagtaaattctagaatgaaaaaaatataataactaagtctttaaaatgggcttaacagcagattggaaacagtgaaagaaaagattagtgaattaaaaaaaaaagatcaacagaaatatctaatctgaaaaacagagaagaaaaagaaattgagaaaagtgagtaaaggatctatgaagaaacaacaaacatatgaacacagatatacttagagtcccagaaagagaggaggtagaaaacggggcagaaaaatatttgaaaaatcagccaggtgtggtggctcatgcctgtaatcccagcactttgggaggccgaggtgggtggatcacctgaggtcaggagttcaagaccagcctggccaagatggtgaaaccccatgtctactaaaaatagaaaaattaaccaggcatggtggcacacacctgtaatcccagctactcaggaggctgaggcaggagaatcagttgaacccaggagacagaggttgcagtgaaccaagatcatgccactgccctccagccagggtgataaagaaagactgtgtctcaaaaaaaataataataaaagaaaaatatttgaaacattgtggccaaaaatttcccaaaatttggtgaaaatataattgtacagatctaagaagttcaacaaacataagcagaaagaaaaataccgaaaattatgcctagatacatcatagtaaaataattttttaaaaaagataaacagaaaatcttgaaaatgtccataggtaaactacacatgagaaaaaggggactgattaatcaaattttgacaagtcaagagaaataatagattccaggagacaatggaattacatctctcaggtgctgaaagaaaagactgtccacccaattccacatccaatgaaaatgtccctcaaaaatgaaagagaagggccggtcgcagtggatcatgcttgtaatcccagcactttgggagtccaaggccagcggatcacgaggacaggagattgagaccacggtgaaaccccgtctctactaaaaatacaaaaaaaaattagccgggcgtggtggcgggcgcccacagtccctgctactcgggaggcggaggcaggagaatggcatgaacccaggaggtggagcttgcagtgagccgagatcatgccactgcactccagcctgggcgacagagccagactccatctcagaaaagaaagaaaaaaaaaaaacgaaagagaagtaaacacattctcaaataatgaaagtgagagaatgaatcaccaaccaacacacactacaagaaatgctatagaagattcttaaggtgacaaacgaaataatagcagatggtaacttggatctgcaagaatgaataaagaccaccagaaatggtaaatatatggatatatatatataaatgggtacattttttcttctcttatttaaaggacatatgaagggttaaagtaaaaattatcacactgtattgtaaagtttacaaaataagcagaagtaatatatatgataaaatagcacaaaaattgggcaaataaaattatgcagttgcaagacatattttacatgtaatgatgtaatattaactaagcagattgtactaaaattaaggatgtatactgcaatctctagaatcaccactaaaaaatgatgtaaagtagtagaactaaaaattcaggggccaggtatggtggcttatacctattatctcagtactttgggaggccgaggtggaaggatcactggaggtcaagagttcaacaccagcctaggcaatgaagaaagactccatctctacaaaaattaaaaattaaaaaaaaatagttgggtgcagtggcgtgtacctgtagtcttagttgcttaggaggctgagacaggaggatcacttgagcccatgacttcaaggctacagtgagctatctttcattgcaccactacactccagcctgggctgggtgacagagttagactctaaagaaaaaaaaaccaatagagaattgaaatgaaatactaaaatattgtattaacacaaaagaagccacaaaaagaggagcagagaaacaaatatcagactggacaaataagaaacaaataacaaaatgatagccctatatccaaaagtatttataattatattatatgtaagttaaaatgtagagattgtcagaatgaatttaaaaaagcaagaatcaaagatatgctgtctacaagagatgcactttaattgtaaaacacaaatagtttgaaagtaaatgaatagaaagtatataccatgtaaacagaaaccataaaaaagctggaaaggctttttttaacaattaaaaaaaatacactttaagagaaagagttttaccagaaataaagatgttgtataataatataaaagggtcattaatcaggaagatactatcatgaaagtatttgtacctagtaatagaccatcaaaatataataagcccaaattgacagaactaaagggagaaatagacaagttcacaattttgagtgagactttaacatagccgtctcagtaaacaataaggtaacaaaaaatcagtaaggatttagaatatctgaaaaacattatcaaacagcttggcctaattgacgtgtatagagcactatacctaacaacttcaggacatatttgcgtgtagaacattcatcaagatagaacataagttaggacatgaaataagtctcagtaaatttcaaaaggttgaagtcttacagaatatattctcggattataattagattataagtaaatatcgaaaagaacttccagatagttagaaattaaacagtatgcttttaaatgtgttgaagaagaaatcctaagaaaaattaggaaaaaatggaactgaatgatcacaaaagtacattccttccaaaaatctaaattcccaaatagaagtttgtgagactcatctaaagcatggtttagaagacaatttagagttttaaatggctatatcaaataagataaaactttcaaatcaatgatctttctacttaaaaagctagaaaaaagaggagaaatgaaaactatagtaagtaaaagagaggaaaataaataagactaaaaaccaacaacacagaaagcagacacaatagagaaacttaacaaagtcaaagttgattctttgcaaagataaataaaatgggtttgcaaagataaataaaatgggtatattctggtgagactgaaaaaatggaggagtgggacaggagaccataagagaaagaacacacattacctatgtgaggaataagaggtaataggagaatattataatcgactttatgtcaataaatgtgacaacttaggtgaaatgaaaaattactcagaaggccacttatcacacttgatacaagataaaatagaaaatttgaataactacatctattacataagctctttcagaaaacgggaaaaataaatacgtgtcaactcattttacaaggccatcaaaatactgttatctgactttggcagcataactctaacaaagacatgaacaaaggaaattagagaccaatgttcctaatacaagcacaataatcattaacaaaatattaaccaacttattcaataatatattaaaaagatattatatcatgaccaagtggggtttcttccaggaatgcaaagttggtcaacatttgaaaattagtgtaattcaccatattaacagaataaagaaaaaaaaacacatgataatttcaatagatgcacttgtgataaaaactctcaacaaactaggaataaaaagaaacttccaggtcaggggtggtggctcatgcctgtaatcccagcactctgggaggctgaggcgggcagatcacctgaggtcgggagttcgagaccagcctgaccaacatggagaaaccctgtctctactaaaaataaaaaattagccaggcatggtggcacatgcctgtaatcccagctacaagggaggctgaggcaggggaattgcttgaacccaggaggcggaggttgcagtgagcagagatcacaccattgcactccagcctgggcaacaagagcgaaactctgtctcaaaaaaaaaaaaaaagaaaaaaaaagaaacttcctcaacctgatatacagcatcagtcaatatcacacttgacagttaaagaggcaactcctcttacgtgattggaaaccaggcaaagatgcctcttctcctttaagttctattctattctataaacttctgaaccagtttgataagtcaaaaaatggaaataaaaaccagaacaattggatagaagaaggaactgattcctatttgcagataatataattctttatatagaaaatcttaaggaatctacaaaaagttactggaactaatgtgaatttagcaacacttcaagattcaagttcaatataaaatcaattgcatttctaaatactaacagtaaacacatttttaaatcaaattaaggttattactttaacaatagctttaagacataaaatacttagaaacaaattcagcaaaagatctgtaaaacctcaatgttcaaagctacaaatactaatcagtgcaattaaataacacatatagagataccccacgtccaaatgttgctagactcaatattattaagatgtcaattttccccacaatgattttaactataatcctagcaggcattttagtacaggtgacaatctgagtctaagacttattggaaatgtaaagggcctggaatagccaaaacaatcttgaaataaaggaacaaagctggaggatttatattatttaacttcaaaacttaacataaattatgataagatgtgtaatactggcaacaggatagacacatagatcaatgaaacaaagtacgaggcataaacagaccaacacctatctggttatttcattctgaagaaaggtggcaagacaattcagtgaggaaaggaaagtgtttaataaattatgtgggaaaacgagatatctatgtggaaacaaaacaaccataacttctacctcattcatccagggacctaaatataaaagctaaaactatagatggtctttaaaaaaaaaacctaagtctacagtgaaaacctcaggtaagtgaagatttcttaaaacagaaaacaaccacagaattgttttaaaagataaattaaactttatcaaaagttaagccttctcattaaaagacactttaaaaatgaacagaaagccacagactgggagaaaatgtaatgtacatatctgacaaaagacttgtattgagaatatataaataactgcagcaattcattagtaatgacaccaatgcaagaaataaagtaaataaaatctgtaatagacacacaacaaaggaaatattatgcatgtccaataagcacatgatcaagttctttcttagtcattggaaaaatgcaaattaaatcttcagtgaaatactagcttacacccaactaaaatggctaaaattaaaagtactgaagacaccaaatattgaccaagatgtgaagcaagtggaactattatacattgctaatgggaatcaaaaacaaaaaagattcgtaatttcttataaagttaagcatatacctgctctatgacccagaaattctacttctaaatgtttaccaaagagggattaaaacacaggtccaaaaagtcatgaatgaggacattcatggtcaccgaaaactgaaaacaaccgaattgctcattaataggtgaacggataaacagattgtgatattgtacactcaaacaatgacaaactatccacaggaaagaactcttgatatatccaaaatatggatgaatctctcagatgtgctgagtaaaggaagctggatacaaagagtatgttccatgattccacttacataaatttctcaaagaggttagaaaatatgtgttgaaaatctatggtggaaaaataatctggaatggaaaaaaaagaagagtttgcctctgccaggggtgttaattaggaagaggcattagggaacgtttagggtgaaaaaaaaagccctaaattttgatagagtgttatacagaatacacatgtgtcaaaagtcatcaaattgcacacttaagatttgtgaatttcatgatatttaaatgttacctcgaagacaaagaaccgaaaacaagtatcagctctagtagatttgcttttctcagtggattagcaattccaacaggagtttttgtgtattctaggttggaacaaatgtatgaatttattgaggataatgaaagccaggtttttaattgttcacggagaaagttagaaacattgaaaagggaaaccaagctgtagattggaatcagaggtacaaatatgaaataatgctttttagtatctagatatagatttgtagatagaggtagcaatagttatggaaatacatagatgtgtatatacatgtatttagatgtgtctatgtaagtgtatgtgattcctaaatctatccactcattggacctagaagggccttcagcaaagaacacagctgctacccagatcattgtctgtaaatatctttactctaataaatggaaccttgaagaaatgctgatcccaaaactagagcaggaaaagtggaagatgaatcaggaacatcttattgtatctgtaaggataggctcaaaatatgatagccacatatcaaaaggacacgggttggcttgaagtggttcccactaatccaaactggcaaaattgcacattaatataaataatagtaatactgggttaaaatctattgagtaaagttagaatgtatgagtccatactgatatgaataaaaagaaagaaaggagggagggaagtgggttagaccgtttttgcattgctgtaaaggaatacctgaaactggataatttataaagaaaagaggtttaattggctcatggttctgcagacagtacaagaagtgtggtgctgggcggggcacggtggctcatgcctgtaatcccagcactttgggaggctgaggcgggcagatcacctgaggtcaggagttcaagaccagcctgaccaacatagtgaaatcgtgtctctaacaaaaatacgaaaattagccaggtttggtggcacatgcctgtagtctcagctacttgggaggctgaggcaagataattgcttcaacccaggaggaggaggttgcagtgacccaagatcatgccactgcactccagcctgtgcaacagagtgagactccatctcaaaaaaaaaaataaaaaaagaagtgtgatgctcgaatctgcttatgatgagggccccaggaagcttccagtcataacagaaggcaaagggggaacaggtgtctcacatggcgagaggggaagcaagagagagatgggggaggtgccacatactctcattttaattttttaaaatttatttttaaatgtttaaatgtttgatgtttgtgggtacatagtaggtgtatatatttatagggtacatgagatgttttgatacaggcatgcaatacgtaataatcacatcatggagaatgaggtatccatcccctcaagcatttatcctttgttacacaaaatctaaatactcccttttagttatttagttatatgtacaattaagttattattgactgtagtcaccctgttgtgctatcaaatagtaggtcttactcattttttctattttttttgtacccattaaccatccccaccttccctccaccgctgccctcctcccagccctaccctttccagcctctggtaaccatccttctactctctacgtccatgagttcaattgttttgagttttagatcccacacataagtaagaacacgtgatgtttgtctttctgtgcctggcttatttcacttaacataaggatctccagttccacacacttttaaacaaccaaatctcgagtgaactcagagcaagaactcattcatcaccaaggagatggcgctgagccattcatgagggatccactcctgtaatccagttgcctctcaccaggtttcacctccaacgctggagattacatttcaacacgagcgtcggaagggactaacatccaaactatatcaggagggatggcgggaggaagggaggagggagggagggaaggacagaaggaacggaaggaggaaggttgtttactacactaccagcctcaaaaggaaaaatgttaacatagattgcatagggttttgcaatcatatacactcattttaatacctataatctttattcagcattttaaattaactgtatctatttcctatttatgccagctgaagaacatgtggctttgaattatttcaaatgcaaatttttttccccattttatcattttgttggctgtattggttttctatggctgttgtaacaaaataccacagatttagtgtcttaaaacaacgcaaatttattctgtcaccatgctggaggtcagaggctaacatgagtcttaaagggctggaatcaagctattagcaggactggttccatcgagaggttccaggagagaattctttctttccctttcccattccctctctccaatatgtctttggctttgccttctgctctaacagagtccaatttgtccctctgtttctttctttgaagaaaacctgtgattatatttaggacccatggggctaattcagtataatcttctcatccccaagtctttaacttcgtcacacctgtgacattcctttgccgtataagggcacactcatgggttctgggcattagaacatggacattttaagaggccattattaagcccaccacattgattattctaactatttagtctctgtccaccagaccactgaaatgaaatatttgtcattataataatttatatttttattattttactcttaaggtgaatttacaatactttatttcagatgaattagaatatttaaaaatatgaagactaaacttatacttaataagtaattagacatactttttttttttgagacagggtcttgctctgtctcccaggctagagtgcagtggttcaatcactactcactgcagcctctaccttttgggcttgaacaattctcctacctcagcctcctgagaaactgggacgacaggtgcatgccaccatgaccagctaatttttttttatttttcctgcagatgcagtctcgctatattgcacaggttggtcttgaactcctgggctcaagcgatcctcccgcatcagcctcccaaagtgctgggattacaggcatgagccactgaatatactatttatatatcatttataaataaatatataatatattaataataaatctgaacttcataagactattcaatctgaagttttttccgttagtttagttctctttatacttaagattctagccaaagagtaactatgaaaagtaataaacaagaatcagagttggaagatagtgtatcctattctagttgcttagtcattcattgaacaaatacttacttggtcccaagtgctattatagatactgtccagcaaagaagagtgtacttccatttgctcttctctgttatggcagattgtttttgccaagatggttataacaacacctcccgttctacctgctcatcttatcatgcaagttgtcactcttcactttgagagatggggactatattccctttcttcgaatccagacaggcctgtgatatagcagtttagccatgcgacttctaaggttaggtcctacaagttaacacagattctgcctggctctcttaggacgatcagtcttggaacccaactcccacactgtgaggagactgaggccacatggagaggtgactgtgttccatcacgtgggtgtcccaggcaaaagttcagtagcatcaactcaccagccagatatgtgactatggaagctttagagaataactccattatttcagttgaaccccaaaatcatgagaaatagtaatacaataatatagtttttcctaagctgctacgttttggagtgatttgttatatggtgacagataccctgaatatctcttacctactcattttatgaacatacacgaaacttacatttcataatataatatataaaattgagaatgagctcacttcctacctattttattaaactaaatgataccatgtatatgtcattctttcaatgtcaatgaaaaaataacaaattaaattcaaagtgctttctatgtgccttttagattgttattgaggagataaatggatataaaaaatcattcaagccggtcacggtggctcacgcctgtaatcccagcactttgggaggccgaggcgggcagatcatgaggtcaggagttcgagaccagcctgaccaacatggtgaaaccctgtctctactaaaaatacaaaaaattagctgggcgtggtggcgggcacctgtagtcccagctactcgggaggctgaggcagaatggcgtgaacccgggaggcagagcttgcagtgagccgagatcgtgctactgcactccagcctgggcaacagagtgagactctgtcgcaaataaataaataaataaataaataaataaataaataaataaatcattcaagcaagaatttcaagaaaaaatggaagcttcatgacttgctggggcaaaatcactattgcctttgtttttttcctttctgtctcatttttaagccatctgactttcaaaattaccctgcaaactctggtgctcttctaactttcctctcttcatgtgtgtcaccatcatccatgcagttactgaagccagaggttttagaagttgtccttgacctctctgtctttcacatccatatccaatctatcactaagtcctgaccagttcttcccaaagaacttcggaagttttctgctttccatctcccctgacatgatctcaattcaacagaaacctatcaattgttctccccaaatttctagtccccaccaatcctttgcatcagaatgcaaatctggtcatgtcactgccctgctttcctttttttgagacagagtctcactctatcacccaggctagagtgcagtggcatgatctcggctcaccgcaatctctctctcccaggttcaagcgattcttgggcctcccaagtagctgggactacaggcgtgtgccaccatgcccagctactttttgcatttctagtagagatggggtttgccatgttgggtaggctggtctcgaactcctgacctcaagtgatccgcctgcctttgcctcccaaaatgctgggattacagtcaagagccactgcgcccggccctgcttcatttcgatggcttctcaacgctctcagagaaggagatcaaatcctaaatgtggtccacgaggctttggatcgttggactcctttctccctctccaggttcttcgtggcagcttcttgccttgtattctagccataatggccttttgtcatttccctgtgtcttcctaccttggagtctccttgactaagatccctatgcctgaaatcttcttacgtcattttctttgttaatatggttctcatttaactgtccaagcctcccttaaaagattatttcatcaaaggattcttccctaaccccagcctaagtcaaattctctgcatttttacatctactgtactgtgtcactaaaaaatataacaggaacaaaaaaccaattcataagatttcatatttttttccaccaccacaatcactaaagaaaactctcgccaggaggtagcttcatttgcattgaggatagaacagatggaagaagaggaaaagataggagtaagaggtcaaagagctaagaacttctcgggccaacggtcaggaagaacttaggaaaattcatttttatcagtgagtaactggaaagagaaacactgagaatgtaagacacaggaaaagatgttaaagcttttctgttttgcaataagatggactctcttgggtattttctgaagagttgcaataaagtttttttctgctggactgaccaagagaggggctgctttatatagtttatgcatattgaatattaatttaacaacgctgtcctcctctcacctccacttacatacaaactttatgtggtcaatgtcttgttttgcttgtcattgcaaccttggtgtttacacaattagtagtgggggctgaatcaatattgattgaattaatgtgtgatttagggcaatttgcttaacctctccagacttcaatatttaccccctcctcccacctccagaagcctgggatagcctgaaacagctaattacagttctgatatttctctggagtttctttgaagtttcatgttttgtctaaaaaacttgttttatgattcattttacaactttaatgttaatattccataccattatatgtcagtatttatttaaaattaaaataattttatctcatgtcttctaacaaaaggaatggcattgtacctattacctccagtgctatacagacttcaaaccagtttgacaaactcaaggattcattaaataatcacaaaggctctctttgagccaaaagttttatgactcttggcttctaacaagtcgaacagctaatatttactgaattccttttatgttcaagtcacaggggagaatacaaggaacaatgagatgaactgccttggagatgcagttatgatgacaagtcatgcatatgtacaaaggtaatattgtgaggcagtacagactgccaagtgagtagagcagcttgttaatgcagaagaatccaggatgactgagccctctaggcctcaatttcctcacctgaaacatgggtaaccatgcttatgcttttatatcacaggatggctatagaggtcaataagatgaaatgtacctacatacaaattagaaagcatcttattctcggagggtttcgatcacatggcaaaaccttgagatggagtaggaaacaagttgatagacgagcatagcagaacggccttcatgaagacacagaaaaagaaatataccacaaagatacaggaaactaaaaatgacaatctttatggggtggaaagctcaatcaagtgagatagctctgaaaaagcaggatattgtgggccttgaattctaagttaggaaatttagaatcactactgtagatgtcattttcaaaagataaatcccttggtacataatttggttcatattttgagacagctgggaacatttggcacagacaaaagggctattttaaatgctttgactcctttaaagaatattaaagggacacgtgaagaaatcagataattgcttgcagggatcaagtgtcaggatggtaatattgctaaaagaggaaagaagagaacatggttgtttttttgagttaaaaatgaactggcattatgccagatgtgggcaaacagaatagaagtaaatttgaaaggagtttcaatataactcttgatgcttggaggcaaaaagcaaatggccttcagcgtaatttggaataaattctagcattattggatgaacaacacatggcttaaattttaatccaaaagctcaaccagctctctaagatgaaagtgtggcattggtagaagaatgagtttttggaaaataatatagaggaaatagtacctggtgttggtgataactctatatattcaattgtttaaatgagatttttgaaagtcaactaaaaagaaaatacattgttagtatacagtattagcatttgtttaatggaagaacgtaagtgcaaaacaaatctttattttaagaagtttccagaaagcacatctcttttgcaaaatgtggaaaagcccaccagtgttgaaaccatatacctttgagtgctcttaaagatggctgcatttgaacactgcatattgtgctataatttgtgtagaaaagaaagaatacatctacttgttactatgttaataaaataaccctggaaatatacaaaactaacctatcatcttggtttgccactaggacataggagtgaaagggagaaatttcttaggttttttttttttcgtttttgagacagagtcttgctctgtcacccaggctgaagggcagtggtgcgatgctggctcactgcaacctcttcctcccgggttcaagcgattctcatgtctcaacctcccgagtagctgggattataggcgcctgccaccacgcccagctaatttctatatttttgtagagacagggtttcaccgtgttggccaggctgatcttgaactcctgaccacaagtgatctgcccgcctcggcctctcaaagtgctgggattacaggagtgagccgccccgcctggccgagaaatttctttgtatatcattttggatttttaaagtttgaatcgtatattttgtagtccaataaacagataaacaaatcaaatgacctcaaataaaatgattatctttgatatggtttctagagtttgaagttcactttattaataaataagtcaacttaccctacgtactcagatgggtaagatgataatcctttttctccagcacattctttccaagcttctttagtgtgcatcagaatcacctggggactgttcaaaacagattgcttggcctcatcccccagattctctgactcagactggctggggcaagtcccaggaattctcatttcaacaagttcccaggtgctgctgctgctggttgtctggggaccaaaatttgagaaccacgtttttgtgttgttgttgttgtttgtttttttgagagagtcttcttgctctgttgaccaggctggagtgcagtggcatgacctcggctcactgcaacctctgcctcccaggttcaagcaatcctcctgcctcagcgcccctcgtaggtgggattacaggcatgtgccactatgcgcagctaatttttgtatttttggtagagaaggggatttgccgtgttggccaggctggtcttgaactcaagacctcaggtgatccactcacctcagcctcccaaagtgctgggattacatgcatgagccaccgtgcccggccaagaaccactgttctagcagtaacatcagcaatgagtcactggtgctgtaaaacgcttcacattccatagcagaaataaaaatgtatatgaattagaagtctgctgggtgcggtggctcatgcctgtaatcccagcactttgggaggccgaggtgggcggatcacctgagatcaggagtttgagaccagcctggccaacatggtgaaaccccgtctttactaaaaatacaaaaattagccaggcgtggtggtgggcgcctgtaatcccagcttctcgggaagctgaggcacaagaatcgcttgaaccagggaggcggaggttgcagtgagccaagatcacgccactgcactccagcctggacaacaagagtgaaactccacctaaaaaaataaaaaaagtcaccaggctctagagaacgtaagcaaaacttcaaaactttataaatctaaaatgtaacccgttttgaaggtagcatctctagataaattgctttaaaaagtcttctctgtgatcggtaaatcaatgccatgcccagcactctactgttatgattactctaatgacatagaagatacccctctgccatcaaggagctttgaatctagtttaaaccaatgagtccccttttgagacatgatccatttaaatgtttgttttaatactgaattacatagaaggtgtaactcaagaagtttcgtgaaaagttttagtatctcttgtatttatttctcattaacttttacccaaattcagacctgtcaatgctggtgaagagtaaataatttgcaatttgcacatggtgaattgaaagcccatgaaaatacagatgtgggccgggcgcagtggctcacacctgcaatcccagcactttgggagaccaaggcgggtggatcgcttgaacccaggagtttgagaccagcccgggcaacatggcaaaaccctatctctactaaaaatacaaaaattagccaggtgggtgcgcctgtagttccagctacttgggaggctgaggtggagggatcacttgagcccaggaggtcaaggctgcagtcagctgtgattgtgccactacactccagcctgggtgacttgtctcaaaaataacaaaacaaaacaaaaaatagatgtgggttgaaggacaagttctactgctaatgttatgtaagcttaacttttcttatactgtttcttcatctaaaactgagtataattttaactataccaaatgtgatactctatgacaataataataaaatctaacatttattgaacatttactaataatttacatgcattaattcattcactcttcccaacaaccctataagataggtactattattatcattttccagataagaaaacagaagctcagagaggtttaagaaacatgtccaaggttagttggccagtaagtaatagagccaggattcgaatactggtcccttccgtaatcaccatgcttgctgcttttcttaaaagttggagatgaaggtagaccttttttcacctcaaacaccttagctatctttagtgggtcatataaaggggcctttgtacttttaaaaacatattgccctggtaagtttctataaatgtggagaaaacacatgtacttacctgattgtatgatatggttttttgtgtgcgcacaaggtagtgctctgtgagaccattgcatataagtctgttaagttcaggtaatatcttggctgggcgcggtggctcaagcctgtaatcccagcactttgggaggctgaagtgggtggatcatctgaggtcaggagtttgagaccagcctggccaacatagtgaaaccccttctctactaaaaatacaaaaagtagctgggcatggtggtgggcacctgtaatcccagctacttgggaggctgaggcagaagaatcggttgagactgtgtctcaaaaaaataaataaataaataaataaaaccaaaaatcaataccaaaatgcctatcaatcccaacactttgggagtccaaggcaggagaatcacttgaaccctggagttcacaatcagcctgggcaatatagtgagaacccatctctacaaaaaacaaaaaagttagctgggtgtgagtgtgatggcacatacctgtagtcccagttactaggaaggctgaggtgggaggattgcttgagcccaaaaattcaacgctgcaatgaaccgtgatcgcatcactgcagtccagtctgggcaacagagtgaaactccgattcaacgaaacaaaacaccaagaggaactctggaaaatatgtaaatatatggaaattaaccaacatgctcctgaatgaccactgggtcaacaaagaaattaaggtgggaataaaaaaaatttctagaaacaaataatggaaagaacatatcaaaacctataggattcagcaaaaatagtgctaagaggaaagtttatatcaataaatgcctatgtcaaaaaagtggaaatgttacaaattagcaatccagcaatgcacctagaagagctgaaaaagcaagaacaaaccaaacccaaaattagtagaagaaaatagataaataaagatcagagcagaactaaatgaaatagagaaaaaaatcaacaaaaaggactggtgaaaggaaaaattggttctttgaaacgataaacaaaatcgataaaagtagactttattttttagggcagttttaagtttacaacaaaattaagcagaaagtacagagagttacgatatgtctcccaccttcacgcgtacataatctctcccataatcaacattccaccctcaagtggtacatttgttaacaatcaatgaatctatgttgacacatcattatcacccaaagcccatatttaggattcactctcgatatggtatattgtataagttttgacaaatgcatagtgacatatatcctccattgtagtatacagaataatttcactgccctaaaaatccttgggctctgcctattcaccccctctccccacataacccagtaatattttttctttttcttttttttttttttttagagaaagtctcactctgtcattcagggtggcgtgcagtggcacaatctcagctcactgcaacctccgcatccagagcaagagattctcatgcctcagcctcctgagcagctggaattactggtgcccgccatgacacctggctaatttttgtattttttagtacagacagatggggtttcaccatgttggtcaagttggtctcgaactcctgacctcaggtgatctgcccaccttggcctctcaaagtggtgggattacaggcatgagccattgctcttggccataaccaagtaatttttaatatgtttttcttatacaaataatatatagggaggaagaaatattttcatctaaataatatagtatggttaagaatgtttgcttagtatagacatgaaactaattatcaagaatgtcagacaagtctatcaagcagtataacttcagaatgataggataagccttcatgtgtcttgtacttaattcgtcctcttctatgcttaggtaaagatttcttaaactgctgtttaaaaacactaaccacaaaaacaaaactaataaatacgcaagaactacccatcaaaagagaatgagaaggcaagccacagccacggagaatatatttgcagagcttatatccgtatataaaggaaacctacaaacccttagaaaaagacaaacaactgaattttaagatgggccaaaagactcgaatagatccttcccaaaagaagttacccaatgggcgtaatggaatgagtatatgaaaaagtgctcagtctcttagttatcagggaaatgcctattattgagatgccatgatgtacccatcaagatgatgagttaaaaacaaaacaaaacaaaacaaaaagcctgaaaatacacactgttggaaacaatgtggagcgactagaagtctcatacgttgctggtgggggtataagttggaaagataactttgaaaaatagttttgcaggattaaactaaagctaaacatctgtatacctcacacaaggtacatatagaagagaagcaaatgctttcgtccaccaaaaggaatatgcaagaatgttccaagaatgttcatcgcaactatattcatcataaaccaaacctgaaaacagcccaaaagctcaacaatagtagaattggtaaatgagttcgggtatattcatacaatggattctactacaagcaacaggaagaaacaaacaattgttgcatgttagaaaatgtgtgaatctcactgaaaaatgtttagcaaaagaggccaggcacaaaagtacctactcgtgtgtgtgcgtgcgtgtgtgtgtgggtgtgtgtgtgtgtgtgtgtgtaaagttcaaatacaggcaaaatgatggtgatgaaatttagaatagtataacagtaattgcttcaaagttcaaggacagggaacagtaacggggaagagatgtgacagagcctttgggatgctggaatgttctatatcttgatttaagtagttctgcaccaatgaatacacatgaaaattcatcgggttaagattcacgcactttacacctgaataaaaaagaaaacaaagtcattctgtttaatataataaaatacgtatttccacgctaaatattacgtttacagctttgaaagattaaaagactgaaaaagtactgagtattaatctaggcagaagggtctgactgcctttgctaaatatggaattggcttggtaaaattacactttacccatgcagtggtgtgcaatgattccatcagtgggacacttggaggaaaatattattgaataactttcacccagtgaatatgctttttgttaagagacgcttgcttctaattgctttaaatttgtgagtcagaaattggaggaagagggggtggaaccattccccacccttctccccttggcacccctactgaccacagatctttcgctttgattcttattagaggttttctgtccaattttatggttttccgcgttctaaaacacacattgtataaataaatgacacatgcttagggcttgcagatgcctttagatgtttctcaaacttccctgtgggccagttctccaccttcctggtgtttgggcttgaattcacagtcaatagttggaattttactttggactttcatttgtctattgtcccagtggctctaggtaggatttgattaggattagcccataggatttcagtaaacgaattttagaaattgttggaaatgtcacatccaccaaaataaattttgtatgatgtccctaatgcatgttaataatccgttggtatatcatatgctgcattctgtaaaacttaactggaacatatcaaatataattggtaaaggtagaattcagtcagctcctaccttcaagttcaaggatacatcctgctggctaggcagaaaagagaggctgaaatttctgcatagcagcttgacttaaggtttctgcaaagacagcacactagaaatgataacgaatgtttgcaagctctttcttcacttaccactgactacaccagattaggaggagtaaaatatctaggatctggagaagatggagccttatgttatcttgatgtacagtatcagatgcagattagggctaagggcttacgtggtgaaacgtcattctgagattgtaaatattctcccactgctcacccagccatgtgcaggacgtaatagtttctaattgctctgagtctgtgggctcctgagtcctcattcatccatccgagctggggttttggtacagagacaatgatgataagaagtactttcttctctttgtccctgcagacggttgcaaaatgaatcttttcaggattttatcatcggggtgtcaggtcagatccatgaggcaggaatgtcaagttggctaaaggacattctaaagtgaatttattaaaatgattctaagagagaattaaaattgtgctaagaaatttttttttactgggtttacacaaaaccttcatgttggtagtcatttacctgtctttgaaaagtagaatttcgagaattgaaattgctagtgtgtgattccttagtcaattttctttacaattgccttgatttctttcctccatgactcatttctttctcttcagcttagagatactttgtaaagtgtgattaggtgttaagtgtgcggattctagagccaaggtaaccgaattcaaatcccagcctactagctgcatgatcttaggcattattacttaacctctatctgactgtttcttcatccgtcacaaggtgggggtgattattataaaacctagtcacggggtcactggtaggatgaatgagtaagtagagataaagctcctagcacagtgtctggcacgcagtaaacactgcattaaggatcaactttatctctgttcttgttgagggactcccctgtatctttcactgcatggcttggctcttcctgatgctctttctttcccagtcttaactccatggtttgctctacatcagcgtgccaactttgtttatttcttggtatagtttattcaaaagttttgaatcctaaaatctgggtggtggagaaggaggagattattattgaccttcattacatgcctccaaagaccttggtgtagtacgttaagactgtcacttgccaagtgactcattcattacccaatactgtcacgcactagtcataagacaattggaagggacagatgaaaagaacagccatctactttaattgctatgttttggaaataatgtataatattaaaaccacaactccaaatcataaagcctaaggtttggaagagaccgaaaatcactcagcctaaccacccaagtgatgcttgtgtgtatttgcaatattctgtatggaaggttcagcctcagttaagtatggtgatactcttatcaactcaagaagcagtttatcttttagatggctcggattctttggaggatctttctaactttagtcaaaattaatatactcacagtttccatctattatgtattttcttttattaatttactcttgaagtcttatggaataaatgttatgcatctttccattaaaagccctccagatatttgctgactgctagcatgtttcttctggagtcctctctggatattccagtcgagctaaatattactcatcttctccaatgtggatggtctgttctgaatgagctatgatttcttaatatccttttaatgctggtcccaaattgaacccaatactccatatatagttgggtaagctcaaagtagttactacctgtgtctactattctagcttctagatggttatacttctattagtgaactccaagatcatattagcttatttttggtagctacgtcatatttgtgaaaaatattgtattaattttgtccaaatgactttttccgtgccctaagacagacctaaccagcagcttattctttggagtttccacagcattttgtatggattgctattgtaaaacaaaaccaaaaaatttatctacagttatacactgcatcagaacatcttggtcaatggtggaccgcatagacaatggtggtcccataagattataatactatatttttactgtactctttctatgtttggatatatttagattcacaaatacttatcattgtgttacaatttcctgcagtattccgtacagtaaatgttatacaggtttgtagccatctagatttgtgtaagtatactctacgatgttcacacaacagcaaaatcacctaaagatgcatttcctagaatgtatccctgttgttaagtgatacatgactgtatattataatattgtgtttctattctaactattttattgtgttcttgcatttgactatgaactctgcataggtaaatttttcattattttgttgtagtggctaataacccatctgttactcaaaatatgtttgtcaaataaatgttgaactaatcccttgatagagcattttaaggtaactagttaacaaagaccactgcaccataatgtcatatgaaaattttgatatcagaggcccacagagattgatagccccatctccttttctagagtcctacttatacctaaaccatccagctaaaggtttgtagaactgaggtctaatggacttcaggaaaggggattattaaacccagtagcttagtcaagtgcatgccctatgtacgcctctaactatacaaccattggaagtattatgcaagagtgtggctagatcactttgcagtcagcactcaccatggcaaagcaatcagctttagaagacagaggccatgtgcgagcctgttccaaggaaacctgatcctggaaacttgcagtgaattcggctgccttggcagtgacatctcatctggcagcctggaacaggaaaacttatttagagaacaaacatgccttttaggagctcgcagtgagtccgatcttaaactgaaaactaggggcctaggagattatggttctgtttatgttgtttgtgttttacatatgctgcgtatcctcccttaagtggtctttggttaatacatattcctggctaacagttgctgtattgaacacagaggaacagacacacctctagaccttcattcttctggattttgcaaacccgatagtcaatttccagctcagctttgatagtaatatttccaaatgataaggaacaggaaatgtcgcaacaagttctcctgacaatgaggtcctgtgtgcctaggttttgtagaacatactgaaaaagtaggtggccatgtctttgatatgctttccaaggtgcatccaactacagtctccttcctttctgcccagtaattcccatcagtgaacttaggcccaaaatcaataaagctgttttttataaactattattaaagggcatttccactacctgagaaggaagggaagacgttctagctcacccttattagcaccgtaggaggcactcgtgaatcaatacctgaaaatgtacaagtcccagacaatcagtgctcagagcgagagcgggcagtggctgaacttggccccaggcccacctatgaagcctcccgaagacactgaacagcctgatgcagagaatgccaagtactggaggggcggatgcaaaggttccagaccaagctcaagggtgttccagtgcgctggccagcatcttagggaggaaggggtaaaggaaggaaaagaagcctagattcacctacaatttgatctgtgaggagtgttgtttatgagcggcatcctttgcaaatatagctttggagggaaaacaaatgcatgctataaatttccagtaacatcctgcctgaggtagactcagtcactctgtaagaccccactgtgcagacagggaaaagagacataactgcagctgattctgcaaacagtggccacagtgtcctaccaagatgacagaacagaggtcacagccaccctctaaagggcctcgggtctggcacccaccccctcgccaccgccttcttgccaaactcataaacacccaagctggaaaaagctgacaatgtatcttcctctcccacccctgttggaactttcttggatgaaccacttcataaactttccccctcatgcagaggaagacttcttatattttttttctcttactttaggaaatttgaacaaaatatttttttcaggtaaaatatacaaatatttatttttaaatatttgcatgtcaaaatacactcaggcccagaaagtactcttaatgggagactcatcagatcttggtattgaaggctctgtgttttggcaggttttatttatggttatagaaaaaaaaaaggagtaactgaaaatgaaaatggttgaatagactgccccacaatttaccaatttctttcttttattttctttttgctctgggcctgagaccagcatggaaaagttttagcttctaaatagactctttcaggaagatttgtatgctgatgaagatggtgtaaagaaaagtagtgtaccaccctaacttgagcttttttttttgagacagagtctcactctgttgctcaggctggagtgcagttgtgctttcttggctcactgcaacctccacctcttgggttcaagcgattcttttgcctcagactcctgagtaactgggattacaggcacccaccaccatgcccggctaatttttgtagttttagttgagatggggtttcatcatgttggccaggctggtctcgaactcctgacctcaagtgatccgcccacctgggcctctcaaagtgctgggattacaggcatgagccgctgcgcccaggcacttgtgctttgattaacattattttcctgtgaaacaaattaaagtgatcaatgagctccagggattcatttttaattaaatcatgaagcagctggcattcatggcctcttggcaggtagtccagcctgggcttgctgactggaggaatgagagtggggaacttaccagctgtctaagcgtcttggttccaggtaaatgatacttatcaggctgttgaagaatttagggagcacacctgatagataaatctgcacacagctttattgaattactcttttcttgctctgtttcagaaaactgtatgagaatataaatccaaacttttcacataaacttttatcgcttttaggtttgttcagaaagattgtccttgaactgaaatgaacacatcaaaactgctcagcttctctgaatgggaagtattgagaaatgatctttaaactttgcggtgaatcagatttatttatggaactttttaaaaatgaagcagcccaggcttaaaacttggtatgaaaaccagccttgagagtaaaatacccagttcctccaaactcctagttcctctgcgttacttatcctaccgcgtggtgactcacatacaaacaatatacagatgttctttgaacctggatttcaaaagatccgtattcagaaagaattctcaatcacattcaccatattcctaatagactccaaaagttctcagagttttctttttcccaatcctgctgatctctgagtcaacatggagcgcccttgttaaaattttattttaatttggcattgctttattttgcgtaatcattgtctaagtaaaagtctatctgcttctgacttttcagaaagagataattttatagaaagtgttatttatttcctatctgttcaacatgagtaaatgtatgaggacattaagattctttcgaacacaattattagcatattacacaagttgaaagggattggtgattttccaccccaaagcgacttcctgtagtttcaaatgtaactttcctgtaactagggaagcatgagctatttttaagctttctttttttttttaaatagtgattaaaaagctagtattctctataaaggattttctttgaagagcatgtgattcctaagaatctcaattagttggtcaccagaaaggacagggaaggctttatagctagcagacttttctaaggtttcattttacaattcaggagctctgtgttctaataccactcaactgtcaagagatgctgtaggtggaataaagcagggaaataaaagagatgaaacagctggcatatgttagccagctttaagagctccaaaattacccggtattctagaaaattatgacgtgcgtgatcattctctctgggagagaagctgctgcagaaagcaaacagtgacgtagtatgcaacaaaggggcatctgtgtggcaccctgaagaaaaatatcaaattacccccacatctagacagtctgggtaaggttatcatcttctaataaacgtaaaattctagttcttctaagatatgctcctggccccattccaattactgtatgaccttggagaaatgtcttttgaagtgtttctgtgtctgtaaaacctggataataatactgtctgtcccagatggttggaattgtatgaattaattagttcaagctggaaaggtctttgataatgttaagtgctgaatattgttattattatagatacaggtggaggcagtgctgcacagcacatctataattagaaaggcctagaaactgaaagtcgtgccaacaccgcgggagttaaggagacaataccttgtgtcattttctcccgagactcagtcagcttgctatgatggaatacttaattcgctcttatcctcttcgaaaggttgaagcttgtcttggacttgccaaccaagcaacatagtttttaccgggtgtatgtgctttttcaggcagtgttttgaatgaagtgctgacatttattagaacacaggatacagtcttgggtttacaacgcttgttaattgttctgagtcaagagaccaagaaattccattaccagaaacacctgtcatctgaaaaaaatgcagattttttttttttttttttttttttttttttttttttttggagacagggtctcactctcttgcccaggctgacatgtggtggaacaatcatagctcgctgcagcctcaaactcctgggctcaagtgatcctccttcttcggcctctcaagtactctcaggactacagatgcacaccaccatatccagctaattttttttttattgtttttgtagaaatggggttcttgctttgttggccaggctggcatcaaactccttgcctcaagctgtcctccttccctggcctcacaaaagcactgggcttacaggtgtgagccaccacacctggccagaaatgttcttgagctataaaatgaagaagagatctaaccttcttttagagattaaaaggctttcttttttcataaacaaactgcaaagtgttatgtggaatcaaaatacataaaacaggctgggcgcggtggctcacacctgtaattgcagcactttgggtggatcacctgaggtcaggagttcgagaccaggctgaccaatacggtgaaaccctgtctctcctaaaattacaaaaattacacaggcgtggtggcgtgcgcctgtagccccatctacttgggagactgagacaggagaattgcttgaacccgggagctggaggttgcagtgagctgagatcacggcactgcactccagcttggggaacagagcaagactctatctcaaataaacaacaacaacaaaacaagaacaacgtaacataggttaaaaactgagctgtgctgaataaaaggaaaaagggaaagattttccttgagtttgtaataaccctgaggaatgttgtcagaatctaaggctcccctgagcccactggaccataccatgtctaaaccaatttttaatacctcattttttgagtattctaaataccagcaacattaaaaacctgcactgctgggctcttctggaagatatagtttatgcagactgacaatttatttcatatgctatctcctctggaaaaccttctctgaccatctcgtctcgtcttacaagttcaactattggtgaaagtcacacagcactccaatttaccatttcaaattcctttgttatcttcttctctatcatcatcatagcaaatatttatgaaatacttatgtgccaagcatggtattatctcatttaatcctctcaacactaccatgggatagttataatattattcatattttagagatgagaatattcaacacagagatgtaaaagaattgaccacctaggaaatggtgaagacaaaaggtaaaccccaaagagcttgactcaaatcttcttgggcaatagcaaaacccaagatcatcttgtttatcactcagtatagagtaactgcctatgtgtttacttgtctttctccaaaaccagacctgtcggtttcttgagaggaggaactctgttatgctcacggctacatcactgtgacctcacacagcacctaacacacagtagttcttctttttttccccatagggtttgggggaacaggtggtgtttggttacatgagtaagctctttagttgtgatttgtgagattttggtgcacccatcacccaagcaatatacactatatccgatgtgtagtcttttatccctcattcccccttctaccctttttctcaagtccccaaagtccattgtatcattcttaacgcctttgcatcctcataccttagctcccagttatgagtgagaacatactatgtttggttttccattcctgagttatttcacttagactaatggtctccatttccatccaggttgctgcaaatgccgttatttcattccttttttttttttttttttttttttgagacggagtcttgctctgtcacccacgctggagtgcagtggcatgatctcggctcactgcaagctccgcttcccgggttcacaccattctcctgcctcagcctcccgagtagctgggactacaggggcccgccaccacgcccgggtaatttttttatttttagtagagacagggtttcactgttagccaggatggcctcgatctcctgacctcatgatccgcctgcctcggcctcccaaagtgctgggattacaggcgtgagccaccacgcccggcctatttcattcctttttatggctgaatagtattccatggtatatgtatatatatatatatatatatatatatatatatataccacaatttctttatccactcattgatagcaatcacactcctgggattgatagtagctgtgtggattaatactgggtatctgcccagaggaaaagaagtcatcatatgaaaacaatacttgcacacagagtagttcttaataattgttaaattatcaaactggcagcatgtttccttcaaaggataaaacaatttgcctatggttattcaaaagagtaaaatattaaataaattagagttatggttgaatacagtttaaaatgatgaaaaaatttgaaaagtaatttctaaaagaaaacactaatctttgaacatttgggatgaggctactttggtggccaagcctaaattcttattccgcccaagaaagtcaaattgacacaacatttgggaaaggtattcagcaattccacttctgcaagtttatcttataaataattcagaaaacaaaataaataaaattattgtgtagaaatatatttattacaacattgttataacaaataattggaaatagcctaaatatttaaaaaataattaaaagatttttgaatggtcaacaatcagaagaagaaccttatgataattttttttttttttttttgagacagagtctcgctttgtcgcccaggctggagtgcagtggcgcgatctcagctcactgtaagctccgcctcccgggttcacaccctttatgataatattttatagaaacttcaaaattatgtatgaaaatatattttaataacttgtagatatagttaaatcacagtactgcattaagtaaaagaaggaaaatacaatcctacattacataggattaaatgtatttaatgtacgtattaaatgcatttccctaactattgttagcaaagcaaaagaaaaaaaccgaagaataatctccaaagggtaacatgggttagctctggttgatgagtagtttttgctttcccccccttaaacatttctgcattttaaatttttctacaagaacatgtcgtgatcagatgaaaaataaactgtggttttttttaagtgttattaaagagcagccatctggtatcacaagatcagttaggttagatttaggaaactcatatgaaattaaaaaaaacctttagaggagcaaacttggttgtttaattcctagaggcaaattgcatgccactgtgtgtcacatagtgtatcacgtacacacagtcagttccccaagtatcaggagttaagaagatgcatttattgaaataagaattgatatgatgtccatgttactcttattttattctacaattgtttctgctaatattggaagtttttggctgggcgtggtggctcacacctgttatcccagcactttgggagtccaaggtgggcagatcacttgaggtcaagagttcaagaccagcctggccaacatggtgaaaccccatctctactaaaaatacaaaaaattagccaggcggggtggcatgtgcctgtagtcccagctactcaggaggctgagacaggagaattgcctgaacccaggaggcggaggttgcaatgagctgagatcataccactgcactgcagcctggacaacagagcaagactctgtctcaaaaaacaaacaaaaaatttttgaatttgggtggtgaggtaaatatctgggctcgtgaacatattaaatgcataattgttgcttataatttcatttatctctcttcagtcagattaaatatgacctactatgttgccagacacagtgctagatgctttttcactgtatctcataattcaactcacataacaactttttccagccagttttaatgtccacacttgacagatgaggaaactaactttcagagaagtgatcattccaaattcaagttgtttgttgggctatgaatgctgatcttcagcacctgagaaactttcgatagtatcagaagtagaccatttatcctattagaaaactaaaaagcaacaaacatatttatttaaaaaatttacaaatgataaaaaattaataataaaaacaattctcatttttaaagttggaatagtctctagggcttagtaactggaaaaacaataactgaatctccatccaaaattatgttctcatagccagatgtgatgccacacacctgtagtcccagctactcaggaggctgaggtgggaggatcactgaaccccaggactttgaggctgcggtgagctatgattgtaccactggcgctccaacctgggcaacaaaacaagaccctgtctctaaataaataaataaataagtaaataaaattattgtttcctatctgttttttatttctatcatatcagttccttctatagagtttgatgattggcacatactgtaatgtgtgagcaaatcgcatagtcttatggcacaaggcgtgcccaacatagaattcttctagactgtattcaaacctacataaaaagaaatgaatacaaacaagccatgcatgcacaaccagaaacatataatttcactaatccatagccactaggacttgtcaaaaccaagctggtctatgtgtgaatgtgtgtgtgtgtctgcaaattttaaggaacatgtgtatgatgaggttagaagccaccattcaaaaatctcttttgaaagacatacgcagctgggcgtggtgactcacgcttgtagtcccagcactttggcaggctggggtgggtggatcacgaggtcaggagatcgagaccatggtgaaaccctgtctctactaaaaatattttttaaaaaaattagccgggcttggtggtgggcgcctgtagtcccagctactgggagaggctgaggcggaagaatggcataaacccgggaggcggagcttgcagtgagctgagagcacgccactgcactccagcctgggtgacagagcgagactccgtcttaaaaaaaaaaaaaaaaaagaaagaaagacatacatgcagccaacaaatatatgaacaaatcctcaacatcactaatcatcagagaaatgcaaatcaaaaccacaatgagatatcatctgacattagtcaggatgactattgttaaaaagatttaaaaaaacagatgttcattatatcgaaaagataattacatacgtatggttatcacagcacaatgcatagttgcaaagatatggaaccaagctaagtgcccatcaattgatgagtagataaagaaaatgtggcatatatacactgtggaatactactcacactacctggccataaaaaagaaagaagtaatatcttttatggcaacttggatggagctggaggctagtattccaagtgaagtaactcgggaatggaaaaccaaataccatatactcttggttataagtaggagctaagctataggtaggcaaagggacatagggtggtataatggcccttggagactcagaagtggggagagtgaaaggggattgagggatattggacacaacgtacactactcaggtgatggccgcactaaaactcagaattcagcactatgcaattcatccgtgcaaccaaaaaccacttgtaccccaaaagctattgcattgtgtatatatatatacgtatatatatgtacatatatatacgtatatatatacgtatatatatatatatacgtatatatatatacgtatatatatacatatatatacgtgtatatatatacgtatatatatgtatatatatacgtatatatatatacgtatatatatatagtgtgtgtgtgtgtgtgtgtatgtatatatctaaaacacaacggatgttgatgaggctgtggagaaaagggagcacttatacaattttggtaggaatataaattagttaatccactgtggataacagtaagaagtttggatatttatttcttttccctttttttttttttgagacagagtcttactctgttgcccaggctggagtgcagtggcatgatctcggttcactgcaatctccgcctcctgggttcaagcaattatcttgcctcagcctcctgagtaactgagattaccacacttggctaatttttgtattttagtggaaatggggtttcatcatgttggccaggctagtcttgaattcctgatctcaggtgattcactcgcctcagccttccaaagtgctgagattacaggtgtgagtcactcactgtgcctagcctacagtttggagatttcttaaagaacttgaaatataactaccattcaacccagtaatcccactgctgggtatatatccaaaggaaaataaatcattctacaaaaaagacacaggcactcatatattcatcacagcaccattcacaatagcaaagatatggaaccaacctggatgcccatcaacgatagactatgtaaagaaaattggtacatgtacactatggaatactacacagccataaaaaggaatgaaattatgtcatttgcagcaatgtggatgcagctggaggccattgtcctaagcaaattaaagcaggaacagaaaaccaaataccacgtatcctcatttataagtgggagctgcacacattgaatatacatggacataaagatggcaaagttagacagtggtggctactagaggagggagggttggaaaactacatattaggtactcttctcactacctgggtaatgggaccattcatacaccaaccctcagtgacatgcaatttacccatgtaacaaacctgcatgtgtacccccagaagctaaaataaaagttgaaaaaaatctctttggaaccccttacaagagaatgaatgaaagacgaaagaatatctagcctttttctaataagccgggtaaatctattttgacatgattttacaatagctgtccctctttgtagcgacatctggggcttacaatagcctcagtattgttctataaatggcattttaaaaaggaaacatctcccctgtagggtgtaagttcttcaaaggcaaaccatgtttatgtatgctgtatttgcaacacttagcactgtgtttgataaatggtttacttttttaactgttggagcggatttttttttttttttttttttttttgagatggagtttcactcctctcgcctaggctggagtgcaatggcggctcggctcaccgcaacctccgcctcccagatgcaagagattctcctgccttagcctcccaagaagctgggattacaggcacccgccaccacgcctagctaatttttgtatttttagtggagacggggttttgccatgttggccaggctggtttagaactcctgacctcaggtgatccagctgtgtcagcctcccaaaatgctgggattacaggcgtgagccactgcacccagcctggatatattttttaaaaagaaaagtatatctagttttttaaaaacattaattcactcaatagtcacatctaaacagacatatactatctatgcagattgtaggcacgctgtatacaggttagatgaaaattctttggcattactgttcaaataaaaatataagacaagctggtaatgagagcaatatatgtaattttaaaatttctgtctttcttttttttcttttcttttttttttgaggctgtcttgctctgtcattcaggctggtgtgcaatggcatggtctcagcccactgcaacctccacctcccaggttcaagcgattctcatgcctcagggtctcagagttataggtgtgccccaccacaccctgctaatttttgtgtttttagtacagacgggtttttgctatgttgaccaggctggtctcaaactcctgacctcaagtggtccggctacctcggcctcccaaagtgttgagtttacaggcatgagccaccgcgtctggccaatatatataattgtaaagtgtctaataatggcatttaaaaagtacaaatacagagatctaattagttttagtaatatattttatttagcctcatccatccaaagtattatttaacaatgtaatcaacataaaaattattcttatttgtggaggtattttctctttttctgggatactatgtcttcaaaatccattgtgtattttatacttatagctcatctgaataaggactagccttatttcaagtaagcaggagtcacatgtgattggtggctgctgtattcacagcgcagcttgatagcaatttagcttcaggacttttgtttttgtttttgaaatgaactaaattgccaaacctacatgtaatataccagatacactcatgtccttaatgttatttgatttgtttctttaggacgaacaacctattttattcactttgtttatataaaaagtattattcttaaatatgtactatgcacatatgataaaacatttcacaacattaaatggtaggaaatataaaaaggagtgtcctttcattgcgtctccaagcccagtcccctgaggtaaccactatcacataaaatgcagattttttccacatatatatgagatatgtatatcttttttaagtatcaatgaggatataacttacttttcatagtcctgataaaataccaacaaaaactttgctatgtgcataagattatataggatatcttcatgtatcaattctttttttctttttttttttttttttgaggtagagtcttacgctgtcacccaagctggagtgcaatggcacaatctcggctcactgcaacctccacctcccgggttcaagtgattctcctgcctcagccccccgagcagctgggattacaagcgtgtgccaccacaccgggctaatttttgtatttttagtagagacggggtttcaccatgttgaccaggctggtctcgaactcctgacctcaggtgatccgaccgccttggcctcccaaagtactgggattacaggcgtgagccactgcgcctggcccttgtaaattctttactagcaatgaggaaagaaaaagcaaaagtaagtatctgggatcttaaatttgatactatttttagacactgattttgtaggatccaatattttgatattcatagaaataaccagtggccataagttctgtaatatcaaatgaagtagcactcttctatgaactatacactttacattcattatatggtttctttttttacttatttcctcaatcagtcagtcaacgaacattcgagatcctgtcatgtgtcagacactgtgcggagagctggagataaaactgtcaacaagatgaatgcagcctctaaaataaagagtttctaatccagtggattctctgttcatgcttcttgcactttctctacactttgctctatcaaaaaaaaaaaaattcaaaacactcacgagtttgttgaccttaaagtggaatcagctgatacaaattaaaagcattttgcatttcaaaaagtgataaagtctaataaatagctcactaatggtgaaatttcagagacatttattttaggctggggtcttcctaattcagaaaaaatcagtccagtttccctattttacatccaaactcctcaaatgaccaatctctattctctctcttttttattttttggatgagtctctcactctgtcgcccaggctggagtgtagtggcacagtctcggctccctgcaacctccacctccccagttcaagcgattcttctgcctcagcctcccgagtagctgggactacaggtatgcatcatgatgcccagctaatttttgtatttttagtagagattgggtttcaccatgttgaccaggctggtctcaaactcctgacctcaagtgatccacccacctaggcttcccaaagtgttgggattacaagcgtgagccactgctccaggccccaatctattctctctaactgcttttatttcctggcctagagctccctaccattccactgaaacggatttaataacacaaatagcattatcactaagtccgaagatatttcattagaacttctcttccattattttatggcattttaaatttttaaaatcactccttctgcattgaaaaactatcatactgaggtttgacgccataatttgtttagctcccctcccacttctctgtggaatcattttttttctcctttaaaagcttttcttcttttgatctcctaattgtgtgagttcttcaggctactacttgagcaattaagcccatatttaaaattgtcactgatgatccattatttatagcttaccaacgtgtgttttatggaacactgttcccacaagaccacattgaaaaacaatcaagaaccctggcaaacatttctcctttgcctgcacattctacagagatcataaaaataaatattctttctcctgatcatacttccagacagagtgaacatatgatacaattctgaccaacaaggcataactgaagtctgttgacccttcgcttttcttactgctttcaacacgaactcaaagcaggaaccgtggtagataatttgcaattttgaaggatgggctaaatgaattgcagggtcatcagcctccacgctgcactgaacataggtcagcaaccacttacctcctgagttctcactacgtaagatgaagaaatctttatttgtttggacttccgtagtcaggcaatttatacctcgcaccagaacatactcttaattagatataaaaatgctacatactatatgtccttcttggagcttcagaacgcacattagaaaaattagagaactgagaaattcccaagagaagaaacctgtggaattctgctgaatttgtcatctcctaaatttatttgatcaggcagcccttttcttctttctgtactgaactaccaatgtctcacagaactatggctctctagctttttgcttttcaaagtgtaatttctagaccagcagtatctgcattgtctggaaacttcttagaaaacccaaatattaggccccatcctggaagcagagttacattttaacaggatcttcagttggtttgtatgacactaaagactgagaagtgccgcttgggaaacactgatttagagaataaagtacaactaaccttaatatccttatgtggcctatgatttcaagggcctctatatcattactgtcccttaatgcctacttcacaagtcaacacacctagttcttattgaatgcttactttgtgcgaggcactatgccaagtgctatagttttataattctcaaagcacccctatgaggcaggtactattgtaatcgttaccttgtagatgagatagctagggctcagagaagttaagttgcctacccaacgtcacatagccattaagtggcagaatccttggcttaaggatttaaggatcactcaactatattggctttctaagcttttgttcccaagcactttcctgctctgtgtacttaacacacatgattccctctgcctgcaatatctccccacgtacaccttcttaaaaggtctcagctcaaaaagtcagttgttctgggaagcttttctgatctcctaccccaaagccaggtcagatcctcctggtaaacattccccaggcacatatctttacttcatacatatcagcttttataattatgtatattttgtgattctatgattagtgtatgtgtttaccaaaaaactaagctccgtgtgggctttaactgtatcctctgtgcctgacacacagttgacacacaaatattttttagagtatctttttttttttttttcttgagatggcttctcgctttgttggccaggtcggagtgcaggttggcacgatctcagctcactacaacctctgcttcctgggtttaagcaattctcctgcctcagcctcccgagtagctgggattacaggctcacaccaccacgcccagctaatttttgtatttttagtagagatgggttttcatcatgttggccaggctggtctcagactcctggcctcaagtggtccacctgcctcagcctcccagagtgctgggattacaggcgtgagccaccgtgcccagccttttggagtatcttttactctcatttgaaacgttctctccctattctgcaccaatccaagttctacccagaagaagctataggatggtggcaagatatttgatttagcatcagaagacttggatttgaggccttgttcccctactttgtaacttggagcagtcacaaaaactcagacccactgattctcagctctgttaaatggacataataataacctcacaggattggcataagaattaaaatgagccctgtgagagaagtgtataacctacataaacttcctaaaaatacgagtagcgttttgtagtgattaagatcctgggttgtgcttaaaagtttccactctgtaatccaaaacctgagttcaaatcccaactcataatatttattgtctctgcggttgattcggcaatccattatttgctggattttgtcatgtgttttgccaattgcattcataatttattatgcatttatgcttgtatctcctaagtcatggtatataatccatgctttttatgttttgtctgacataagctcttatcagagccctttgcacacagggattcaataaatattaacacagtctacatttatttggtgaatattgcatatctgctgtactgaaagcacattaagtaacaaaggcaagtgagaagaatgaaaagcactactcacaacagttatcatgattgcgcatggatatgttcagaatgagtatttttcaaatcactttaaacaaagctgaattgcagaaacgaaagcccaacagcagcaattaaattacatttggaataaaatcatttggcctaattttcataaccacagatttcagagaataccaccacccatgccaggtgtaccagacaatcccattgtctgttttagccgtgtaggggccgctgtagtatacaccattcaggtttgcagagtgacacctagtggaagggagaaaaaaaaagaaaacaacaatcagactggaaaaatattgttcagaatcccttttattttgctacaaatgctcaaaatttttgaactatgaattctgccatttttcagacaagtaaatatttactagtttccaaaagctgagaaatttctacaacagatggctattgtattttattttttattttttaatttttttttaataatagagacagtgtctcactgtgttgccctggctggtctccaactcctgagctcaagcaatcctcctgcctcagccttccaaactgctgggataacaggtgtgagccactgcgcctggcctcagagatgggtattttaaaatggtgagttttactgccattacaaatctgaaaatacaacccaggccactcacagtgcattgaaaaataagcatttcaatttttgattttctttaaacaaaaaattaaaacaagcaaacaaaaacgcatccttgtaacctccagccttacaacctcctgactcagaacagtgttaatttcatacttaacaagagctaaggtgagtgtcagcaaagcaagtcgtgggcaaggtgctctactactggctttcctggataatttgcactcacacgttcattcctctgctgctaagacttagctttcataattcaaactccgtatgtccccttctttaaattgctagcctatcagttatttcaatctcaagggtaagcaaacaaacctaaatcaccatttaaagttttgccacccatcaaccaataatcattttttcctagttgctgagttaattttttacatatattgcaccaatctagataagctggttaggttatcgacaatataaaaatgtttctttcctcctttggagtctgtaaattttgtccttgatatgtataatttacatgtaacagtatgcaataagtttatgtgtgttgttatgaaattaattgccatatacttctttattgataaaattaatgaaaagatgtcagaattaggatagaaggagaacattcacaagaggtagttctgaacatctatggaaaaacccaaattattgaatcaaaaaagcatataatctacccgtaaaggctgagtggctggcttgaatcacttatcagcttaatgattcactcctactgagcgttctcgaagtcctcctaacttaaatggacgtaattaattgaaaatatgtatgtcaagtctgcaaatgtcaaagcctactgtgtttttaaaacagcatggaaagtaatgttaaaaaaagaaaatactgtaaattgagtctccagaatatatattttggcatatatttgtctatctagagacatctgctaactatatttttatatttggtctatcatttgaatcccattaggaaactgactctgtgatgaacataagaaaccttcactattctgagaccagttttctagcatcgtttagtttttagaacagcctggatttgaaactaggttaggggatgattgggtcttccttggtgaagaagtggctgtgaacactcacgtgaaatgctacactaacaaagaaaagacatcaactcgcagtgattggtttgctatgtggaaaaaaacattttataggtgggtaatatttatgaagtgccaacatttcatgtaaattagaagaactatgggacagaaaaaaagcaacagtaagaaggaagaaaagatgatagtcgaactcactgatagtaggcatggtagaagtagcaccaagtttctaaaacaatctactttctctcccttaatgcctactgattttccaattgcacagccttatcaacccctttgattccaaggataatgtgggctctgtggcaggctccacctaatgaatggcctttctttgtgctccctgaacccatttctttaaagtcaggtaaatcgttcctttgcccacattaatatacatggtagttttcattcagatgccttagaagccagtcagctggataaagtacatggttttgatctcaggatactattagtaattatttctgtatatggaattgttttcaaaatcaaacattggtgatgcttgcagatgacttcatgaattacacgttaagttttatgtcatgctgacttagaagaacaagggggaaagaaaggagtaggaacaggtgaagaagacggtttttaaaataacaggaaaaccactaaggaaaacaccatcatcaccttcaatttgcaaagcaggagagtgaaatttgtttctctccttcacactgctggaaatactccagttcctttataaatgatcaaatcttaaatggactcaaatgtttttttaaaaaagcaaaatatagaaaagatgactatttttacaacagcagtagtactcccttatctgcaggggatacgttctaagacccctagtggatgcctgaaactacagataataccaaattctatatattgatactatgctttttcagtctgataaccgaaacagctacgaagtgagtaacgagcagataaagaaaataaaatttaccaaactgaaagacatgatatagattcaaaagaaccactgagtacccactgcagtaaaccaaaagaagaccacgacagtgtatgtcactgtaaaatttcagaacgctagggggaaaaatcttttgggtgtaggaaggaaaaaaaccatctatagtagttctctgttttttcctataatatacatacctatgacaaagttaatttataaattagacacagtaagagattaacaacaactaataataaaagattatgattatataacaatatgtcagcattacagctcttgtgctttgggaccattattaaatcaaataagcatgattcgaacacgagcactatgaaactccaacactggatctgataactcagacttctactaagtgtcttggggcagggagggctttcagcgtggatacgctagacagaggggtgacccacctcctgggcagaaagaatccaatggtgcgaatctctgctcagaatgacatgcaatttaaaacttatgaattcggcagggtgcggtggctcacgcccaacactttgggaggccggggtaggtggatcacatgaggccaggagttcgagacctgcctgggcaacatggcaaaaccccatctctaccaaaaatgcaaaaattagcccatgtaccccagaaatatataaaatattttgtatcagtaaaaaaagaagcaactatatacaatcaaaaacggaatgaatttgctgataaagtaacatgaatgtattcagtcagagggtagaattaggtttctggattattgtaaaggaaatttctgtattgggagaggcttagactcaatgaattaatgaaagccatagtgattgaaaagtagtactatacagaagcattacagcaataacggtggctcttttgtgtgatatggtcaggtgaagaactagttggttattaggatgccaaatagtctccatatatatacatgctctctctttctttgtgtgaatttgtggccttctatttataactcatccataattcagtttgcaaatgatctttgtaaaagtaataatttatttctatgacatttacactttactaatgtacacaatgaacaaatcctcaaaacgacttcattgctgaagaattctaatgagaatgattacttaataatactaatattataaataaagactaacattaccatacatattatattgataattaatgtctatcagtgagatatcatcaactccattacaactatgctcataagacatcaaacctgttaaaccaccagccagactgatcttcttctgcgcagttcccttcatagttgtcatgatctctgtcccacgtgctgaatttcattctttggtgactagcccaccactgcacctcaggatgaaaattccccgcaagggaatctccagctgttccagaatattccccaatattcaactcgtagaaattctaaagaaaaagggcatttctgctgtcagtggagttcctctatgaccattttaaaattaagtttatttcataaacaaaagaacaggttctattgtatatttttatttccactgactccagggttatattgcacattttaagcatttattcacggttttacttcttagaaaattgtagtaccttttcatctccaactttgaaattcttatattgtgcataacggctatttttttcaaaatctgcaaggtcgatttttaaagtgtagtcttctaaaaaagaaacaagcaattataatttttaaaaatgtgtgacatgacacggactactgcggtttaaaaataattcacagctctattttaattttaccatttcccttggccaagaatcagttttcaaagattaaacagtgactcctttgtatatataacatgaacattttatcgtgtaatttatttgaaaaaaaatgatggatacaatattaaatttaaaaaatgtctactagatctcttagaggtaaaacctagtgcaattcactgaataatgaacaacagaaaaaataagtgattacttaaagcaatctaacaatgaaagggtcgacgttttacctttaatagtttgacctctttttcttgatttcagtaagaatgttgatcttgaatataaatggtggctattaatgacattgtgtaatctctagtagctgagccactaggtttgtaaaatgtagttgccattgcctgcatatgcctgaacttggttattttcctgatagcataaaagatcagccaggaaaccctttaagaataatttgaggaagaaatatgaatcctaattgttatccgaaaaccttcgtttgatactggctcataagatcaagagactcttagcatcaaagtatgtagagtggatgtcattggaagagaatttcagaggcaataaggaaacattctggagaaatgctgtaccaccaacattctcaatggcagagatgatgataattactggaaaatatactaacatcaatgactctgagtaaaaaggtatttctgaagaactgatatctacatgtgaaagcattttaagaatgcaatggggccggggcggtggctcacgcctgtaatcccagcactttgggaggccgaggcgggcggatcacgaggtcaggagatagagaccatcctggctaacactgtgaaaccccgtctctactaaaaaatacaaaaaattagccgggcatggtggcgggcacctgtagtcccagctacttgggaggctgaggcaggagaatggcgtgaacccagaaggcagagcttgcagtgagccgagattgctccactgcactccagcctgggcgacagagcgagactccgtcgcaaaaaacaacaaaaaaacaaaaaaaagaatacaatgtattgggtacatattatcttttatatatgctaaagaatgatatatgatgacaaaaaatctctaaacattaaagatatactttaatgactgtaaaaattctaggcgatataagagcattatgtttttaaaatgattaaaataattgctaccttcaagtaatcttttttttcccattgtttggaaataacaaagactattcctttttcagaaacagaactcttgtcaggggcaccaaatgttataaatcaaattattagatcacatgtgttctatcctcctactttgataaataagatataacaatgacctgtaaggtcgggttagaatttagagcctcactttccttggagtttcaagccagaccatggaggcactgggaaagagagtccctgaatagtcctatcacctaggccccatctctggttggcctcttctctctttccatccccatctccatcacttatagcaaggggctttggatccacttgtggacatcccaggctgcatatccaagttctattcacacccaagttgggtggattacaaggtcaggagatcgagaccatcctggccaacatggtgaaaccctgtctctattaaaaatacaaaaattagctgggcatggtggcacgtgcctgtaatcccagctactcaggaggctgaggcaggagaattgcttgaatccgggaggcagaggttgcagtgagccgagatcgcgccactgcactccagcctggctacagagtgagactctgtctcaaaaaaaaaaagccattttttagcctcccctcaagcttaagggtgcacacaccaggacgagaacatcctgaaggagtcctataaacaaactcaaggctgttggggcagggaatgctggattcctcaagactggagtccctttaagaggtgatgcgggcctctcttgggcttgttgatttagcaccacaatttccttgccccagggagctctctcaaggtagtaaaggtcacaggagaaaagactgtagagtgtataagagcagcaaggcaggctaagtcaactgtctttaaaaatattctattacagacgagatgcggtggttcatacctgtaattcaagcactttgggaggctaaggcacgcagatgacttgaagccaggagtttgagaccatcctggtcagcatggtgagaccaccgtctctactaaaaatacaaaaattagctgggtgtggtggtgtgcgcctataatcccagctactcaggaggctgaggcatgagaattgcttgagccaagagtcagcggttttagtgagccaaggctgtgccactgcactccagcttgggcaacaggcaaaaatctgtctcaaaaaaaaaaacaaaaaaaaaaaacttctattataacagagacataaagactcaattttttggctaacattgaaatgtctctttgttcaataagtaaacaaattatatttaccatttctaaatcaattttattgccactacttctagttgagatttatgtagtggggataaagctattctcagaggtaattcattaattcattagccgtaatgctctcataattaaagaatgcagagacaaaaacactggctattgtctggattgatgggatacgtgggtgggggcccaggaactgaaaaacacgttttttctccaacgagattagccagcctgagtaccaagttgatatatgaaaaggaacaggtttgttggcaaagttcctctgggaaaatatgtacatcataataacttaaaaaataatacgtttgaatttcatatatttagaaagagccaagggttactgctctggggttttcatagtttcaataagaaaccagataaatatcaatgtgcaaatgaaacagaagttggtatggcaaattttatatatctggcataaaacacttaaaactagaataatagatatgttgaaggaaaggaagcgttatgtaaatttagagagcactgatcataagaaggacatacaaagaaagtataaggtttctaggattactcatcctgtctaatgtttatcattctagtgtctcaaagaactttataaccataagcctactactataaatatagaaacaccaatagctttccagaacttggatggaacaaaggaacttttgttttatcttaattactttattattattattatttgagacagagtcttgctctgtcacccaggctggagtggattggcgcaatcttggctcactgcaacctccgcctcttgggttcaagcaattctcctgcctcagcctcccaagtggctgggattacagtgctgtgccaccatgcctggctaatttttgtatttttagtagagatggggtttcaccatgttggccaggctggtctcgaaatcctggccccaaggggtccacccacctcagcatcccaaagtgctgggattacaggcatgagccaccatgcccagctgtttatttttaatgcaattgcagtgtaacttagcatgcttttttgggcattacagttgccttttatgaaggattcaggatcagacttgagtgggactgatgataatctcagactacaacagaggtagggaagacaatggattggagcaaaagaacatgggagatagaagctgggaaaagtcgttatcaaaacaatgatattttagacaaatattaaactctaaagataagaatttaaaagtatatagggagacatccagatgtctgctatttactttgaaatatatatacagaaaagatggattgatggacggattgagtaatgggcaaacggatagatacgtaacaaaaacaagcaaagtaaaatgttaatgtaggatacaggtggtaggttgaaacttctttcaaattggttgcagctttgaaaaaatttcagcattaaagatgagatgtatgtggaaacatggacatttcatatattatagtgttttattggaaaaatagcaccaattgcccaattgttcacctctctctcataatatgtcttcatagctcctcctattgtttacttccttttaaaaaaaagtctgagctgctcctgtgatttgctttcaccaatagaagaaaaatgactccatgccaattctgggcctagatctcaagagacttatatacatccactcttttttgtggaaccctgcctgtgctacaaaaacaagtccaggctagctagctggaagatgagagaccctatggagccaggttgaatccttccatcccagagcagcaacttcagtgaggaagttgatggcagactcataagcaagcccagccatgatcagcagagcccagccctgatcagcaaaatcacccagccaacctgcagatttgtgagaagtaataaatggttgttgattttaagccactaagctttggaagaggattgttacacgttattattgtgacattaggtaactgatacagcatatataatctccaggaactcaaggcatcaaaaaggaataattatgacattatatatccttttcagaagtagaatatatatatattctatatatatctatagatacatatagcgacttatattctatatatctatatatagctacatatatactatgtatagaatgtatatatatctataaatatatttagatatttctcataaatatatatgtgaaaacaattccccgcaacccaattctagcttttttttctgtttctaattttaggcagccacattttacatttgggattattgcccaaaagttatcactgccatctgcaaatcatagcaattattgaattagttccattgcctataatttggttaaaaaaaaattttagtgttgtttttattatatttcaaataaatctgacatcattcaaaccttaccttgagtggtcaagaagtgaagatttttattgcccagccaatattcaccatgtttttggacaaaatttccaaagccattttcatagtctttccatcctctaaaaaaggtaaagtggaagccgattagagcaaactccatttgtggtaccaaagcgaccaccacccaccccctgctaccaccacctccaatattttcttgattagttaattcattttcagtattcttctttagagagattgaaattctgtctaattaataggcttcaggatatgatcaaaatatttgacttataaatctcacatttgctgctacatataaagtcttacatcataattagcacacctgttaaagttttcactgccatcagatcgtctctgaattacagtccatcctcctccatcggacatgtcacaataaacagaaaattctgctgggctctggagaggtttgattttgtaaaatccactgagcttatacccatcattgaaaatctctgaacaatctgtttttaaaacaaggtaatgtaacattcattatgtgtctttttctccccccgccttagggagcctctgaatgagactactcagtatcactggagacagataacacatggtatagaaatcagcgttttaaaattgcatcttgtacatcttccagtggatattaggaaagttttatttcctttgctaaaatttgccacctgaatccttgatataatcatcgaggaaaaaaggggagtgaaataagaatctagttttttgtttctttcttcttttttcttttacattttttttaagaaatgggggcgtgtcactatattgcccaggctggtctcgaactcctggcttcaaacaatcctatcctcccaccacagactcccaaagggctgggattacaggtgtgagcttagtttctaatttctgagttttgtagaaaacaatcttaaaaaaaacaagttatgagtagtctgttaataacagtatatttaggtggaacttacagttttatcagacggaatagtaaaatttatctcacccatgaagctaaaatgaaagcagaaatgttaacaccaaagttactacaggttatcctgacttagagcatgataaatcattctggacatctgaaaatgaacccaaaatagtaatcttgtaaaaatctttattattatactttaagttctagggtacatgtgcacaacatgcaggtttgttacatatgtatatgtgtgccatgttggtgtgctgcacccataatcttgtcaaaatcttataatctcttagccttattagattttttactaacccactgaagtttctaaaagtccatacattcttagatgtttttgctaaaaactgcaagcttctgctattcttttcatcccttaattcttttttgctgtggtatttctttgaacactgaagcaaatgtagctacccctttgtcaccaaaaagtgatatctctttctttctttctttctttctttctttctttctttctttctttctttctttctctttctttctttctttctttctttctttctttctttctttctttctttctttctttctttctttctttctttctttcttttcctttgagacagagtcttgctctttcgcccaggctggagtgcaatggtgctatttcggctcactacaacctccgcctcccgggttcaagcgattctcctgcctcagcctcctgagtagctgggatcacagccacgcacctacacacctggctaatttttttgtatttttagtacagactggattttgccatgttggccagactggtctcaaactcctgaggtcaggccatccgcccgcctcggcctccaaagtgaaaggatgacaggtgtgagccaccacaccctgccaaatggtgatgtctgttccttaagccacttgagggtgatgtaaattaatacccattgggtctcacctaggttgatctgtacagacttagagaacgtggcaaatggggacctctctattgttcagatgcatagaaagctaggttttaggatgattgaagtagtggtcactataaacaatctcaagaagagccgtctacaaacatttgaataaaaatactataacatcatcaactttcacttttacccttatcgctttgttaatttccttaacaaaaaatttttttcttattggataattccattcttgtagcatattttaaagatgtttaaagatttaaaaacaaatgttcattgttttgatactagattgccaaatttacaactctcttgttttgttacagataaaatatattgcacattaagtaggtgaataggccatagacatcagaagagaaaagaaaagaaagaaccttagtcattttataaagccttcacatggttgggaccaaccatatactcctgctttggtgagatgtttacctttgtaatgatttaggctttattcatatatttattttcaagattcagaagcacatgcgttcatatacatgctaaattataaaaaggatcctgttttggcaattaaacaagaagcaaaacaatgagaaaatgattatctaaaattagttcaatgttgttataaagtttacatcttgtagtcaagtatatagtacaacacttttattaaagtaagcagattttagccctatttggaaagaagctttttgcttacattaaatttcctaccaaagagctgaatactaaagactcacaaggatcaaactattttccaggcaaatatggaagtgattagctataacatttgcctctggaaaacttagtgaatatagaggtttcagccaaaattttctacttgttattattttatgctaactgcgagtttgttatttctttggtcttgtttttgaaattttccttctccccagaagaaaatgccaaacacaacttaagaaaagcttttaactgaaataaacagtaacacaacaacaaaacccccaacaaataaataaacattaaaaaagcaaaaaagcaccagtagttcaatttgcttatagctaacaagttaagaagcctgctttgggaaatgagacttaaatcgtaacagcagaaagtatgaaaaatgtagaatttaaaatatgaacttgatatttaaaacgatgattttcaaaatgttctgacccactcaactccctggagaataggtagaagaaaggcaaggttaaagagctttgtgttcatgggagttttttttttaaaaaagaaaaagaattttgaatatttacataatactagacagaggccaaggcatcctgccttctgttttgacaaacactgtattaaactgggttatgtgtgtcctttctctgatcatgcagaaagtaagccatgttggaaggctgaatgtttaagctcataaagtgacatgacagcctgccaaatgggctttttcctcttgtctcaggatggtggctgaggcacaaagctgagaaccaaaggcacaaagtaccccacattctaaacacaaaaagaggtaagcaacagaggtcagctgccactccccagagcatgttgggatatgcgagaactggccctgctaccgccatcttcacccccaggcaacataaggaaaaaaaaaaaaggataaaggaaggtgggtacatagtaggtgtatgtatttgttggggtacatgtgatattttgataaaggcatgcaatgcataataatcacatcatggaaaatgaggtgtccatcccttcaagcatttatcctttgtgttacaaacaatccaattttgctctctttgttatttttaaatgtgcaattaaattaatattgagagaatgcgatactcttgtagggtagagtgagtaggctttcttccttgaaaacaaggctataataatgtccatagatagctggcattcactgagtacttcttttgctctacgatgttaaatatattaactcattttattttgtttatttatttatttgagacgggtctcactctgttacccaggcaggttgtagtgcagtggcacagtcagctcactgcagccccaaacttctgcaatcctcctgcctcagcctcctgagtagctgggcctgcatgcatgcaccaccaagcctggcaattttttttttatagtgttagagtctcactatgttgcccaggctgttcttgaaatcctggcctcaagtgttcctcccacctcggcctctcaaagtgcagggattacaggcatgattcatggcacctggccaaaatattttcactcatttgaatatattttaatccttacaacaaatacacagcattcttattctcattcttcagatggggaatatgggacacacagaggttatgtaatgtccccaaaggccacagctagcaagatgggcagctggactttgaaatcaaactccagagtcaacaccttaggccactttgtaacctgcctcaagacactcacatgcagactgggggctcctgaagaaggggagatgctggagccagtggtgttgtcaagtgaacggcggtggtgacgccagatttttgttcttgccaccagttaatgtgaatttgacacagtaaccttttaattcataatccgctagcacccaaattctttaaaaaaagatacagcttaatagtatgctgtagaaaatcatgtgcctagtgcattgtttgcacaaattgctaggttgtatgtaattgggtgttttctaccatcagataaattagaattcagaaaataactaatttagtaataataaagtaacttgtaaataagaagaaaagatttatatttctacagattatatgtatgaatatttaattgttttcaatttaaggacaccaaaaacataaactttgaggtgaacaagttcttatatattttataccatattatatatatataaaacactatactttattggaatttttatgttatatattttatttattgagtatctgttcttagtagcctctccagtactatctccctatatgctaaaatataaagaacaattgaactgtgtttatattttatttcccctttttcttcttcatgcttgtaattaatatatgaaaaatattgttttaatctactgaattctgatttttttggcttttatatcaaaaaacagtcatctagaattcctatcatctgtcttattattataacagtattatatttataataattataatgttttttctgaagcatctctatatgactcttctaactcctgcttgtacagttaatcctgctctgaccttggcatcgtaatttccaagtaactgatttcttgccttattccttggtgaccccttacttcccaaagtctgctccccagcagtgtcaacacaaggactggatcttcagctcttgatatgatttggatgtgtgtccccaccaaatctcatgttgagttgtagttcccagtgtgggagggaaggcctagtgggaggcgattggctcatgggggtggagttgtcatgaatgttttagcaccatctctcttggtactctacagtgagtggtgagttctcatgagatctggtttttgaaacagtgtcgcacctcctccctctctttctcctgttcccaccatgtgagatgtgcctgcttctgctttgccgtctgccatgattgtaagttccctgaggcctccccagaagcagatgctgctatgcttcctttacagcctgcagaaccatgagccaattaaacctcttttctttataaacgacccagcctcattcatttcgttatagcggtatgagaacggactaatacagcacttaagcctcagtcttcccatgactggttgtagaggcctgggaacaaacatctgattagctgccccctgccatgattgacccttgagtctgtgccaataacctgctcagaatgtgttcaaatagaaaccccaagtcttgggcttggtttgaaatttggagtaatgatgatccactggcatctacgagttcctcgcccttgagatcagctttgtatgttcttttgggatcacttatctgtatgctcatcccttaaacgatagtccgtttgcttcccaagcccatttttacccgaactgtccctggttcctcttggctccagaggcactggccatcttcaggctatagccatccccactactgcagaccactggctctggcctctttctgatctctaagggccagagggagggcagttggatcaagatgctggccataagagaagcaggagcccagggcgaggagtctgagcagagggagataaggatcttggtagaaaaaaagggagcattttaagagtctcatgcgctacagtgtgagccagccaggtgccctgaagcattttatggaagcatagactctcacaactcctatatcctacacttgtatgattagaagcagaaaataaacatgtttctattcccataagattggcaactctttgacctctacagtctttcaattctagtcaaataggtgtccgaatttatatttgcttatcttgctattcctctccctatgaactaccttcctttcattcctgaatatgaggatctactatgtttcaggcactctaatagccaacagggagataaaagtacattaaatatcattctagacctcacagagtgcccagttaattgacctcaatagactcataaacagaaattacaatgtagcatggtagtgctagaatagacatatggacaaagtgctttcgctagcattctttttgtttctgacaatcgtcgtttactctaaaagataccttttacttctggaggaattcaagtgaacagttttccatagagaataatgatttgtgcagcaatgtgtgtaatgtgttgccagtttaaaatcatttagtttctggggagaaatacctcattgaaaggaacattatgaaatcagaaaatatacatataaaaaactactcttttattttccttagtaattctggttctttttcctttttctgctcctttattttttaccttatttgccaccctaatgcacattaggatttcagaagggaaaactgcatacatgcaacaaggaaagatacacaaacacaaagctcaaatgcaaaaattcccaattgtaatctgccatgtgtacacggattttttttttttttttgagacagagtcttattgtgttgcccaggctggagtgcagtggcacgatcttggctcactgcaacctgcgactcctgggttcaagtgattctcctgcctcagcctcccaggtagctgggactacaggcacctgccaccacgcccagctaatttttgtatttttagtagagatggggtttcaccatattggccaggctggtctagatctcctgaccttgtaatccgcccacctaggcctcccaacgtgctgggattacaggcgtgagccaccgcacttggctgtgtccatcagtatttaaacaatctattgtcctgatttcttattaaatgatataaattctcagatatttagcattcacattaaatgccctggcagagatagaaaaaagtaaagtgtcggctgggcacggtggctcacgcctgtaatcccagcactttgggaggccgaggcaggcgaatcacaaggtcaggtgatcgagaccatcctggctaacatggtgaaaccctgcctctactaaaaatacaaaaaaagtagccgggcctggtggtgggcacctgtagtcccagctactcgggagactgaggcaggagaatggtgtgaacctggtagacggagcttgcagtgagccaaaattgcaccactgcactcctgcctgggcgacagagcaagactccgcctcaaaaaaaaaaaaaaaagtaaagtgtgaaagaagacatttacaatagatataatgcttcatattgcttgttactgaaataggaaaagcctgaaataactagcaccatcactgtacatgggtgcataatgtaagttatagaaacacttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagatgagaagaaaacttgtaaacctgaattagaattgtagaacttcccaggatctgttattgtaatttcacagttgcttatgggagatcaaattcttttgtgtctgttgaatttataagatgtctttatcagattccctccatcttcacccttccagcaacaacaaaaataactactcttaatgaattatgcttttcataaacttttttgtgatttgcaaatatgtcatgtcaatatgtaacagcttattttggttttaaaagagacatttggatttataaaatcccaaaagaaaatatatacctgaaaacataatacctaagatatttgaaagttggctctctcactgggccaaggtcattaccatagctatctcataataagtttttagtttgactcgtgttttcagttggcaataaatatgttttttgagcaaaattataatagctatgttgctttttaaatttgtacccttgtgtctttaactatctaattttaaaatttatcacaaaactcaagtagcataaaggaaaaaaataaatgcccttatgcaaatggcaatttcttaaacataaacaattgcatagtcacagacatacagtcataaagtatttttcatgttacagaaaataagaaacaaaaacattttattataaggaagcaaaagaaaataaagatggaaaacaaaatatttaaaaaatataaagagattttagaaatagccttgttccccgagactagaacatgcagagaaaatataattagaggaagtgacatcattcagtcaaatatcatcaacactagaggctcagagagggaaaattgtttgcctaaagaaataaaagagactttcactaagtatatttacactagtctgggaaatcagcataacgacatgacataaataccatttatttgtgactccaactcaaattgttcttctgactgaaaataaccaatgtatttaatagattactgattaggatttttccttgataaatgaaactgctaaggattagtagtaaaaataatgtcctctttttttatgtgacaggaaacaaattttcattattttaatccgctcccagataatattcaggagtcaaaaattaaaaatcatgaaatgtctgtatcttctagactttgctttaatgttatttgttgaaaaatttttttatttgattaaagttttcttatgcatttgtgggatcaagtactttatttcagaagtgaataaattagcttaaaaagttagagcttagccaggcgtggtggctcatgcctgtaatcccagcacgttgagaggctgaggcaggcagatcacttgggtcaggagtttgagaccagcatggccaacatggcaaaaccccgtccctactaaaaatacaaagaaattagccaggtgtggtggcacacaccttttatcccagctactgtgttggttgaggcatgagaattgcttgaacctgggagacagaggttgcagtgagccaagatcacaccactgcactccagcctgggtgacagagtgagactccatctcaaaaaacaaacaaacaaacaacaacaacaaaaaacacctagagcttaaaaaagaaattttctcattccaatgtttgattctggctcttgcataaatggaagtatgttttgaaaatgctctgaatgatgcacctatatatcatataattttacctacgcacactgtatatatacgtatatgtatgaacataacattattatacataatatgtatatattatagattatattatatatacattatataaggtatataaatattgcttagcattagatttagtaaaaaataaagggctaatgaaatttttttgacaggcctctgtctcttgatgtcctgaaatgtttatctcactaccattaagataatccaataatcaaaaaggcaccccctagtctggtagcatataaacaataaagcatttcaaaatgtaattatttacatttagaaagtcattatattactttgattagctttagaataattcctgagaatatcttaagttctctaaaattttccattttcctcctttgcaattctaaccaacattctctgtaatattgaagaaatgctaagcattaagaaacttgctttgaaattctggtctccatcattcattatagtaaaccattatttcttctgcacatctggcttacagtaaagttgtatcaaattattctgttcatttattgcacaattagttgtatttcttttataatatttttgccttaggcagtatcaaaacttttaattattataaaattaaaattgttatcaaatggctgttctttggtggactatattattttacataattttaatgctataaattctaattccttccccactatatttaaaaaaaatttaattaattacgctgcattaaatttaaagatgaagacattaaatttgtaaatgaaaagttctaaaaataatatataatttttaaaaacaattacaaaacagaagtacattagtagcatgcaaacatttcaaaactggtatgttttaagcaagcattgtaaaaggatatataaaagaaataaaaaggaaggaaaaagttattgaacgaagtatgtttaataagttagcattcacaaacgctataggactataatgcttaggactataacctaagtcagtgagttaaaaatgtacccataaacacaagcttagagactccttttaagctatttccttccaaattttttcctctttctgaaaatggaatataactgtgcttttgtatttttcttaagaatccatactcactgaaagccttacaaagctaaatatagttgatccctcaagaaatgcaataaagaaaaatgtttctgaagttttttgacttctgaagtgaaaattgtcatatagtccattttatttttaattttttatactgaaactgtaaacctatcatttacgtcaaactcccatgcaattcattcaaaatgtaaaggaaattatacaaagtgagactccatctcaaaaaaccaacaaacaaacgacaacaacaaaaaacgcctagagcttaaaaaagaaattttcttattccaatgtttgattctggctcttgcataaatggaagtatgttttgaaaatgctctgggtgatgcacctatatatcatataattttacctgcgcacactgtatatatatgtatatgtatgtacgtaacattattatacataattatgtatatattatagattatatatacattatataaggtatataaatattgcttagcattagatttagtaaaaaataaagggctaatgaaatttttttgacaggcctctgtctcttgatgtcctgaaatgttcatctcattaccattaagataatccaataatcaaaaaggcaccccctagtctggtagcatataaacaataaagcatttcaaaatgtaattatacatatttagaaagtcattatattactttgattagctttagaataattcctgagaatatcttaagttctctaaaattttccattttcctcatttgtaattctaacataccttatttgtatatctgtatatttgtatatctgtatatctgtaacaaaagatacataattctaaatctcttctccaagtagcagaagcagactccttgctagtcaacctgacttcttgcaaaagctaatggttgttacctgagttttggttactatcatacctgtgaaataaattagcattattacaagcatgtcaaaaatgcagagacattaaataacttgcctaaagtcagaagtgagtcagagacccagctcaggttccatccagacactctgcttcccaggatcctgtaactgcattgggaatttgtaattatttctccattatttgattagaaatagggacaatgttgattctggcttcaatccagaaacaaacatgtggacacaggtttaactgaaagaaagctaaaagagaagattcaaggacaaatcccaatactctgatatttttcttttttccccacttgtatgactttttgtgaaagatccaataatatatctttataaagatatatatattttacaacttattattatgttcattcagagaatttttgtactgtaacttcaataatgttccattgaagattaagtaaaaacgaagtccagctgaaactttgctttgtattaagggtaataacattttacccacaaaaatatgaattaatatgtcatctcaactaaaatatggagataagccaaatttttcctagttataaaaaacaaggcaggttaataattgccaaggtgaaatggtcagtttatttgctctctaagaaaaacaaaagtattccctgaggtgcaaaattgtgaaatttaactggaagcatcgattatactctggacaagttgttccttttgttttaaaatcctctagaagattttctaatgtgtaataggcacttgttagctccattaatcgtattgtgtaacagtttcttactggaaatctgggttcatcatttcttctttccttctgatgtaactcaagcagttgtttgccatttgtcctgtggtccctatttattcactcagattccagtaaaataccaaagttttgttttctttctgttctttgttatctactggacttgagcactgacgatgtttggtcttcccattaaacatcttcctgtccttcacgtggacattttgaagattattaagggaaaggtaatcctgttgatttactggaaaaaagaaggaaaaaaaaagccagttagactgaagtgatttgcacacacacagaagaagtggaaattatacattcataattgtagagaattcaagctgctaatgttaaatttcaaaagcaaaaatatgggattattcggctaattcaataatgatctctgtggtaaaatgacatattttgaaatacaaacttatctttccttcttgtatgcctttagctttgtccccattcaagcaataatttagccttgtgttcatttcctcactggagggacataacattaacagcagctaacatgtggtatacttatcatgtgctaaacatggtaattttatcaactcactcagccacacagccctataagtaggtactgttaatgatctccatttcacaaatgacgaaactgagacacagaggtttaagtgacttgcacgaggtcacacagctaacaagaggtatagctgggctcaaaggcaatcctgctcagaatctgtcctcttttctactaaaggtagactatgctgtctttcggaaacttggctagcatcattacctcaggagaaacttgcaaaagttaatcaggcagtaaggactactctagggccaatactttgtggaggaattccaaaagccaaattttcttggagtaacattattccatggatgtactgccataacatggtggaagaactatcatcaggaaaggtcaaaattatggccaggtgcggtggctcacgcctgtaatcccaacgctttgggaggctgaggcaggtggatcacctgaggtcaggagttcgagaccagcctggccaaaatggcaaaaccccatgtatttttagtttctactaaaactacaaaaattatccaggtgtggtggtgggcgtctgtggtaccagctacacaggaggctgaggaggagaattacttgaacccaggaggcagagattgcagtgagccgagatcgcgccactgcactgcagcctgggtgacagagcaagaccctgtcaaaaaaaaagaaaaagaaaaaaagcaagaaagaagagttgtgaccttgcacaactgcaccaaagctatgaaatgagaatgagacctgagatcactggctgaaaaaagtacaagaaaagcatgatataataggacaacaagtacagtcccaccaagatcaggctgattaggctctcaaacacattaaacggacactgtcaattcttttttccttttccttttggaagacctttttcagagaactcttcaattaatacatcagttacagcacaattttcatccaaaccctctggaccctgtattgtgcctgccagattgaacacctgtccattatttgatacttgacccagtcaccgtgggaaggtttaattccagatcttgccgcctccagtccactcaagcttgcagcgaggaacatgtctacttaaggctgcatgaggaactagactcagacaaatgatcttatatccttgactgtattctaccagcataaatttctgatggttatattttccaaacttgactcccagttcaggaggcacccttttatgggacttataaaactccatgctctgattacaatgataacattttaaacttcaaatgtgccctttattaaaatatttagaacggagcgtattgtagatatcaaggaaaggggttgttaagaacagtcttcgttccacacaactagcagagcttcctcaggtggaggtaatcaaattccttcctgaaatgctggtttcaatgtcatctcaggcagagtcctgaaaaactagaaagtttatttgcacataacgtaggtctcagaaatttcaatggagaagcattttaaaattaataaaactaaaacagttttactagtgagttatcctaagtattcccattattgatgtaactagcagaaagtttacattaatagatgatcaataaatagttccaccttcacacacactttctgggaaagattctgacaatatgaactagaaaaataagggtaaaggtggataaagaaaaagaggaagaaaagaaaaattgaggtgctttgtaatgtgtcaacttgggtaggccgaactacagttcccagaattccttttgccttatgttttccattaggagcagttggcaggcagaaaggaagtggcagccatctttgcagctctcccatgctgtaacgtatctcgttggccttaagatagtggctaagcctccagctgtttcacttccctttggatataatttggagcctcgtttagcacattacaaatgggtctggcttctgtaggacacccacatcaaccaaggtcagaggcaacaagaactgacacaggtttcagtccgtcctcatagattccagctcctgcttctattacgctcatctactctctcgcttaactgcagttcgtacttcaagctccaacatcatccctggagacagctgcctttcaaagagtacttaaccagctcccacagttgcattaagtcaaatcccttatatatcctagaagctctgcttctatgattgaactctgcctgtaactctgaggctcctggacaggaaagtcgaatgcctcagaaggaattttgtcactgcaccattatttcttcctcccagagctctctgttcttttgctcacatctggattgctctccctctaggcctgctacatgaggcatgtaaaaagtaatactgatagacatttggcagatactcccaaatgtgtagcttcaggttccacacaacctatgtcctcccctgcatactagttaagataaaatgaaacgcttattcactactcatcttttcagagctttctcacctatgtgtttggatttttttcccctctgattctcaaactaattttagattggttccctagcaggaagagtacaaagatgttttctttttttttttctgccacaaaaaataaaaagtgttcttgctgaggaatatgtttgtttttctttctgtgtgtttgcaaggactgtggactggcatttattttatgcttctgaataataacatctttcttattaaagaagaatctccccagaaggtcacatgtcattaaaaaaacaattttaaccaaatacacgtaaattctaatagaaaacagattttttacccgtaacacatgaagaagaaatttagctatattgtataaaaatatgtagggaaaaaagaacacaagagctcgtgttaagtaaaaccacattttaaaatacgcctttaggaacacggaagatggaaggtatcagaagatacttgctttcattctactcctcggtgatgatgtatctgcttttttttttttttttttggatgaatttgcagtgtatcttttcatcctgatgcctaaatccagtctctatatgtacctcttttctccagtttttagacttttaaaatattatcttttcatgaagaattcaactaattggaaaatgcgtgattcctaccactatgacaatatctgaaagtagaatcctcagggttgcaagctattctgacaaaatttctgaactctagcagaaaatgtaaaaatatacatttgacaaaaatatatttgcccatttgaatttaaattttgtcttttttttactcagtttttatttcttagaaaaaggaagacaatctaaatataattccctgagatatagtttcctttcacttcaaaataactgtacattaggttgagagacaaaaaaattcattgtctacaattacacatactttctgattaatctgttggttagcccacatttagttcatcaggcacaacttatttttctgcatgtgcatttgggacaataaccgggcatatgaaacctttaaaatttacatttaaaaatttatatttgcacttggataactttgccaataactagaactccctcaaaaacaaaggctaggtccctgactcctataggcatgaccaagagtatactacaaaatgattcctctgagactgaaatgtttttttcctgcttccccctcagagacacattgtggaaaaattctagaacttttagaatagacattgtgtgcttgactccagcgatcaaagattctgaaatattgaggccctatttgagagtcatacacttatactagttttatttgttgttgttgtttataatctgaagaaatgaacttcagccatctagaacaaaaataattggatttgttggagggttacggactgaggtaagtagtacaatcagtgacagactgatacaagccaagggaaggcagaataaggaaagctccaaaaatctctcaaagatgtgttcttggatttattctgtagtatgcagcccttaaaatgttttaatttcagtggaattctggcctctgtgtctgtccatacaaatctcacatccctaagagggagaatccaattagcccagtcatcggtatttctttctgtttttttctttttctttctttcttccttccttccttccttcctttcctttcctttctttctttctttttctttctttctttcttctttctttctttcttttttttttttttgagacagagtctcactctgttgcctggctggaggatagtggtgcaatctcagctcactgcaacctccacctcccgggttccagcaattctcctgcgtcagcatcccacgtagctgggacttgggcatgcaccaccatgcccagctaatttttgtatttttagtagagatggggttttaccatgttggccaggaggtctcgatctcttgacctcatgatccgcccacctcggcctaccaaagtgctgggattacaggcgtgagctaccacacccagccatctgtgtatttcagtgtacacctagatatatggcacccacacactgaggccacacctttactccctggccccaaaatttttgtcaaatgtggctgctgggtgatctgttgtgagcaagaaaagctccatagtatgtgccattctcctactacaaaattaggaaatttcaagagaaatgaaaggtggggatctgtccagtttaatggaagattgcctggctcaataaagatgctcggcaagcctaagactgcatctccaatgactctttcaccaatgaattaaccataatacatgtacccttttctattgctgtgatgtatatagttgttacctttttatttgcctattctaatttctatgtaccctctctgaatgaaataagtcttaattagccaccagcccttctcctagcccatccaccaaggctagatgttctcctatgtatttacttctcttatatcacacatcactatattgtgtactggagcttctcttttcattccagggagatcaggggcttgttttttcttatttcaatatccacagcacccagcatatgcacaccacacaatagaagctcagaaatatttattatgcatggaatagtaatatcacctatttgtattagcatataatgtaaatattcaaaattggtaacgattaaacttgataacttacatgaagtgcttatgacaatgcctgatagaaaatatgcgataaattttcgtttccttctgtcttgaaacaatgtcatgattgtttaattcgttctgtaaagaaggaggcagcaggctggctcctgggattggtggcttacacctgtaatcccagcactttaggaggccaagacgtgtggatcatctgaggtcaggagtttgagaccagtctggccaacatggtgaaatcccatctctactaaaaatacaaaaacagccagctgtggtggcaggtgcctgtaatcccaactactagggaggctgaggcaggaggatcacttgaacctgggaggtggaggcaagatcacaccattgcactccagcctgggcaacagagtaagaccctgtctcaaaaaaaagagtgaggcagcaatgtacaaccaaagataatacatcatttcatgaagataattccaatgttagattaggaagctaccatgtccagcctgctgcatcattctttacagaacgaatgaaagagtcatgatgttattcttaataatgtagaactatttgtgaaatgtggatgcagtgaacgttgatgcagacaatacaatgcccctaaactcattttactaagattcccaaatttactcatgctttagcacaagaattttacatttcagttaagaaaggtgaaagaaacttctttaatctgtaatggaagaccttgtagcagaacaaaattgctaccaagaaagttgaaaagtagatatatataagaaaaatgtttttgtgacctggattcacaaagtctgggataatgttcttgctcaacaactatttaaattgggattccctgaaagcagagcctgagacaaagatttggatacaagtagtttatttgggaggtgattccagggagcataaacaagggtgtggtcaaatgaaatagaacagggaggaaagccaaaaagtacctaatgagtgggggtacactcatagacaactgaggctccaacctactgaaacctctgagagccccacatcagaattttcctctcaggtggcaggagaccaagagtaggtatatatccaccaaccccaggtccttgttgcttgagggttgcttctgtggtattgattccacctgttgtactatgatccttccacgtgtgctttaatccccagctcctcatttcttctctagagctaggttgattaccttcctctttttcactattgacttcaccctttccttccacagttgtttcccctttttactctatgaacaagcccaagtctattaaaccctagaaaattaaaatctctcttactcctgcctctagtaactttcctatttttctctccatttcaactatgcttattttttaagaagacagtccacactcactgattccacggtctctctttccatgaactcctcaattaaagccagtgacttctgactcctttactgcaattgcggctgcttacaagatgccacaacactcctcatggcagtttctcgctgaattctcaggctgctccttcttcctcaaaagttcttcttccacaggcttttataaaacccatccctcttagttctctgggcatcctccaagttttccatctttcctttatggagtattctttcctttttggtccattgaatgttagtgtttaacaactcccaaatatttcattccagctattacttctctctgtaactccagaagtgtttgtccagtagcctgttagctcagactaaatttattatagtctcttctcttcctcttccctccccttgggaagaaaggcttgccttcgaaagaagatagtgagttggcaaaaccagcatttactcacttcatttacccacttcaaaatcttgggattatcagagaacattcctcctcctcatcctgcatttccagttagtcaataagttctgctgattctaccttctaaatggtaaattctctccatcagcgccattgctgctgtcaccttaattcatgtgttcatcaccttggcataatctactggtatctcttagttgatcaatctgctcccagtttcttcctcatgcagaccatctgctacagagtataaaacattatcttgatgcaaaaaaagaccacattacttctctacttaaaaaggcttagaagttctccatcaagtcaacaatcaacaagctaaaatctgatttcttttatgtggtgatctagctagtcccagtgtcagtatccagaagccgctcaggtggtcccaatggctaaagccatcatgagccagccaacctggcatgtgtgggtgctttgaaatcaatggttaaaatctgagtgtgggaatggatcctgagaccttgtagccctaagtcagtattggcacagagccttctctgtaaacttaaattaagtgtcaacatttagaagtcacttactatgagccaggtactctctgaacacttcctatgtactaattcatgtaatctccagagtagccctttgagatatgtattattatttttaattcccattttcccagtgaggtgactgagacataaagagagcaagcaacttgcttaacatcatatatgccacgatttgacttgaagtagactgttctagaagcagggtcttatccatttgctatgggctttgttagctttacacagaggctgtggggttcccaggcttagaacataattccagcctgtgcagggatctagatgaatcagaggtgaagagtggaagaaagaagcagagtggaagcccaagccactgatggcaatctgaacttggagcgtaacatcaccaggagaatctttatctccacatcttcccaatcctctatagttctgtcatccaacacacacacagatacagacatacacacgcacacatagacacacacacaatccatgagaagctttcaccagatcagaagtggaattattgctgcagaaggtaatgatggatggccccagaccacatgagaatgtttttaaaaatgacaaaatattgggaatataacaaacaagcaaaaaaatgggacccatctagagagccacatgtggtctctaattcctccctgcactgtgggtttggaatgaacactggcccctaagaaccgagttagccatgccctgttcttctcttgaatataatgggaggggatgtcagggaaatggagatgtctcttctcacaatatctgctaatcaggattgttcagggccttgtgcaattaattttagctttcaaaaaagaaataatttctcagaactccatggtgaggaaataggtcatactcattagcatagtcatagaggaagaacagtgtttaataataggcctggctgaaataggctagcagtgaaactagaagggcaaaattattctgttaatgaagaattaatgaagattttcgagtttccttaggtaacccaagaagaaaggtgtgaaaaaggaaggagtgaatgagataagaatggggaggaggatgtgaggaaggaatacatcaagatgccagggagctgagcaagaggcagccagggagaagttctgggctatggccaaggatctttaaagagcaaggatctttaaatagtcagttttaagatgtttggtgcagcctaaattcctcttcctcttcccctgcctgaatcttccgtaagaatctactacacagagatgccttgtatctgcagcattttgagaagagggaaagaggctgttgctttgggaatgatgcagagtggagaaaaagaacagccaaaagaggctagacttgagagaaattacagtaattcagtaaaagcaggaaataatagaaaaacattgactccaaagatcctggaaggtgccagcaagtgaggttaggtttcccactgtagatgtaatggaaacatggtttccccaccaacttcgaggcttgagagcattcaggtaactgatacttgttctatgttagtaaagcggatatgtgtcttttgacaatttacatgtgaaataactgcagctgttttctaattgaatttcaaggctccattccatgggctcagagaaatctgattctctactgctttcagcatgatatcagacaatttagagtttctctccagtctgggggttgcatatgatttctggggtttggggtggtgtgaagttggtataatatcactacaactgtctattcttgctctagtcactgggacctcagcctgagggactacacagattgctgccgcaaatccccccgcttccttttcagcaatgcaagggaaaacatcacattcttttgatttcccaccaattcatcctctttccaccccggcaaattgtgggagtgggagcttctctgattttaatcttttttcatctgttgtttctaatattgctggctgtgacaatccgcagaggaaatgcatgcctacctctagtctgaatggggaaaaacaaaatccagtatataagaaaatatatggtacagtggctgtgcatggtggctcatgcctgtaatctcagcgctttgggaggccaaggtgggtggatcacaaggtcaagatatcgagacaatcatggccaacatagtgaaaccctgtctctactaaaaatacaaaaattagctgggcgtggtggtgcatgcctgtagtcccagctacttgggaggctgaggcaggagaatcacttggatctgggaggtggaggttgcagtgagccatgattgtgccattgcactccagcctggtgacaaagtgagactttgtctcaaaaaaaaaaaaaaaaagaaagaaaatatatggtacaaactaatacctacaaatatcattcggttacattggctttataccctctctttctattagttcaaaatagtactcataaaataaccatcctgtaaagtaatgaaactgaattttcttccattgctaatttctcctctgacctaacattaattatctaagaacttaagtgtttagtgctctacatcagaggtcaacaaactattgtatcgcccacagtctaaactcgacccatggtccatttttatatatttaagtagttgaaaaaaatcacaaatagatcgatatcctgtgacctgtgaaaattatatgaaatctaaatttcagtgtctacaaataaagttttattggaatataggcatgctcatttgtttatatactgtctgtagctgctttcattctataaccacagagttgagaagttgcaacagaatgtatagcatacaatgctgaaaatatttaatatctggtcttttacagaaaaagtttggtcaaccttgtaggggaaccagcccgctataccacccgcgggttctccccttcccagtggagacgagggaatgagaaaagaaataaagacaaacacacaaagttcaagagttaacaaaagtgggtccaggggtccatcgcaatgtggaaactgcgacagccctgagctctggattccactgatatttactgagtacagttcctttgatcctataggctgagggtgggcagatggtggggtgatcacagggtgaccatggggagaggtggcagagggggtagcatgcgtcatcagcaagttaatattatttactgttccactgtataagctaatactctatgtttaac

SEQ ID NO: 775 - DNA, 89483 bp, Homo sapiens
catctcacctgactcataagcaaagtcttcatattgctgtagttgctatttgtaaagccttcaaagttgccatcttagaaatattttgattaaacaagatgcagaaagttaaaaaataaaaagacagagagtgtgctggagggaaaaaaaaaaaaaaaacttgaaacaaaccatcctcacccaaagggataatttctcaagttctcttttggtagtactacctaccagaacaaaggtataacaccagaacaaggtataacaccagaacaaaggtataacacttgtgtaacactccagaacaaagcagaatgatcaagtttcctttctaagagaatcatttgggaaaacaaggagatctttttcagagaacattttggaccagagagaacaaattccccacttattaaagagctgggaatgtaacagagcagctcctcttaaacggttaccaaaatatatatttccctaaggatttataaggattaaaaattagtaaatatgtgctgaaagaaatggtcaaagaactactagtacaagctttgaggtataattccaatgcctttggaaaaaaaactttctaaatcttagcttaagaaaagtgattgtttattccccaaagataaaaaattccattatttcttcatgtgaagagacacacctaaagaactgaatcattatattaattacaattattatcatataatagaattcatcatcattaccatattaatgctagaagaaattttaaagatccaattcaaacttcattttacaaatgagaaacctctgagaaatcaactgcatgacgtgaccaaatcagttgtcaatagcagattatacaatagctgtgtgccttatttcaccaactgaactagaaactcaatagaggcttatataagagtagatgtcttctatatctccctattacccacagtgtctagcttaataatttggacctaatatagttaaccttgtaacaccatattataactataaaatcaagaatgtttccaaaagtaaaacataagaactggcttcattactttataaccacacagaatgtaattttactacttatttatgttaatatatggcacgccagtcctttaagatgtgaatacaaatacagttataatttatagcttccaaatcataaagccattatcagtcttcttaaaagtttttaagaactcacaaatcacaatagtagtttagctctgtaagctttaaaacccaaaatattacctgatcttcaacctcccttgaatcaaaaaagatgacattggcacaacatctaagctatcattttatcttactaaaaacgaagcagttgaggcctggtgcagtggctcaggcctataataccaagactttgggaagccgaggtgggcggatcacttgaggccaggagtttgagaccagcctagccaacatggtgaaaccccgtctctactaaaaatacaaaaattgccaggtatggtggcaggtgcctgtaatcccacctactcaggaggctgaggcaggagaatcactggaactcaggaggcggaggtcgcagtgagccgagatcacaccaccacactccagcccaggtgacagagcaagactttgtctcaaaaacaaaacaaaacaaaaacaaaaattaagcagctgaacaaaatgtcatcagcagcatgtattataaaaaatatattcataagactccacctcctgttaaaaccattcaaggtagctaacagttctactctaagcctcaacttcctactatttttcataatgcaagcttacattcttaaatttgctcttgcagcctacctttcatcaaacttaatagccacctcaagcactacgtttaacggagcatgtctaccacctaggaaccgagtagaggagtacttggtggtcaatttcctaaaagcataacgatttcctatgaagttgcttaaatcaacagcaggaaactagagttgatttaatgcatttcaaaatggtggacggctatgaagtaatacaagttataccttaaataatttagaaaacaagtataaatttgaaattacatccttttattctgaaacagtatttctctgactttaatgtgcccacaaatcaactgggcctttggttggtcaactgactgattcagaaggcaaggatggggcctgagattctgcatttctatccttctccctggtgataccaatccttttggtccatgggccaccttggattagcaaagatgcggcaaagagctttgagaaacacctgtccagttgaccagatcaaaaacaacagtggctgtcagggctgactgctttcacatccaatggtaccttttttttttttgagacgaagtcttgctctatcccccaggctggagtgtaatggcgcaatcttggctcactgcaacctccccctcccgtgttcaaacaattctctgcctcagcctcctgagtagctgggattacaggtgcccaccaccacgcccagctaattttttgtgtttttagtagaggcaaggtttcaccatcttggccaggctggtcttgaactcctgtccttgtgatctacacacctcggccttccaaagtgctgggattacaggcgtgagccaccacgcctggccggtaccatttcttaaagtagatacagactttctctacatttggactcttaatttatgcttttgaatgctgctctcaagacagctcatattttgcatctagaaaataactggaaatgcagagaatgttgtttccataccacttcggcttattccttccacgtggagggagtttaatttgtataacactcctggcttttgactcactccatccaggagaagtgaagtgacttagtggatttttgtaaatttagtgagaattagctgcacaaacccagaatggcccgacctctttttttctcttgggaatgagctgcccaccagagccaggacgacggtgcactgagggagatactcgctggaggcactaaggcaacaggattaacagtaccctacccagcctggagccccaggcaaagggaaacacaagtaactgtggctggctggttatctaactcatctcctcttctttctagcacacagatattatgtttctatgtgttttgcaggtaatgctgtgtgttccagacagcagaatgtgagtggacatcatatgtaccacctctgggcctggaccatagaactcacacataatccttcatgttcttatgtgaccacacagatgaacaaagcaagccaagtgtggaaacgtgttaaagatgacggaaccacaagatggaacaagcctggatccctgaatccctccttggaggattagtgcccacaaattgtaaacagccacccagatctcagcgagcaagaaataaattatacctgaatgttttaaagggttttttggtggggaaagaacagtgatgatagatattcttaaatactgtaactactttgaaagaagagaacaacagttaagaactatgtcattttagtcatcttttgttttgtcaaaacaaagatgttacaggcctgtgcttgtttaatatgaaaaaactctatgatctacaaatccttggggatacagagaatcagggtagctggtgacatctgacctatcctcttactcactgatattgttcagaaatccaagctaagaggttctaaaatagcagggaaaaatggtaatttctatgcacttgcatttttatgaaagaaaactgcaaaaaaaaaaaaaaggtaatttctatgtacctgcaattttatgaaagaaaacccattaaacaatagtttataataatgcatcccctacacactgaacaatttccctgttcctgtttcatctttatatcttccccaggtctgcttcttttaagacgtcttcacacgttaatctagtccaagggctggcaagccatttctgaaaaaggccaatataaaatatcttaggctttacaggatgtgcggtctgtgctgcatttattcaagtctgctgttgtagaatcaaagacgccacagacgatatggaaatgaacaagcgcaactgcatcccagtaaaatgatttacaaaaaagaggcagtgggccagacttggccgtggactgtagcttgctgacccctgaactagtctatgccctaatcccgtggtccccaacctttttggcaccagggactggtttcatgggagacaacttttctgcggaccaggaggagggggaggattcaagcatattatgattactgtacactttatttctattagtattacattgtaatacataatcaaataattatataactcatcataacgtagaatcagtgggagccctcagtttgttttcctgtaagtagacagtcccatctggaagtgatgggagacagtgacagatcattaggcattagattctcataagtagctcgcaacctagatacctcgcatgcacagttcacaatagggttcacactcccaggagaatctgatgctgtcgctaacatgacaggaggtggagctcaggcactaatgcaagcgatggggagtggctgtgaacacagacgaagctttgccccctcgcctgaagcctacctcctgctgtgcagccctgttcctaacaggccacagcccaggaattggggaaccttgccgtgatgaatcaaaactagctgtcattggctgggcatggtggctcatgcctgtaatcccagcactttgggaggccgaggcaggcagataacctgaggtcaggagttcaagaccagccttgcaaaactctttctctacaaaatatacaaaaattagccaggcgtggtggtgtgcacctgtaatctcagctactagggaggctgaggcagaagaatcacttgaacccagaggcacaagttgcagtgagctgagattatgccactgcactccagcctaggaaacagagcaagactctgtctcaaaaaaaaaaaaaaaagactagctgtcatctatacttcaccatcattaaaatacagacaccacacacacacacacacacacacacacacacacacacacaaatgcacacacaatttttttggttttatttttatttcttggctctttcagagacaggtcaactcaattcaaggacagtatactctcaattttctcgtaaagtccattactacatctcttcataaaaataaccactcacaaaatcaggtaccatagggcttctaaattacctaacaacaaacagaaatagcaccaaaaattggttcttacttttcacaaatcctctccactaattatcatttaagatatcatttactatatgaaattatatactttacatactataaattatacactacaaattaagagacctttatgctagcattagtttacctttgtttaaataaaaaagcttaattgtcactttagaggcattttaagactggttgacactgggtgccgatttagtgaatttttgtcaccaagttcaagtttgctacagctgtcaaagatcataaaactgaaagcatacggtattagcaaaaacaagtcttatcagtatccatgcaattttaaaaagaacagaaacttggcaactaatgggtaattaaatgtctgcagaccatcacatgtgagtacacccagtacacaagtaatcatcatccttaatgagaatgagaaaatgtttaattcccactcatgccaaaggccacatacaagtctccttcctccatgagatctcctcctactactcaacatggctatcttttttcaagtttaataggcaaacctctctcagcacttgactggaataactgttgcaccatttgggagttatttttcttttagacatttgcagatcttatctgaaggtgactaagagcccagagttaagtatttgtgaggcaatctatgcgaactctgaacttacctagttggcttatatgaaatttgtagaacgcatggcaggagcctgtgtaagaaagtattgtcctggttttctggtggtttgttgttgttgtggggtctgagaatgtacagccaacccctcttttataacagagaattgattttgatacatattttaaaatatgatagtgcagagttaatggatgttaaaattttattttcttgttttggtaggtagattgaattgagaatcatataatcagtatatctgagaattgtatgaccagtatattttaaaatatgatctttcttttaatcatattttaaagtatgatagtgcagagttaatggatgttaaaattttattttcttcttttagtaggtagactgaattgacaatcatatgatcagtatatttgagaattatatgaccagtatataataagactggcacaaccatttgccatcttttcctgttatcatcacatagtgtgggtggggagaatgaatggaaatcactccagaataatgacaaatggtttttaaaactctatgctgaatacattccagctgataatgaccgacttttcttttttcactttggtgatatcatcctcagggtaaaaaaaaaaaaaaaaaaaaaaaaggcatttataaaaaacagtttcataaatcttttagttataaacaggaaagttttatattatgtgtcatttcatttctagactgttgatgatgatgataaggaatttggggccaattttgatatatgaatgtattgtttttccatgtggtgattaaagcttccattagcagtttaaaaaaaaagagtgagaggaggtaaaaggggctgggtacagtggctcatagctgtaatcccaaaacattaggagtccaaggcaggaggattgcttgaggcctggagtttgagactagcctgggcaacacagcaaaaccccatctctttaaaaaaaaaaaaaaatcaaccaggcatgggggtgcacacctatggtcccagctactctgaaggctgagggcaggaggactgcctgagcccaggatttcgaggttacagtgagccatgatcacgctactgcactccagcctgggtgatagagcaagaccctgtctcttaaaaaaaaaaaaaaaaaacggtgtgaaagagactgaagtgcagcaagatgctccaagtttgggggttggggaacatgaagataaagagccaacggtttggtcagctcaagagtttggcttctactctgagagcaatgggagtctgccaaaggagttatgatggagactgatgcttcgaattggctaaaggtggaagatgtcctagtgaggagagactagacgcacgaaactgctagggcagatgggaactcctggcagtggcagcacgaggcaaaggagaggacaagccagacacgcttaaaaggccactgctgtgtcctctgccctgagcagcagagaggctggcacacaatatgtgcccaatacaggtctgttgaattaaacattattttaaaagactacttcacttacattaatatttaaagaaggaagccacagcagatagtatcagagagctgtataaataatgtatcacattctagagagatacacgaaggatttacgctttgagtataaactaggagagttttataatgttctctcttctctttcttcaaataaactaatatgtgagctcaggatattaattcaggattttccagggtcttgaaggtcttttactcaatccaaaataaataaaagagaggttcaaaacatgaataagagatctgggttaaaatgaataatttattaagcatagagacagatactagtttaattatccaaggaaaactaatttgcttctttctaaaacacacacatttaagactttttaaaagaaaatcatatacaacaaagaaagctatgagagaaactctgtttatgccatggtaaaaaaaaaaaattaaaatgacctcaacaaaaatatatcaccccctttccctacccaccctcaaagccacatgaggtttgtatttaaaatatctttaagagcctttttgcagcaattagaacatttttatacaaacagtcaaaaattatcaagtgacttataagaagatagaagtctcctacctccaaaacaaaaaacaaaaacaaaaaaccattacaagaccaccagcagagaagagagagtcctggtgggcagacagcattccaaagtcctctaaaactgatatcaacacaccagaaaagtcaaagaatctcccaaaaaatcatgtttacaccaataaagattaaacaattaatggtattttgtttacacttctggagttttcgggggatttttgtttttgtttttttaatatggttacaatttaaatgggcattggagtggaaaactgacttactcagtcaatagcacagtatagtcagtttgtcttagataactcacactatgcaattaaaaagcctctgcttgggggtggaggagcaagcccctagctggtgatagcaaagacagcaccccgaaggagaagctcccagcaaagcctgcgggaagtataaagattccagacaaaatcaattcactgacctgctaaggttcaagaattctgattcctcaagttcattccaaaaaatgcttttattccttttttttttttttttttggctcaacaacttcctaaaacctccaaaccagcatgtggaagaccttacacattcacaaactcttaaaactgcatttctgaaggcttagtcagtaatttttttttttttttttttgagacagagtctcgctctgtcgcccaggctggagtgcagtggcgcgatctcggctcactgcaagctccgcctcccgggttcacgccattctcctgcctcagcctccccagtagctgggactacaggcgcccgccaccacgcccagataattttttgtatttttagtagagacgggatttcaccgcgttagccaggatggtctcgatctcctgacctcgtgatccacccgcctcggcctcccaaagtgctgggattacaggcgtgagccacccgcgcccggcccttagtcagtaatcttaataaggaaaatggtttaacattttcagggcatcctatattctttaaacatatcataaaagcagcagaaataacaaagttgtgtttccctcaatcctcatctcttgctgtgaagacgacatgaaagccaaattaaaatgctcagatcattttaaatcataagcactcaagcagtttcagttttcttctctctctgacccactgccacactctttgcttacacacacacacacacacacacacacacacacacacacacacacacggggggggttgggggggaagcactacagtcagaatcacaatgcaaaagtgagaaataagcaaggttctagacacttcagatgacatataaagtatataatacataataatttcctgccgcactccatacaattgttggtgtaaccataaaataaccacagtcatttgtaataatatacaacatttttacatgttgcttaatgagagtttttgtacttgatattttaacccaaagcagagccctgcatttgattattatcctttacaaaaagtacataaggggatactcacttttctgcataatcatcttagcattttcaaacgttctagaatttagcctgaagtaggggtaatctaataaagtatgataaataccacaaacaaaatataagcaggtggaaagcatctaagatttaaagagcagcttcaaaaaaaaatcccttttgaaacttgagtggttttaatttaaatgccccaaatcaaccataccaagctaacttacctatattcctcagaatatcaaaaccaactgctatcaacttaagcaagagatgtcttattcgagttatctgtccaaacaaaattttttaatgcctttggttgcacctcagagactgtctttttcatggagcaatgcagaaactgcaaccagactacaggaaatacaaacaccagaccgtacaatgaagcctctctggggactatgattattcaaagacagttcagccttgcagcagtaatagggctgagtgtaacgacttttttattcttccaaactaaagaattttccttggactctctgccaatgaaacatcacagacttttctgaggctttacaggcagaaaacttgtacgcagatgtttcttggttatactgtacacatcacttgcaataaaactgtaaacaaacaaaaacatgacaagttctttaagcaattttcagatcatctctgaaaacagaaggcacttttgcctgtcagattaaatcagcattcactgtggctgggtgactgcttctggattaaagaaactggaatattccagtgatttggataatgaaaaagaaaaaaagttttaaaggtaagatgttaagtatgcatctataatataattggaatttagatgtaaggaataacctacattaatctggctacaattgtacttctcactcccttgactaattacctataccaataagttcttaggagtgttatatcctttaaacttaggaacttcagactgctcaaaaattatcaagttaataataaataaaataatctgtgtaaggaaaagttcctgaaagatacataccttctcattagcagtggttcaccatctcaggtcaatgatgaggaaggggaggcagggggctgcactgtaagtttactttatacatttatataattatttaaatatttgtaattacttttggaattttgaatatcaaaacaaaataaatttatgctccaatggaatcaaatacatgcttcatgcaatgaagttttcaaatcaacgtttctttcacagacattgcaattaaaagatctgcaaatcttttattcagaatcttgggccagcgtatctgctctcagcaatgtgaataactagtgtcatcaaagctgttactttacaaaatagtcagtgtagtccctaaataaatgtctttcaaattccaacaacagattgtctgaatcagacacctgaaatgcatgccaagaagtcttgcaagcaggcagtctacgcatgaaaacaaaccctatgatagattctcttgaaattaaatacaactcttacaacaaagacaattttactattttccgataaacagggtccactcatggaaaagagatcgactaacatggataattcatcgtccagtgtttacagtggctgagttcatttaacccaatctactagttctgtatgtgagaaaactgagatctagagaaaagaagttacgatttctactagtgtctactgcataactctatgagtcaccattcacaccacattctatggacagaaacttcactggtccatttacattaaagatgatggccatggtggcccagaattgtgcagggtagtggcctggatgacttttaagatgacacaatgatttagaagcagaatcaggatcagaattatctccttcctctcctttagtttaccatcatcttgcctcataaatgtatgaaagaaagcaaaatacaagtgcatttaggataaaactctaatttttatccttgaaatggcatgaatactgcagactaatcctaccttcagaacatcgtatgtattaaaaggaatgcctatagaaactagacacacatgtacaaaacaaaataactgaaacatttaaagatgtcctacaccattatactatattaaatactttgtgtcccaaagctacaggtgaaaacaagaataaatatttcactcgcattatccaaacttgaatccctattgttttcaatatccctactgactgtaccacagaggatttaaagagattcataattatgactgtcatattatatctgctaaaacataattatctggtcctgcttcccagtagaagaggccagtgtactctctactgatgtcataccaaggaagcacttatggctacaatcactgatgtcaattaacataagaaaccagtacattcagtactctagtaggttgttgcaaagcagattaagttttcctacaaagagaaactaggcccaaaaccagacaaagtatgttcaacttcttcttataacccactatcattcaatgttagagaaaatctaggcactaagtaaaagcatttcagatcatcactttgtaaacagccagagtagttcttctaatttctgaaacaatcacctgtaattcagcaccaaaaaaacacacaaaggaataaaaggtaaggaaaaaccatatgaacataaggtgcccttgaaaagtactggcatggaaaagacttgaagattatataacaagactaatccatattagagaatcaaaaggagattaaactcccaaagatacgttcagaagaaaaactactatgaactaaattatccttcctttccatattgttcatgcaatatacacacatgcacaactttcccccactttcacctagttgggatgagatgttaatttaggctgaaggactattatttctctttactcctgttatgccagagaggatccaagaggaaaaaagatatacagtaaaataaaaagattaggaatcagagccccaaggaaaataaaagactgtattaaacatcactgcaaatcaatgtctctgaaccgaattttttaaatattttgcaacgtctcagatcaccatacgtagtgcaggagcaggggaagagtcttcaagagtcatgctagccacactgtcattagaggtggcctagagatgctctggggttacctgaaacaagccaaaaagcccagtgtctatatcaatggctttcctacataaaggcaaatctagggtaagatacctcactttgatgtatatgttactatgttttctgttgctacaccatagactgggtaacttataagccatcaaagttcatttagctcagggttctgcaggcttagagtccaagaacacaaaactggtgtctggtaaggaccatcttgctgtgtcataacatggagaagggcatcacatagtgagacagtaagagcctgccagctcaggtctctcttcttaggaagccaccagtcccatcatggggtccacacctgatgaaattatctaaatctaattacctcccaaagactccacctccaaacatataaaatttgggagtcacattcaaatcatagcaatggagcaccaaaatcccacagggtctttccaggaagaactcttgacatgtccctcatcactcctgtctatgtcaaccagcttggacacagatctacacatgcatggatcaatgactagcatttctgaggtggaagccagggcccacagcacactatataaaaataagactaggaggcacacctaaccattccaacgtccatgttcttccccactgtgcagccctcacatctacattctctcctttagctccctcacctcattatatgaccttaacaatcctgctggtaaaggcagtccccaacccacaagcatataatcttccaaagtttgcctggagatttatttaacttaaagctcgttttcctagataaacgctactaacagcatttctctcttaatagcattctgttaagaagctcccaggctggcctccaatctgaaacccatttaaaccacaatgcagctactactagtttgggaaaacactagcccttcacatctgcataaacgccaaacagctgaacaccagttaggactttgtttccatgtgtctaaaagaaacaaaggtgttgcttttcctacttgattctggctagtaccacctcagtctcaaatcagaagaggataaggactggggaagaaaatgaaagtaagtttacccctttctaaaatgtgaagaaaaggaagcggaggtgatgccaccaggcattggggtgaatctcatgagaagatgctcaacatcattagtctttagcgagatgcaaatcaaaaccacaatcagataccacttcatactcgttaggacacctatgatcaaaatgctggtgaggatatggagaaattggaacccccttgcgttgctggtggaaatgtcaagtggtgcagcagctatggaaaacaattctgtggttcctccaagagataaacatagaattgccatatgatcaagcattccactcttatacccccaaaagcagaaaatagagactccaagaaatctgtacatccatgttcacagcagcagtatttacaataaccaaaaagtggacaccatcaaaggtgtcagtggccaccactgacagatgagtggataaacaaaatgtgatctatacatacagtggaatattattcagccataaaaaagaatgaaattctgttacatgctgcaacatggctgaaccctgaaaatattataagtaaaaaaaaaaaaaaaaaaaaaaccagaaaaggacaaatattggatgattccacttacataaagcacctggagtagtcaaatgaatagagacagaaagtcaattcgaggttaccaggggctggggcaggggaacatggggagctattgttaaatgggtacagtttctgtgtgggatgatgaacaagttctgaaaatactggtgatagttacacaactttgtgaatgtactttatgccactgaaccgtacactcaaaaatggttgaaaacgtaaatttcatgttatatatattttaccataattttttttttaaagcaacaccacaaattagaagagtcagagctaatggcttcacctttggatacctcaaccttcccaatctacagaataggagaaaaataccgtaccacctccgggatcctgaaacttcaggctgcatcatgagtatctgagacctcaaatgctaaatcctcaaatgtaaagggtctacacgacagcatgcatcacgccctacacacctgccaggtggaagcttttctaagctagatggtcgcacagaaagcagccatgtgtacatatgaacaagtttcctaagtttgcaagttctttgttaaaatcttcaatgaaattctcactctattaacttaactatcataaaagagacattatatcatagaagagtaaaattatcatagtaaccacagcaagtatgctgacaaagatgttttcgatgtagctgtttagaataaattactaggacaaacatctggacccatggccaccaggcactgggcaaacagagctcaggtacagtctcctggtgaggcagcctggccaacctgggttaccccagtgggggcctaaaaataaaagtgacaagacacacagcccgatactgagtcgcatgactacgcaggcatttcagagtgaagtcaaggtgcttaggttcctactgggccgccaagccattcagcatcagcgccggtcccatctgcaggcaaagaatgacacaactacctcttcatggaatattcccagtcaaagcccacttaataacgaggtccttctgcagggttaaacaaacctcagttagaatgcagcatggtgctgagtggtctttcaaacttgcttgtatttacagtcagccaactgcagattgaacatagtcgggagaaaaaaaaacaacaatacaaaatacactataacataactagtataaatgtatttacatagcacttacattaggtattaaaagtaacctagagatggtttacagtctatggaaggatgtgtttttatatgcaaagactacaatattttatataacgaacttaggcattctcagattttggtattgacggtgggggcgggggtgatcctggtaacaatccctgcagagacctacagacaatacacagaagtctcacatacgaggcccagtgcagtcaggcctgtaatcccagcattttgggatgccaaggtgggcggatcacctgagctcaggagttcaccagcctggccaacgtggtgaaaccccgtctctaccaaaaatacaaaaatgagctgggcattgtggcacatgtctgtagtcccagctacttgggaggctgaggcagcagaatcacttgaactcgggaggtggaggttgtagtgaggtgagactgcaccacggcactccagcctgggtgactgagtgagactctgtctcaaaaaaaaaaaaaaaaaaaaaaaaaaaaatctcagatacaaggcttacataaagaaagcattcaataaatgttgactgtaaattagattttccttgctattaaacattactcataggtgacgatgagtgatatttaatcactattaacaactgttttcctatctaaatacaaatttaaggaaatatatgcgtaatactccctgggctctctcctcttttaagacctaattgtaattgcgctttcggagagcaatttcaacagctgtaagacttgatttcatgatatcttacttaaaatggaaaacctgggtgtgggcttagtccacaacaaccccctttctctgaacacagcccctcctactcactgaggtgggttccactaaatgaactagtgaattagccctcgtgcagacacttaagtctaacagtatgcaattttcccacccccagcatttggatttgaaacaggtggctatggccgggcactgtggctcatgcttgtaaccccagcactttgggaggtcaaggtggttggatcacctgaggtcatgagttcgagaccagcctggccaacgtggcaaaactccatctctactaaaagtacaaaaaaaattagccagacatggtggcgcacaccggtaatcccagctacttggaggctgaggcaagagaatcgcttgaacccaggaggcagaggctgcagtgagttgagatcacaccactgtactccagcttgggtgacagagggagacactgtctcaaaaaaagaaaaagaaaaaaaaaaaaaaagatgtcaggcacagtgtgtccctggaactaaataacataaatccaggcgctgtgcatcagccaccttctccacacacccaaaagcagagaaagcaaatctctacagagacgtggatgggaccaacataccaaggggagcagaaatgaaaaacagtgaaggttagattgcctcactgacttggttcctgagaacctgccagacactaagttcttagaaggactccatatccttatcacacccatccagtttttgtccctatttgcttgaatttttatgactttccattaagagtctcaagaaaactatcgtcagaaatttattataggaaatatttcagcagattttcagtatattttccacatctgtgaagacttagaaatgatgaaaatgttgacaagaaggaattagaaaaccacagtacagtgattcaataaaatgcaactatttataaattatgcagtttacaaaactaggaaaaatatttttgtgttttatgattcctgctatgtaaaatatgtagaaaaagcaacacaggaaaacaaaaacagatgtgggtgggggtatggagctgtgggtcactgatgccattttattatcttgcctgtgttattaaactaggaagaaaaatctaattgccaaaaacttgaaataacccaaatgtccatcacgggtagattatttttttttaattgtggtacattcatctgatgaaataccactccacaacagaaaggtaaaccattgatacacaaaccacacagatgtatctcaaacacatacgctaagcaaaagacgtcacacacaaaagtctccatactctataactccatttatataatattctggaaaggcaaatctaagggaacaggattggtgtttgtctaagaatgggcaaagactgaaaggggcacaaggaaactttgaaataatgaaaatctattttgctgagtgtggttggtggttgcacagctacaggtgtttgtcaaaattcattgtactatacacccgaaaagtgcaaattctgctatatgtaaattatacctcaataaaccagacttaaagaggagggcaggtgtggtggctcacgcctgtaatcccagcactttggagggaggaggcaggcggatcccttgagcccaggagttctagagctgcacggtgaaaccctgtctctaccaaaaaatccaaaaattagccaggtgtggtggtgggtgcctgtagtcccagctacttgggaggctgaagtgggaggatcgtttgggccctggagggggaggttgcagtgagctgagatagcaccactgcattccagcctgggtggccgagtaagactctatctccaaaaatatataaaaataaaaataaagaagacactgagctcagacaccaaaccaaagctactgaggcacctgtaaggtgtctgttttataatattggatgacattcatcattcatcaaatgtactgagtgcccatctaatgccaaatgctctgctatgagctagtacagagtgaacaaaatagacaaaaaaatagacacaactatacaaacaaactacaggtcacataggaaagcatggatgctctgattgctattacgggattaggggtcaaggaaggcctctctgaacaagtcacacaagcttagaccccaggaataagtagtaggtaaggaggcagagactggaaaggtttctaaatgtgtcattacagcagtagttaacagcaactcaactgtttcaacatgtgacgggtggttacagtttactattttgctgtgataaggattatggcctcctacataagaagccctagtaaatgaaggttttaaaacagcctaaagacagtgaccaggagacgtaatgatgtgttttggatttcagggaccatcaaggagtacgttcctccaatccttgtcaatatttcaaaaatgatcaacacatgtatgtatttccctgaaatgaggttgcctatgggtaaactaaaacccatgttctggtgtttaaaagatttgttgtatttgttcttacttctggctgaatttgccattatttatttaacaaggtttcctgaagcttatcaacgtttctaaatgataatgacactcactcactctctctctcaccaaaaattggaaaaaatggtcccagtttgacaaatcgaaacctcttcacaatacgggaatcaaccttaaagaaggcccccttcacttggcttcagaggccctactctatcttggttttcctcctaaactcacagacttctctttggcaaatgcctctaagagattcttctttgatcaacatccaagtgttggagggggggcgggggcagccccttattccttctcttccttcactcactcttgtttcaaatacactccgataacaattcccacatactcatctctagcactgatctttccccaaagctccaggtttgaattctcaactgtcaatgtgacatctccacttacatgtttaacaggaatctctgacatgggttggatgtgtgtcccctccaaatctcatgttgaaatgtgatccccagtggttgaggtggggcctggtgggagatgactgggttatgggggtggatccctcatgaatggcttggggctgtccacaagagggagtcagttcttgcaacatctggttgttgaaactgtgtggcagcggactctgggcacacttcctatggctttgccctgctccacaagggacagccaaaaaaaaaagtgtggtacctcccccgtccccttgctcttgctctcaccatgtgacatgacagattcctgctgccttctgccatgattggaagctgcctgcggcctcatcagaagcacatgccagcaacatgcttcctgcacaaccatgagccaattaaacctcttttctttatacattacccagcctcgggtatttcaatctagcaatgcaagaacagtctgatacaatctcaagcttcaagtctaaaagggaactctgggcttccagacccctgcccatttccttcttgtcctagtgttcctggttttcaacaaaagacaccatgaatatacctcaagccaaaaacctaggagtcagcaataatctgcctctttccctctctccccagtagcaactccgacaggcactgccttcaaaatacatttcaaaagcaagcattcctcaccttcactattatcccaggtccaagccaccactgtctctctctgggactactaactggtcaaatcatgagcctctgcctccttacaatatattctcaaaacagcaaccagagtcatccttctgaattgtactcagttcctgccattcctcagtccaagccttctaatggcctcctatcacatctaatacaaaaaagggacccagtgacctaagacaataattagcaacagactaacctttatgcaaaaggtgacgtgaggcatcatcgaaggtaagggagtgctcactgccatgacaaatcagatgacacagcttacacttcatagtcaatcctgaggggctgtggaagaatctaggaaactcaatgacatttcacccctaaatcaacaggtgtgcaaacagaattatcctcttatctaatcagatctccataagtaccctgaaggcttcaaggaataagagtgtgcctgtttttgaccacggattatttacttgcacaacttctcaagtgatctgtttccacctaaaatggaacaaaggagtctctaaaagaaatactacgtttcaaatatctcatagccaatcagcaaacaactaccattctgaaaagattttgtctgaatttccaatcaaagtttcttccagcccatatgacttcaacatacaatttgtaccacattgtaaccaaagagttattagtaagaatgttaaataatcctcccctaaatttcaacttaaaatgtgtagtctttgtttaaatggcctgttgtctgcaagttttgaaacaaggcttcactttgtgttcaaaggcagtataaggaaacaagacatgttactgtttcgattcctctgaatgacagtgattaatattaaacacaagagtttcttacaaattagaattatccagaaacatatcccagtaagcctagcctcataaaatgactaacttcaatatttactttcatttctaaaattttttaaatcaaccactaagactttaacctccccctacacacgccaagaagaaatgctggctctcccctgcactggccacacctgtctttagacagcacccctttcctgctcgacggcctcctgcccccatcatgtgatcaacctctggcatcaggaaggcagtggtggctctgtgccatgaggtccctctttgtaggctgtggctatttttgggctggcagcccctctgattcctgacttggccctagataatcatgaggccgcctttagagagaaacccttcagaagccaggcaggtccctgtgggattagcaacactccactgctaacacagcaagtctcaggtcctaagtgctataaaggccctccaaggacagcgccctctaacctgatggccctcggttggccagacccaaggctgggctcccatttcaaatgggcaagtccgtggttttatggggctaacaaatcaaagctgacacagatatactactcatacatggattttagccaggaaatttcaaacaactcaatgatgggatttttttccccccttaaatgtcatgtccattcataacagtgagatttcagatgtgtgtaacagctttgggaaaaggtattgataaaaatattcaaagaaaatgttagtcacttttcaaaaaaagcacagcataccaagatgatgtagtaagttaaatattcccttgtgctatttatagacataaccatatactgtatcatttctaattggaaaaggtctaccagagatactatacacctgatcctaaaactatacattatcttctgctacgcctctaggaaacaagactataataacttgaattttaagaactacaaattcaagataaatatttgattggtttttccatctcactattaaaatgaagcataagaccctcaaattaggtttaaatgttttaacagtgaagttttatgggagagtacatccaaaaatacagagaaaatacatttatgtatttcatatcacacctttcctccaaggccatcatgacatcaaaactgatcccttttctttatccctaacttggattttgtaaagaattgtaacatcttttctgaaaccacaagtctacagtgtaaaaaatgtttcattcccaggtttctactggcaacattaaatgaagaccttatgaaacctggccgggcatggtagctcacacctataatcccagcactttgggagacagaggtgggtggatcacctgaagtcaggagttcgggaccagcctggccaacatggtgaaaccccacctttactaaaaatacaaaaattagccgggtgtggtagtgggcgcctgtaatcccagctactcaggaggctgaggcaggagaatcgcttaaacctgggaggcggagtttgcagtgagccaagatcgtgccattgcactccaacctgggcgaagagagtgaaattctgtctcaaaacaaacaaacaaacacacacacgcccttaagaacgcaatgaggataacatgttggcccttgtatttgagaaggcaacctggcttgactctgagctacagctccaagaaataaagacgatttgctcactggtcctagctctgacaataagcacctgcccagtgaagtctctggctgtgaaggtgagtgaggtgttctctccattccatccattctggagttggaattttccaaacactgctaaaggtgggggtgtgccaggaaaacaaaggaacacaacatggaccagccaagttccctctcttgccctcataagcagaacaaagtctcagcactccaggactggccgctatttgcctttcttagatgggagtgtaggaagagggagcataccaggccttagaatctgtcctcactagacatggaggaggagatgatgtaattttttttttaaataaaaagatatgcaatgcgcatgctgttgtgctatgagaagaatgtggaaattcacaagttgggcattgtttagctttgtatccctgtggctactgtgttcaactcagcctgaggctccatgaagacggtccttgagtctgacttccaagggcctgacagcctattggtgacagcctttacaatcactggtatctgaagctcaagcaagacagacaccaactaagtacccccagcagtaatttctcaaaaaacaattcagtaacatgcagactccatccttaacggcaatctgaggctctgctgtggtcaacaaataccactgacagtggcccggaccaccactccaattcccaaagacctatgggccccgatgacatgaaggtcactcagagcttaaaggcagagatgaatgcaatgaagatttccactgaaagatggcagagaaatgttctacccacactcacccaattgagatttgtggaattcaacagcccccaaacgttttaaaagcaaataattcagtatccattcatgcctttctccaaatgatttcaactcttcataaagtaatcataagttaaataaaataacatctctccttttgatactaacttcctatagcttagccgttataggcaaaatggcagtgtggtttaactgaatccacatttacagttgagaatactcctactccctgctgttacatcagtgtaagatgttttagttggcaatctaaaccctgctaattttcttacaactgtttttttttttttttttgagatggaatttcactcttgttgcccaggctagagtgcaatgtcgccatctcggctcactgcaacctccacctcccacattgaagtgattctccagcctcagcctctcaggtagctgggattacaggtgcgcaccaccatgcccggctaattctgtatttttagtggagatgaagtatcaccatattggccaggctggttttgaactcctaatctcaggtgatctgcctgcctcggcctcccaaagtattgggattacaggcatgagccaccatattaagagactttcaagaatgaaatgatccctgtgtaatttttacgattgagttccaactggctacaaagagaggaatgtatacaatagcatgcagaacagtctccgagaagttccgtggctacagaatgggggcatttctcacaccactctgtcagcttccttatccctgttacagagtgacctttttataacaagaagaactttttttttttttgacacagaggcttgctctatcacccaggctggagtacagtggtgcaatcttggctcactgcaacctccgcctcccggcttcaagtgattctcgggcctcagctgcctgagtagctgggattataagtgtgcaccaccatgtccggctaatttttgtattttttgtagaaacggggtttcaccatgttggccaggctggtcttgaactcctggcctcaagtgatccacctgcctcggcctcccaaagtgctgggattacaggtgtgatccactgcgccccacctataacaagaacttttattcatgcaacaaacattcctaggtcctctatcacatgcagcttctttgctaggtgatggggacacaatgctgaacaagatggtcccagccttcaaagagcctccaaagagcctccagttcagccaggaagacaaaaatgtacaagtaaataattacaaaaactgcaaaggtagaagcgactggaggctaaagggacccagagaataggctccactgttacagatatggagaaaacagtgaaatgtcacttccagaagaagataaagcttgagctgagactaaggcataggcaggtgagtgcttctcagcctttcagattttatggacctgtgacatccacactccaaaactctgcagagacagcatggggatgtcagctttaattttgccaagaggggcacttcagacaaaatttgtacgactgccaacacatcataaaaggacattattttaatacaaaaagtgaaaggggtacaaaactgcagcataaagaacattcctttagtttacgtaatatacatttagccttatgaaaatcttggtacactgtatttttattccatctcaccgtgttcaagtcaacattctgtcaccaggtaccccagggtcacagatgcacatttggaacctctgatctagatgacaaaggcagatctggagggcagtttctcacctctgcaaagatcaaagcaacagaccaggagagaaagaaatacaccaagggaagtactgagagggccgatggatcagcaaaggcctaaggccaggtaccatgggtcatgcctgtaatcacggcactttgggaggccaaaacaagagaatctattgaacccagttcaagaccagcccgggcgacacagtgagactctgtccctaaaaaatttaaaaattagccagccatggtggcacatgcccatagtcccagctactcaggaggctgacaccagaggatcacttcagcccagaagttagaggctgccgtgagccaagactgtgccaaagcactccagcctgggtgacagagcgagaccccatctctggaaaaaacaaacaaaaaaaagcagcttagaacacgtcaaggaaggtcagtgtattctgacccttcttgcaatggaagccacatcaccaacacacgcacgagcctaggacagaggcacccaaagaccaagcccgatgagttacttccgtagagaccagagaggtctggaaggcagtgcctggcagcagacagtcctcacccgctgccatgatgctaaaacctcctccaggacccaggcaccatctcagataaaagctcttcaaggacccaggcaccatctcagaagtgggtgagccgctgaggaaggaggaaatccatccttcagaggagagaagagcctcagataggaagcgtgaactgaccacacttaaaatcctcaaggagatatttatctgcaagcgactctttgaaaccaaaaaacactgagttatcttgaggttgccacattatatgttctctacaagtgaggtgaaatgaggatgtgtgaggcagttgggttataaagaaataaagttccatttggggtcacaatgtgaatgtgtaagtgtcccacctgcttccgtagttgagagactggctggggctggaagaaatggatccacccgagcggtatgaaggagctgggtttcatatgtgatattaagagttaaggtgctacgttaacaaccaacatttaacactgcaggggtagcgctttatcacaagagactttcgctcaggccacagtacatcagttcttcggatcccttatgaactcttccacctcaaaccagcatatactgttttgtatcacagctatacatttcagaaagaaaataaaagttgaatttttaaaaaagactctttcctagtacacttgacaagcattgtggagtgaggctgacctcattgctgaaaagcgatcggaagcttcaggacatcataagggctggtgagagaaagcgctgtgtaaacacagtgtttggcaaatccaaggactgccaaggaggggccaccgctccctgacaccctgtcaattccactgctccacgccaggccagcacagtttgtgaggccaggatgaggaacaggccacagcctccagcatgggtaaagataacgacatcagtgcacagctcttcaaagtccacagtgttcccacagtcatcctcccagtagacagtcccatgtgacagacaggtcacatgacagtcacattcccccatccctcctcctctgagatgctaaacctgatgtttccagaagttgagtaccttgctcaaaacacagagttaataaatagcagcaatggacattaaactctactccaatgtgtaatcttgatctatttccaccttccttctcacaataacgaaatcacctaaacacctggtaggtctgcacagctatggaccttatagccacctgatatgagaagcatacgtttatcaaggagctcctaaactgactcaggaactgggttacctgttacaagccaaaaatattcttcgcctcattttcctcatggacaaaaactgattcaacaatccatctcatagggtcgttttagagttaaataaaatttttggaaactttctaatacacaattgtacattgctactgttatgccaacaaccttgtaaaacaagccttattatcatcctcacttttctgatgaccaaagctcaatagtttattcatccagtcacgaagactttctggctgggcacagtggctcacactgtaatcccagcacttcgggaggccgaggcaggcggatcacctgagtaaggagttcaagaccagcctggccaacatggtgaaaccccacctgcactaaaaatacaaaaaattagctgggcgtggtggtgggtgcctgtaatcccagctactccggaggctgaagtaggagaatggctggaacccaggaggcagaggttgcagtgagccgagatcgtgcccttgcactccagcctgggcaacaagagcaaaactccatctcaaaaaaaaaaagacattctaaggtgatggacacattctgtatcttgattggtgtgatcgttacaccaatatgtatttgtcaaaactcatataattgcacacttaagccaggtgcactgcatttcatcacacttaatgttatctcaaaaattgtttcaaagatcatgtggtagtgaacagcagtgtgtattctgagacatattcatgaattcttattggaatctacagattttttccgcattctttttctgtaatctgcttgccaactaatccttcctacccaacagaaacccttaaatgttgacgatagctactagttaccgtttctgtctctttactcagaatttcatgttttactgttacatcctgaacatattcatctagaaccttccactgaagtaggtctctgtccacaacccagtagggtacgacagccacagactaaaccaccaccttgaaaagcaggctaggaaggatcatgtgccagctgcctgcagtcctaactcagccgacttctgagaatctcaactatatttctcaatctaagtcaacattccttcaacagtttattgaacaaaaataaaaagcacaattctaaatactcctcccagaggaaggaacaaaataaagcccttgctctcttagatatcacatcatattgtagatgattttcaaaattccatcagaaagtaacctttgtcatgaaaatcagtaaaaaagaacaagaggcaaaacagtaagtttcaggatagtactgggtccaaagtatttacttttatacaatgagctgtttgtatagaagtaaataattaaaagcaccatctacccccagggcttatcaaaggcactctcaaagactgtacagttatgctaaagaaatgatttgatgtacagactgtgcatgcttttagttgtctttttttttttttgagacggagtttcactcttattgcccaggctggaatgcaatggcacgatctcagctcaccacaacctccgcctcccaggttcaagcgattctcctgcctcagcctgaccagtagctaggattacaggaatgagccacctcacctggctacttttgtaattttagtagatacagggtttctccatttggtcaggctggtctccaactcccaatctcaggtgatctgcccgccttggcctcccaaagtgctgggattacaggtgtcagccactgcccccggccacttttagtttttaaattatatgcagttagtttttaaaaactacctaaaaggtagctcagactgtttgagggacgtgggggtagatcgcgtgggcagggcagagtttacagctgaaatataaaatctttaccccaaagtgttaaatgaccatgaacatttccttgtttagaaacttcagagttgtcctctctctccaaagtccacttggtgaaaaggaaataattttccatttgaatcacgccaacaccaaatggaaaatgtctttatgtgtgtgtagttacgcaagttggcacctcaccttatacctcccaacctttattaaacatcgacttcctgcacccttttcttgaaaatgattacctatgttaggctttctgctagcaagagttctttaacagaaggtgactgtatatacacatttaactcacagcagcagcccaacgatagccaacctccaaccagggcctatttatacagtcctaaccctatatattccttagaagacaatttggaaatagagaactgatgacttttagggctaaaaatcatgactgatattcagctgaaactgtggttttgtgagggcattcgtctcttcccagttctgacactggcctcacctcctacttcagtttccatctgggattacctccatttcctccactaattacctgccgctcagtagcttacaataaggaaacagaattcaagatttctacttttaaaaaaagtttcaactgggcacggtggctcacacctgtaatcccagcactttgggaggttgaggcaggtggatcacaagatcaggaaatcaagaccatcctggctaacatggtgaagccccacctctaataaaaatacaaaaaattagccagacatgatggcacacacctgtagtcccagctactcgggaggctgaggtaggagaactgcttgaacccgggaggcagaggttgccatgagccgagatgaagccattgcactccagcctgggtgacagagcaagattccctttcaaaaaaaaaaaaaaagtttcaggaaaaaaaatagtagttgctatccagcatataagaccacagactgctaatctatgaagtgagatacaaaaaatctaattattcaaatgattgtttctatacagttctattaggacttattgcaaaaagcagtctgaaagctataaagtcctatgtaagtggaattcatgattgtaatgatctctaactgtcaatttttcacttgtgctactaatctgaatggcttacaacatttaacattcggctttacgttctgtgattagaaaatgtgaaaataaaccgtaattctcagctatgtcatttgaaattttacatatcataactactgcatgacttggcctggcacagtggcttactcctataatcccagcacttcgggaggccaaggcaggtggatcacttgaggtcaagagttcgagaccagcgtggcctacatggtgaaactccatctctatcaaaaatacaaaaattagccgggcatgatggcaggcacctgtaatcccagctacccaggaagctgaggcaggagaatcgcttgaatccgggaggtggaggttgcagtcagccggatcgtaccactgcactccaacctgggtgacaaagcaaactatcggtgggggcggggagaagttttatcccatttcagcaccaatgtatagaaaatcctggcaacagaaacttattacttccactcgcattaaaactagtcaaataacagcatcatactgggtgtgggaaatggaccggtacaagtccagtcccagttccataacttactcgccataagacaaaacatttatccaaatagttctggtccccagtctccttcagtataaaagaaagcactcatgacctgctctgcccaaccgcagggctgatgtgatcagttcttaatatcatatttacaatgtgcttgccacaaacatagggaattaatatttcactatgcttaaaagatgaaaatacaaaattgcttttatatttaaatactgtatattaatagtaacattttacaattgaaactctaaaatacaaatattctggactatgttacaggtgaaaaatcagaacagggaaccttagtactgtaatatccacaagtccaagattagttcaaagtgatgactcaattgtctttcgaatgtgctgactgatagcaaagaggcaacataatttacagactttaccaaagataaaagtatctacattgattttttgaaaacacagttcaaatggagtatcagcagctcactagacttaaactttcaagaaaaacaagaggtgacaaagctggagtctgagaataaacaatctccaatgtttgctacaaatcaattcctcctaaggaagagggaaagttatcagcctcctgagcctagaatttaactcccaaccgacagcaccagcagatccaagcaacacctccaaggctaagcagcagaaattaaatgaaacacctatctatgaatcagaagatttaatttaaaactagagactaaggaaggttattagcacccattgatcattttctatatacctggcacctgtgtcagaataaccccaggagacaaggtactacccccaccttccagcgtcctgatgagccaactggggagcaaaggtaatgaaatttcactcaaggtcacatggctaataggaaaatctcagacatgaacccaattttgcctgttaagtctgtgcactctctatgacattactgcaccaaatgtcctggatacccattacatttttccaattctataataaagtatgtccccagggtttcataatggatgtcatggtgggcaaaatctagctaaatggtgaaatacctctatttattatttgaaattcaataaaaacaggaggaaggagagaagaaaagcagtccctagcactgaaggatggagggctaatcattcaagatcaaaacaactcacaccatataaggagaaaatagttttcatttgattatatatctacaaggttatacatttttaaatgttcagcctaataagctgtaaccagaactttccaacaaaatagtcttatctgcaatataaaatggtttaggttttctcatagaaacagaaatgtaggatttttcttacctcccttttcattaactgaccctactcttttaaattcaaattaagagtaagtaaatccctttgcagaggtgccatcaaaaacactataaagcaacatcagaaggctgggcatggtggcttacgcctgtaatcccagcactttggaaggacaaggtggacagatcgcctgaggccaggagattgccaccagcctggccaacatggggaaattctgtctctaccaaaaatacaaaaattatccaggcgcggtggcgcatacctgtagtgccaggtactcagaaggctatggcatgagaatcacttaaacctgggaggcggaggttgcagtgagccgagatcacaccactgtcctccagcctgtgacacagcaagactctgtctcaaaaaaaatctgaaagcaaaacaattttttaacccttaaacagaaaatacttcttcacagcattaaatcaagttcaataaccagcaagtctagagaactattgaaaagttttacataaatgcaaaactactctgaaacacaaatcttattagatgtaatgagaaaaaagaatcctagactgcaaagttatctgaattcctaagttgtacatacatttttctctaaacagaaaacagcccaagtccctagtcaaaagaaattgtcaacttgcgattgtctgcacgaatagggaatgtcataaatcatgagtggaatcaattacgtacatgtatttgcacatgggtatgccagatgttctcaaactgactcttcataataaaacagtaactcagaagcatcaggaaacttggcaccttccagctctgatgctctgctcccaaagccatggccgttcagtcggacacaagactgagggtaaactaccttccctctgcttgctgagtatgaaacaatggatgagggggtgagggcaagaggagagggcaaggagcaaggcacagaaaagcaataaggaaattaatacctgtggtttaaaagaccttccagtagctgtgactatctgacaaaagaatttcaaattcccatgccatcagagctctagatgatttattccagaccacatctgggagaaataattataaaagtaaaaatgtacccagcatccgaacatttagaccctatccttaaggagcttacaagatgtagcaaaaatatactggaaaaggtaactaaagattctcattgagagaaattaagagacgccaaagagtacagtgctaagtattttccttcttaatccttttggtgagaaggaaaagggtaagcatgattaatgacaaggatgctttatataaccaagaatgtcaatacaacctacgtgaccaaactttggtcaagtcagcaggtggaatttttaatgcaaagcccaacgttaacaacctgggagaatatttcgaacaacacaaacacttactaacatctccaaaactgcacttttcacaatgattggggtttctctgactcctccaagaaaagaggtcaaattcttttttttctcttctacctcagtgtttggcccatagaaagtgctcaaaaatggctgaggctgaggaaaaccaaacacaggccgggcacagtggctcacgtctgtagtcccagcactttgggaggccaaggccggtggatcacctgaggtcaggagttcgagaccagcctgatcaacatggtgaaaccctgtctctactaaaaataaaaaatgaagacgggcgtggtggtgcatgcctgtaatcccagctactcagaaagctgaggcaggagaatcgcttgaacccaggaggcggacactgcagtgagccaagatcacgccactgcactccagcctgggcaacaagagcaaaactctgtctcaaaaaaaaagataaaagaaaaaaaaatcaaacataatattctaacagcaaggatttttactcatgctttttatttatcattttacatgaaatataagcctaactatacactacgtataaatgacttggttctgtatgtggggcctagattggggatctaatacaacacgtgaatttttcttggtagctaggtcttggcatggctcagcccttttaaatccatttctcattctccaatatccttctaccctatcctgacccaccagcaaggaggacttctgcaatcctcacttcaattaaagcctgttggcttagggtcacagtaataagcaaatatggttcaattctgtaatttgattaacaacgaaatgattaacagtatagcagtttacagtataataaaaaataagattttaacagtgcaaggtgacttaatcagaattctgggaaatatgactcaaccaccttgacacagaggtcaggggaagggggtaggtctatgtttcaatgtcatctcagaaactgctcatatctatgctggcttctattttcattccgtaaagctagccaagggagctatgttttacgaggacatgcagtttcaacttcgtatcattcatagctaacaatcatgcaaaaatctacaaaataaacattaaggaaaataaatttcttatttgtcactgaacactgctgaatacctcctatgaactgcttatctgaaataaggtgaagaaatattgattcttttcatccagattggtatatgtgtaaataacacctgagttaaatattaccatgtttccaatgtacaaaaagcataaaagataagctaactacccaacagtcaagacttaatgaacactgtcacaaacattatttacacaagaatgtatgttacgcctcttcttcctagtctcctgataagtatgagtctttcccaagattcccttttcaatgtcattttaggacacaaaatgtccttaaatgttttagttaacagtagaagatcagaataattatatttgattagtcctcaaatttaaatactaattttcttttcttctgcatcatgcttaagacacaatttacttataaggtacacatttatgcatttaaaagaataaggtcatttaatggtttaaaaacctcttccaatacatcttacctgaaagactgatccattcctagtctgttcttccctttagatgagttcacactgtgtcctagcaataaagcttctaggttagaatgagggtaaaatgtgtgtttttcttacttttatttatgtagctaatgtgtatacaagaatattccttttattcctttttagacagagtcttactctgtcacccaggctagagggcagtgatgcgatctcggctcactgcaacctccgcctcccgggttcaagtgattctcctgcctcagcctcccacgtagcggggatataagcacccaccaccacaccagctacttttgtatttttagtagagtcgggtttcaccatgttagccaagctggtctcaaactcctgacctcaggtgatccacctgccttggcctcccaaattgctgggattacaggtgtgagccactgagccaggcccaagaacattctttttttctgtttttcttttggagacaaagtctcactctgttggccaggctggagggcagtggagcgatctcagctcactgcaacctccgcctcctggattcaaggaattctcctgcctcagcctcctgagtagctgggattacaggcgcccaccaccacacccagctaattttttgtatttttagtagagatggggtttcactatgttggccagggtagtctagaactcctgacctgaagtgatccgcttggcttggcctcccaaagtgctgggattacaatgagccaccacgcccagccccaagaacattcttactttagatatgggcctgctagcaagatttaaatgcagtttatctttgaataaatacatttttattactttacaatatacagcttgaagtctaaactttaatgaacaaagttattttgtaatcaagatttatatgcaaatacgtacttctaaagtacctgaaagctatttacttaagtgaagcacttccaagttcgaccttgttcacactctaaacttgttgagaaaacccaccctttcttccttgattgtgtaacatttatatatcagagcaatcacaagttgccaatctgcttctagggtatgaaaaggaagttttatcttatgtatccacatggcaaagagcccccaaatctgtcacctccaaaatggaagtctcttttaccatttctaaggccaagtgagcaagaaaaagtcatgattaatgtcatcatggaaaattgccccatatccaagagtaaattcaaagattactgagggatttttctctaagaaaataaataaataaccatcatcagggcaatcatctacaaaacttggtttagaaataaatttttaggccggacttttaggccagacacagcggctcacgcttgtaatcccagcatttgggaggctgacgtaggcaatcacttgaggtcaggaattcgagaccaagttggccaacatggtgaaaccctgtctccactaaaaatacaaaaattagccaggcatggtggcgcacacctgtaatcccagctactcaggaggctgaggcaggagaatcacttgaacctgagaggtgggggttgcagtgagctgagatcgcacgcaccactgcactccaacctgggccacagagtgagactccatctcaaaataaatttttaggctgagggcggtggctcatgcctctaatcctagcactctgggaggctgaagtgggaggatttgcttgagcccagcagttcaaatccagcctgggcaacatggcaaaaccttgtctctacaaaaaatacaaaaattagccaggcatggcggcacatgactgtagtcccagatactcaggaggctgaggcgggaggatagcttgagcctgggacgtgaaggctgcagtaagctatgatcatgctactgtattccagcctgggtgacacagcaatatcccgtctcaaaaaataaaataaaataaaataaaataaaaagttagaagaaattacaagtcaaattcaactcctggttatactggaccatccaaaaccaggtataaagtctccctggtcaaagtaggcttttcggggccagatttcaagctagctgagttcataccatcccatctagtccttcatttcctgtgggtgggatcgctcatcctccttctcaggaggccacagtcaccactgtatccgctgctaagtggtcacctccctccggggcctgccttcttccagagaaagtctgaggccatttttaagtgcccctaagcacgcagatcctgaactccaatttcatccttatggctcaaatatggtcctatcgcttactcttacgctctaagcttggggaataaaagggactcaggctctcatggagaacacacttcctttagtgaggactttcagggtatattcaagctttcacaacacagagaaagaacccaactttgagatatcaggaagacgtgttcccccgcccccccaaataaatactttgctgagtagcagtattggaaattaatccaggaaattttttaactacgtatgcagtacatttgtctggacatcaacaagtccgtatgaaaccacaataatgactataaaaagaagaatctggcaaaatgatactacaaatagattactgacaataaatggagtgtgagcctactttgtataatcacagaataacagatctgaaaaacattcagtcttagggatttaaaactttctgctctgatttcaaaggatgttgttcctaatagtatataccaggcccagtggcttctcatcaacaaatgcaattagttttgcaacagtctctaacccaagatatggaagttcttgcaatgaatttgaaaagattctaatttagaatttggggaattttttttttttaagatggagttttgccctgttgcccaggctggagtgcactggagtgatctcggctcactgcaacctccacctcccgggttcaagcgcttctcctgcctcagcgtcccaagtagctgagattacagatccatgccaacacaattgactaattttttgtatctttagtagagacggggtttcaccatgttgcccaggctggtctcgaacccctgacctcctgatccgcccgccttggcttcccaaagtgctgggattagaggcgtgagccaccgcacccggctggaaaattttttttaaatcttctaccacagtcacatatagttctgaagctacgatttagaagtgttaaaaattctgttttgagaaagtcaacagatttatcaacattaaagaaatttgtgtatgtcaaaactactgtaaatatataaagcaaagataaaatgggaaaagtatctgcaatatgaatggcaaagatttactatcaatccataaaaggctcttatgaattaatggaaaaatactaatatcccaggagaaaaatctggcactacatcaaatttcaaaatggaaaacaactagatttctttggtgttcaaatcatctgtaatcaaagaaattgaagtttaaatatagagaaagcactgttcacctataaacctgggaagaattttttttttttccctttaaggatgattctacatgttgacaagaatacggtaacaccagtattctcacagagagctggtgggaacataatttggttaaacattttttggaaagcaaatggtcaatatgtatgaggagatcttccaaccatcaactgtatttcaagggcactaaggatattaaccctgcacataaagttttaaaaacgtatttgttgcaaaagtatatttagtaagtggaaataaatgaaaaccagtttgatacatctatgtaatgtaatattaagtagccactaagatttctgaagatttcatgacatggaaaatttttcatgatacattaatcaggaaaaaacctccacgcaatagtatatttagataaactatataactataaaaaatttttctatatattaacaagtattttcttaaatattaactgtgattatctttgctgaaattgcttaactcacttttctcaatctacctatttttatacagcaagcacggattacttttgaaatcaaaacaaacagggttaacagaacagggctattaagtaacaggctttttaaatgcttgagtgtaataactgcaggttagtttccaaaaaatataagatattatctagaatcttataatcctattatactccaaaatgtaaccttgacttattgacataattaaaaggtcttgttccaagcatgattttctaccaagcagatttaccaagaattattttctcttcataaacctgattttaaaaagaacaggtgaaaaaacgtggtgcaagttacataaataactacatattattttaaactaaattccacttctaaggttttttagctttggttttaaggataagcatgtagttctaatcttttctttgtatagctttcctaatggaatatattgcctatgaaaaaaaaaaaatctgtaacagcactttctacactgtaaagcactgtactaacaggacatcaccattttaagttgtgtatcatttcctgccctaaccatccctgaaaaagcaaactgtctacagaattgcaattccgtttatgcaattccttttaaagttgtccatgcactgttatcttgtatataccctccttaaagaggtcactggttcccaggaagcaatgactctcttttttaatcccctccctcctgcattgcctcccttcctcctgaaattcactggtaacacccctactcccaccctccagccccagcgctgtgatttagtgatgattgactttcgatcacctgcacctggcaaaacttgaaagcttccacgcaccgttttgcctaagactttggtttcattgaaacaaacaaaacacactggatttcctttcttagaacactgactacttcaaacaaacagtatttaacagagtatgtgtaactacgcaggctaaatgaattaacctcttccttcctagtcccaaattactccaagtcaaaaatcaacaaacaacttggtagaaaggagtacgtcttcaaaaaagaacaaaaacgttcctcagtgaacacctaagtccactaagcactatagagtagtcaataaggtcaccttaattaagatgagatttttctagagcgtgaaaaagtgcaaacaagctgcagaaagtagcgaggcgccacgaggggtctttgggacctgcagcaaccctattccacccgctttctcggccccgcttgcttctgctgagaaggggccctgcgagaaggctgggaccgccgggcccgggtgggcggcgtaaggagtccacagtcaagcccctcggtcactttcaaggtgacagcgacgagatccgcatccgtcccttccgcaggctctgcgctggcccacgtgagacccgcctccgctccgccggcgctgccgccccctttagccctcagcttcggcccccaggcccctggaacgccccctcccctccccgaggaccggtcccgtcaccctgggcggcgcgctcgcctgtcccctccccaccccggccgccgggcagcgggaacagattccagcgcgcacttacccgcagctccttcaagcgctccgggagcaaagacgcagaggcggggagggctggcgccctttgcaccactggcggggtcgccgagaacccgccccggaggtctcgggggcggcgtctgcacctgggggcgcgcggcgcggcaccaccccacgcctgcggcggctaccaggcgggacccggagccccggcctccccgcctccccgcctccggggccgccagggggtggagcagggcggggagttcgggaaacttgtaaatagccgaactcgggcctcccgccccaacccggggcggctccttccgaaggctccactccagcggctcgctgcgggagaccaaggccagccgccgtcccaggggacggccctcggggaacctgaatgacgtgcgaggccgtacctcggggcgctggactccgctcgggcgctcccgctctccgctcccgctctcgggtcccaatcccgacgctccgcgcgctcccggactaagtgcggacgcgccccacgccccccggcgccagcccgggacagcgctgcacctgttgccacgtgcgacgcggcgctcagcggctgccactgccgccggcgcacctggctgcaccgcgcgtcccgggaccacgctcgtccccgcaggagcccggggctccgccgcacccagcgctagggcccaggccgggccgcggtaggtgggggatctgactcctgcttgcctctggccacctgcaggccgaggggcctcgcaccgcggggcgtatagaaggtgggaaggttgcagaattatcagggcggaagcttgcaaggaaggagtcgtgattgtctcttagaagggctgattcgcagtctgtattatcttcatgcttctagcaagtttactagcaagtgtgtattaaaggttaaagaaagtagctttccagctattagagcttgagatacaacgtggaaaggagtctagaaccccagggagataaactaggctcgacctacttttctctaaacacaaacacagtccttgctgtttgctaaactgagcaaatttcatcgacagctgtcttctaggtccgtaaaatattttcttctataaagcatatttttaatagaaaacttgtccgaagatgctattctgcctgtgagagatgtcacattgctgaaccgtgaaatgtcagacaacctgagaacaaaattttaatatttcctttttaattacctggattgtggtttgctaaaagcttttaaagagaagtgaacttttttggagaatagacgtaaggactctgtatttcacagttttctataccatgaatattagaataactgacagatgtcttgccattgatagttgtaaagacttttcatatgtacaatgatccattatttcctgactacaaaacccaggggtatataggtcagattatctccattattcaaatgaggaattgaagctcagaaaggtcaagtgactagcgcaaggtcacacagccagtgagggcaagtgcaaacccagccagcctaactcctaatcttctcttttaattccattacataatgacacctctcatttgcttcagaaatccctgttgtaaagatagatgcaactagcatgatccgtgttgttaggaaaggcatgtgattaattttaaatagatatagtatttaacaccaccagatgagtctccctctgaaaaagcacacaaaaacaaaacaaaacgctgacatagtttccgcaagtcacgaggcaattatgctaattagcaacaagcctccatccctaagcagaatagttcttgtgtgaaacatatcatttaatctttataaccctgatgtgacctagatgatttggtctaaaccccacaatcctattgtgtggcttagttatatctataaatatagaacctgttttacttcatttttgtgtcaggtggtttgaaggggggaaacatacaatgctctgctaagtaattagagctacttacgcaggcattggggaatctgaaacttagcttctaattgtctccacataaaaacagaagttaacttctagggacatcttcagggactcctcaaggcaaatattcatgaaatggggcctattggcttttcttttcatcttggttctgggcatgttgccatgttcctgatctctgaactctgatgctgacctgctacagactccaggagcaatattaaggataaaataataactcacataactttgtggctctttattctaaaaaaaaaaaaaaaagttggctcaattttttttcctccataagaaaatgcaaattgcaactgtattgagaaaccattttttcacttatcagattgtcaaagattagaaagtttgataatcacagtgttggtaaaagtgtagactagcagtcacaatgaaaatgtaaatgtaaattataatgacctccctagggggaaggtcaggatacctaacaatattgcaactatacgtataagagtttatcttggccctgcgtggtggcacggtgactcatgcctgcaatcccagcacttggggaggccgaggcgggcagatcacctgaggtcaggagttggagaccagcctggccaacatggtgaaaccctgtctcaactaaaaatacaaaaattagccagacatgatagcaggcgcctgtaatcccagctacttgggaggctgaggcaggagaatcccttgaacctggaaagcgaagtttgcagtgagccgagattgtgacactgcactccagcctgggcaacgcaccgcgactctgtctcaaaaaaaaaaaaagagtttatcttacaacacacaggagaaatggtatgtatctacaaccttgtttatttcagcattgtttataataagatatatttcaaatacaaatattctttagtaaaggactgataaatcatgatataggcataaaatgaaatcttatgaaagcttttaaaaagactgagaaagctctttgtacttttatgagatgatcttcaatctatgtcatgtgcattttttaacacaaaacaattacctaatagtatgctacaatttctactaaaagggaggaaatgatacaaacttgtatagatacatatatagatatgtttgtataagcataaactaagcataagccaccaggcatggtggcttgcacctttaatcccagctatttgggaagtctaagggggaggataatttgaacccaagagtttgagacctgccagggcaacttagaccctgtctctataaaaaatacaaaaattagctgcgcatggtggcatgcgcttatagtcccagctactctggaggctgaggtgggaggatggcttgagtccaagaggttgaggccatcgtgagccatgattgtgccactgcattgcaagctggtgacagagcaagaccctgtgtcaaaagaaaacaaaacaaaaacccataaaatatctggagagatataccagaagcagataacattggttgtgtcttgagatgggagttggatagttaaatggcagcattagaagagaaatttgttactaaatacaattttgtactttttttggattttgagccatataaataacagaacccattctaatattttaaaatgttttaccgcatgaagttttgccatcaggaatgaccaaagtttctctgtgaacgaatttcacttatagataaaataaatgattggtcaggcatggtgccgtggtaggtgtatcacctgaggttcggagttcgacagcagcttgaccaacttggagaaaccccgtctctgctaaaaatacaaaaattagcgggggcatggtggtgcatgcctgtaatcccagctactagggaggctgaggcgggagaatcgcttgaacctgggaggcggaggttgcggtaagcagagacctcgccattgcactccagcctgggcaacaagagcgaaactccatctcaaaaaaaaaaaaaaatgttcaatagatgcttctgaccctatttcttctctagtttatctaaaaaagacaactttggtacataaaactctaacacaagtgtggtgaaaacgatgaattagcaaattgtaaattccttgcaatttgattagcagtgacatctcccttgggtagggcttccagataactttaccaaagttgcattcaatcagaaatgaaaaaagtattccaggccttaattctcaaggggaactccatggagtcattgcctttgttcccaatccgggtccctttttttttatttatgtttccttatggcaccatctcactgagaagggagttgaacatctttaaaagacagaaacagtacattttaaaaataaatatttcaaagtgtaagtatttttagtataaaatggtattcccggaaaagcatacaggtaatagtaaacatactattgagcaacgaattaaaacactgagcttcctgagacccaggtacgccaaccgcttacataattgtcattttcaaaagaggctgaaagtttctcaaaggaagaaaaacttttcctagcactgaattttaagaaaaatttttgtcactcattttcaattcaagactacaaaatggaaaatgacaatatactattaaaataccataaggaacttcatgtggctatttttcatagtgactgtgaataaaactagaagtttttttcttctttttttttaatagagacggggtctcgctatgttgcccatcctgggctcaagcaattctccagacttggcctcccaaagtgctgggattacaggcgtgagccactgtgcctggccaaaaaaacaaaagtattgtaataaaactcaacttgaggaagttactcacccagacagggaccggtcttataacagcataatgagatcaaggattggctgtaaatagaagtgtggaaagacggcagcttcttcagatatacttctgaaagtcaaatatgctcatggtaaaacgtgaacatctccacaaatcccttaccacagaggtaaacacagttgctttatacaacattccagaaattttctagtgagcactcattagacaggtgctgaagcattgtcagaagttgcggtaatctctggcaaagtcccagaatgctggaattttgtgatactgtcgatgaccttttctttgtttttgtgaagagaatgtgtatattacacatagtcatatgatttttttttttttttgagacagagtttcgctcttgttgcccagactggagggcaatggcgtgatctcggctcaccacaacctctacctcctaggttcaagcaattctcctgcctcagcctcccaaataactgggactacaggcatgcaccaccatgcccagctattttgtatttttagtagagatagagtttctccatgttggtcaggctggtctcaaactcccaccctcaggtaatctacccgccttggcctcccaaagtgctgggattacaggcgtgagccgccgtgcccggcctatgacttttaattcttgtgtccaaagatggtgagacatgtgtggtaagatacccaaactgaccagctgtagcaatggctgcataacaagaaagagagaacgtgagagcagtaaatggccctgatttatttaccaataactcccaggttcttgattatctattttttttctcagtggacttgaagacccaactggactctcctcttttttcttttcttttcttttctttctttttttttttttttttttttgagatggtgtctagctctgtcacccaggccagagtgcagtggcacgatctcggctcactgcaacctctcccatccaggttcaagcgattcttctacctcagcctcccaagtagctgggattacaggcgcctgccaccacacccagctaatttttgtatttttagtagagacagggtttcactgtgttggccaggctggtctcgaactcctgacctcatgatgcacctgcctcagcctcctaaagtgctgagattccaagtgtgagccaccacgcctggccttcttttttattttcttatttttgagaaaggatctcactctgtcaaccaagctggagtgcagaggtgccatgatggctcaaccgcagcctcgacctcctgggctcagttgatcttcccaagtagcagggaatggagtcatgtgccaccatgcccagctactttttgtattttttttatagagatgggatttcaccatgttgctcaggctggtggccaacttcttagctcaagttatctgcccacctcggccttccaaagtgctgggattacaggcatgagccactgcacctggccctggactgtcttcttaatgccccagaaggtgactagcagaatagaaatgttcttatgccggctgggcacagtggctcacaccttgtcatcccagcactttgggaggctgaggcaggcggatcatgaagtcaggagatcaagaccatcctggctaacatggtgaaaccccatttctactaaaaatccaaaaaattagctgggcatggtggagggcacctgtagtcccagctactagggaggctgagggaggagaatggcgtgaacctgggaggcggagcttgcagtgagctgagatcgtgccactgcactccagcctgggcgacagagcgagactccatctcaaaaaaaaaaaaaaaaaaaaggtccttatggcaaagtctgaagatttttaagtatctcaagaaaggagttttttgttgcaagttcaaagcagtagaaaaaatgaagaaatatagcttcctcttatcaaaatgacctgcagaagtttgaaaaactcttccatctccccatcccatggaaggcatcttcaacagtcctgttccatttatagactctgtagaaggaacagttcttataacatgatgccaaaattattctagttcacacacaaacaagttgtcctgtaattctgctgtgggcctcctcatattaggaagaaattaagaaaaatatagtaccaccagtttgttatgcaaccacttcgaaaatgtttactttgcttaaaatgtcatggctaaagaaactactcgtctgcataatccactcttgacagtgattcataactgtgtgacatttgggcttggtcaggctttactccagtcagattgagtctttccttaaaaaggggatatattttcaatttcagagtatttactgcttcatgacaaatattaataacaagtctgtggcttcgaggcctcatacctttgagactaccacagtctacttagcatttttttttttttttacttagaccttttgaatttgcttttaatttatacccctggccttgttctcttgaccaaataaaagccctaagagagcttccactgccagcagccttccaatttgctctgttcccccttgggccctgttgattgggcccagtgatcacctaaaaagagtgcaaagagtcaggaaggcttgtgggttcagtctttctgtgctaacaccaggccacatccaggcctgatgtactaactgatctccagttcattccttttgcaatttttggccttgattcatagttcctgattcttgattggctctgaaatcctccccattttcaaaagggatgcagtcaagcaggccaaagcgctccatgttagctaacaaatgtttgcaaatcataataatgtaggaagagaaccataaactaaatgaacaacaggcattagccctcatgctgtcacataagcattcctcaaaatataatcatgcttctaaacatgggctggcaattcaggaaagggccactgaaaatattagcctcgttcttttctctgtagagtgagcacagactattcctaaaccacattgcagtatgccaacattgtaaattaatgcctgattggttacctagaagtaagacaatcttacttttaggcatctagaacactgagaaatccaggatggacacttaacactaccaaagattgatctattttgggtaagtatacttctgatctctttttgaggactgtattagtccattttcacactgctataaagaactgcctgaggctgggtaaattataaaggaaagaggtttcattgactcagagttctgcatggctggggaggcctcaggaaacttaacagttatggcagaaggcaagggagaagcaggtaccttctttacaaggcggcagaagagacagagagggcaggggaaactgccatttttaagctatcagatcttgtcagaactccgtcactatcacgagaagagcatgagggaaactgcccccatgacccaatcacctcccaccatcccccgctcaacacgtggggatgacaattcaagatggaattgtgtggggacacagagccaaaccatatcaagtacctacaaaattatggtgactcttcactaatttgcaaactgattatctgcaaatcttaaatagggaataaaacacaaaaatatcattatccctccagaactgaggacgcaaattggatttagaagacttagctttgacacctagatatgttttcattgatttgacctaacttgatctcagtttctcttttatagagttagttctttagatcagaggtccccaaccccaggactgcggactgccactggtctttggcctgtcaggcacccggccacacagctggaggtgagtggcatcaagcaagcattaccacctgagctccaactctagtcagatcaatggtggcattacattctcataggagtgtgaaccctattgtgaactgcacatacaagggatctaggtaacatgctccttatgaaaatctaactaatgcctgatgatctgagctgaaacagtttaggccaaaaccatccctcctgcaccccattttgtcttccaagacaaaagattattcaaggttgctatgaacacctttatgtggacaaactagaaaacctagaggagatggataaattcctggaaatatacaaccctcctatattaaaccagaaataaaaataaatcagaaactgagcagaacaataacaagtagtgaggctgaaacagtaataagaaaaattgccaagaaaaaataatcgaggaccagatggattcacagctgaattctatcagacattcaaagaagaactggtaccaatgctattgaaactattccaaaagatagaataaaaccagtattaccctaataccaaacccaggaaaggacataacaaaaaaagaagactacagaccaatatccctgatgaagatagatgcaaaaatcctcaacaaaaggattctcaacaaaatactagctaaccaaatacaatagcatatcaaaaagataatacaccatgatcaagttggtttcataccaggaacgcagggatggtttaacacatacaggtcaataaatgtgatatacaccacatatggttgtcttatgaaagtttttgtcaagtagatgcctcaggaagtgctcatggaaacaatattccctgaatttttgcacagtgattacatttcgtatgctgcctttatcttggaaagctactgactcacattttctttcattgaatatcttaaatatgttactccatttttcttctacctaaatcattgctgttaaaaaaaatttgatggcaaatctgatttttttttcctttataagtggattttttttgcctagaagcccaaaataattttttcccctttaaaatgtgtaattttggtgggatgatcacttgagctcaggaggtcaaggctacagtgagctgtgatcacaccactgcacttcaggctgggggtcagagagagacactgtcttgaaaaatatatttttttagctactaatttcattataataagttatggtgttactagtcctgggtcagtttttccaggtatgtagtataacctttcactacgtagcttcaaatacatatattgttaatttgaagaaaatgttcttcattatagttttttggtagtccttctgtgccttgctttggtttttcttcttgagaaactcttgttaaacatatttttgtatatcttttttgcctgtctctaagtttgtttctttctctcaagccctttttattactttccttcaattaaaaaaaattttttctctttcatcttctcttcttaaggtattctctgtgtttatttattcttccattactttcagtttagttttttttttttttttttttaagagatggggtctcacttgttgcttaggctggtcttgaactattgggttcttgaactactgggttcaaaggatcctcccgcctcagcctctcaaagtgctggggttacaggcatgagccactgcacccagcctagtctctgtttttgactagtgtttctacgtctttttccttggcctagtgtctgtttttgactattgtttctacgtctttttccttggcctagtctctgtttttgactattgtttctacatctttttcctaagtatatctatcacctcatttctgatatttcccaattctcatttttcttgttttttccatatcttggatgatttctttaatgtcttctagcacacattgaaataataagtcatggtttgcatctgctctgtaggtatgtctttttagcatctttggcattgtctgtagggatgtttttcagtttcttctctttttttcctgacagtaattttgtatgagatttaatcttggtatttttttgctcatttaaaaaaatatgaaataattttcttaaactttcaggaggaggtaggatttgggaaagcatttccaatttcacaacctgatcgctctctttttttgttgtatttgtgtggtggttaaaactatcggggcttactttttttttttttttttttttgtttgacagatctcgctctgtcgcccaggctggaatgcagtggcgtgatctcggctcactgcaagctctgcctcccaggttcacgccattctgcctcagcctcctgagtagctgggactacaggtgcccaccaccacgcccggctaattttttgcgcccactaccacgcccggctaattttttgtatttttagtggaaacggggtttcacctgtgttagccaggatggtctcgatctcctgaccttgtgatccgcccgcctcagcctcccaaagtgctgggattacaggcgtgagccaccacgcccggcaatcgcggcttattttctgagatggtcagactctgttttctttccttgctttcatctggaccccgtctttccttgatctctatcgtcccagttccgtacaatgagcattcttttccaagaagtttcttctctgtgcagtgcttgtccaggagtggaaatttgggtggttagtttggaacattcattgtgcccgtcagacactttgcattcccctgactttggagtgtgcaaaactttttccagtttcagctgctgttcccaagtggaacctccaagctttccagcaattgcctgcttgctattttgagattatcagatttatcagagtctcatgaattccctccactttctattatacagttgctgataccacctagcccttgtatctgtctatggctttcctcaattccttatgttctagggttcgtggagacacttcatcacctaattttgttatagatgttgtccacgggttttttattttatcttttgtcctttgtctatatttgtggcagaattttaaggttaaaaaatgatgacccccggatacaggtgaccattgtaagggtacaaggaaaatatcccctttgtcctctgaagatttgcttaaaaatcaactcataaaagtcagattaattggagtaaatgtatataaattttattaacgtgtacatgagagcctttagaataaagacccaaagatatagagaaaattatctttttttgtttgtttttgtttgagacagggtctttctgtcacccaggctggagtgcagtggtgcaatcacaactcactgcagcctcgacctcctggactcaaggggttttcccacctcagcctcccaagtagctgggaccacaggaatgaacaacctactaattattttatttttagtagagacagggtctagctatgttgcccaggctggtcttgagttcctgggctcaaaggattcccccacctcagcctcctgaagtgctgggattataggcatgagtcctcgaacccagcctggaaattatttttatgtttaggttcaataaagtatggacaaccatgtagaaatgtaactggacaaaaagggtaccatctaatgttaatagacaaagtagggaaacccaggaaggcctgggttaaacggtaagcttagatagtaagacctgtgtattagtctgttctcatgctgctaataaaaacatacccgagactgagaaatttgtaaggaaagaggtttaatggactcacagtttcacatggctggggaggcctcacaatcatggcagaaggcaaaagagaagcaaaggcatgtcttacatggcagcaggcaagagaggttgtgcaggggaactcccatttataaaaccaagttttattcactactgcaaaaacagtatggggaaactgcccccatgattcaattatatcaacctggccccactcttgacacgtggggattgttacaattcaaggtgagatgtgggtgaggacacagccagcccgtatcagcccatgtgtctctctgagtatgtatgtttttcttttgcatgtagggcaggaccctttctagaatggggatcgtatggcctataattaaataaggtagctcagataatttttttatgaccaggttttacacagaaaggtgcaggaaaaattagagtaatatttttaggttttttatggctggctttggggcaaagaggttctcatttgtatgacccgccttggggaagagggattctagtttctatggcaagccttgaagcagaaagggaccttagtcttagaccagtcttagtcttagacaagaagacatgagaaaattagaaaaaaaagttttacttgtaagactattttggaggcctttattttgggggtgtgttttgagtccaaacaccatcagatagatcttggtagccaccagctatatatggtgagtactccttgacagcaccaagcatgaaatgctcaaacaggttggcagaagtccctgtgaatgctcagagggtgccatagagaggaaaaaagagcagaaggcaaccagcttttatctgagatctatgtgccagatattttgctagtagcttccacatatattatttgatttgatttaatctaataatcacccccatcttctgaagtagaatcttcaggtcttcctaagtcctatgctcattcaacatggaattgtgagaaacttaatctccctgatggaataggaatcagttaaagtgcgacagagtagaggcacctgagtcagcactaatgaaccttgtgaagtcctttagtgtttgtcaaaactactgtaaagatactacctgagactaggtaatttataaaggaaagaggtttaattgactcacagttctgcatggctgctgaggcctcaggaaacttacaatcactgtggaaggggaagcaggcatgtcttacatggcggcaggcaagagagaagtaagtgcaaccaggggaaatgccatcatatctcatgagagctcactcactctcatgagaacagcttggaggaaaccacctccatgagccgatcacctcccaccaggttcttcccttaacacctggggatgacaattcaagatgagatttaggtggggacacaaaagcctaaccacatcaatattcatcatggattcaaagatttcttgattaaaattacgagatattaagattaattatgatgattataaaaataataccaaaccttgattatgtaccatgcacgattttagtcattttacactttacatgtattaattgtttaaatattcataacaattctattaggtagatattattattgcattcttcttctttttcttttttaagagacaggtattgctatgttgcccaggctgctgctggcctcaaagccctggactcatgtgatcctcccaccttggccttctgagtagctgggactacagtcatgtgccatggtgcccagcaagtagatactattatattcattttataagtgatgaagttgaaacccagtctagttataaatatgcccagtgtcacgaagctaataaataacaggattaggattgaaatccaggtcagtctgaccttgaaccaccaaatacactgccttcttataactcagctctttggagttctacatttgatttacttttgtgtttcaaccccagatgtatagttcaaaaataatacataactttaaaaataaagataatttttaatgaaaagaaccagaattaattgtataatctgttgttagaaaaatcttttggccaggtgcgatggctcacagcggtaatcccaacactttgggaggccaaggcgggcagatcacgaggtcaggaaattgagaccatcctggccaacatggtgaaaccccatctctactaaaatacaaaaaattagccgggcatggtggtgcacacctgtagtcccagctactcaggaggctgagacaggggaatcacttaaacccgggaggcagaggttgcagtaagccaagatggcaccactgcactccagcctggtgacagagcaagactccgtcaaaaaaaaaaaaaaaaaagaaaaaaaaactcttaatgaagaaatacaagtcagaaacacttgagccaatttacttaaaaaacagaaacatacagagggtacccctacgaccactatcactaaacagagaatgtagaaagatttaagtgtgttttacatgttacatggttgcatacttaaaatgtcagcagaatcaaacaaaaaatagttatacacaactagaagacagaatttaccgtatcaataatacattaaataacccagcaataaaattaacttgaaacagatgtgtttcttaaaaaaattgattgaagggacagaaagatttcctgacaaagatgccaaaagcaattgcaacaaaagcaaaaattgacaaacggtatctaattaaactaaagcacttctacacagaaaaagaaactatcatcagagtgaacagacaacctacggaatgggagaaaaattttgcaatctattcatctgacaaggtctaatatccagagtctacaaggattttaaacaatttacaagaaaaaaatgaacaatcacattaaaaagtgtgcaaaggacatgaacagacacttctcagaagacatacatgtggccaacaaacataagaaagaactgattattagagaaatgcaaattaaaaccacaatgagacaccatctcacaccagtcagaatggctattattaaaaagtcaaaaaacaacagatgctggagaggatatggagaaataggaaggcttttacactgttagttggagtgtaaattagttcaaccactgtggaagacagtgtggtgattcctcaaagacttaaaggcagaaataccatttgattcagcaatcctattattgggtatatacccagaggaatagaaattattcttttacaaagatacgtgcacgtgtaaaaataaaaagatacgtgtacacgtatgttcattgtggcactattcacgatagcaaagacatagaatcaacctggacgcccatcaacaacagactggataaagggaatgtggtatatatacaccatggagtgctatgcaaccataaaaaggaatgagaacatgtcctttgcagggacatgaatggaggtggaagcaattatcctcagcaaactaacacaggaacagaaagccagtcaccgcatgttctcacttataagggggagctgaaccacgagaacacatagacacatagacggtaacaacacacacgggcctctccaagaaggtgggatggtgggagggagaacatcaggaagaatagctaatggatgctgggcttaatacctaagggatgggttgatctgtgcaggtctgtgtagcaaactaccacggcacacatttacttatataacaaacgtgcacatcctgcaaaggtattcagaacttaaaagttgaagaaaaataagttgattaaattctaataaaaaaaggtaaacatacctaaataactatgctacattcttttttagagagattaaataagacatcaattaaaaatgtttaatatataaatttattgcagttataaattcctgtgagaaccaatagtgaaaaataaatggatgacattatcaaaacattttcattgggaataaggatgaactcagcaaacttggaaaactgaacacactgcaacaatgatcaaaatcttatggccttgggttattacagtcggaaaaaagaatccaacctatagggcaagggaaaaccacataataagttgtcttccaaatagttggctaacaggctggaaaaaacatcatgttagatacgtaaatacacggaaacaaacagtataataaattccagctgtatcaaaaagtaaaagccctttttaaaaaatggaagagtggtttatctatttcctatgagaaaaagaacatgcatttttattttcttttttgagacagtgtctcactctgttgcccacgttggattgcagtggtgtgatcatggctcactgcaacctcagtctcccggggtcaagcaatcctcccatctcatcctcccaagtagctgtgactacaggcatgcgtcaccatgccttgctaattttttaattgtttgtggagacacagtctcactatgttgcccaacctggagaacatgcatttctaatcactgcagaaaacaaaggttgttaccggaagcaggggtgattaattgagcagatttaaattttttaactttcatgcaacaaaatgtaaaataaaaatgctataaagaaaactttccagtatagaatagatatattacaaatataacgtgataatagctttctcccaaaatatatgaaaaaataaatgattatgtaagtcaataaccactttccacttgatgaatggacagtttgcagttaggaacatttagactacatcattgtgtttttaaaaatcagttttattaaaaaatgaaaataaaggttaattaaactcacatgaagactctcttacagatgcattaaactggaagacattttttattttttattttatttattttttttttgagacggagcctcactctgtcacccatgctggagtgctatgatgcgatcttggctcactgcaacctctacctcccgggttcaagcgattttcttgcctcagcctcccaagtagctgggtttacaggcacgtgccaccacacccggcctgtttttgtatttttagtagagatggggtttcaccatgttgtccaggctggtctcaaactcctgacctcaggtgatccacccgcctcagcctctgaaagtgctaggattacaggcttgagtcactgcgcccagcctggaagacattttttagcttgtaaaactgaacctggacaagtctttgggaggaaggcagacgtacattttgtatgttaatggtagaaatgtaaaatggttacatatttctggggggtaatctataacatgctctttgacctattacccgttccttcccctgagaaaggaaaactaacttataaagcaattttcattgcagccttacctataatggggaaaattagcttcagttcaaatgcccaatagtattaacatgtttaagtaaaccatggtgtattaccatatacaaattaaaatgacaagtaaatggaggatgtaatacatagatatgtttatgtgaaacaaggtgaagtaaacaacttgaacccatgataactttatacaattatatagacatatataaatgtaggccaggtgcagtggctcacacctgtaatcccagcactttgggaggccaaggcaggtgaattgcttgagtccagtagttccagaccagcctgggcaacatggtgaaaccctgtctctgcaaaaaatacaaacaaaattagccaggtgtggtggcacaagcctgtagtctcagctacgtgggaggctgaggcaggaggatcgactgaggttgaggctgcagtgagccatgatcacaccactgcactctagtctgggctactgagtaagacccagacatttatattgctttttccaggtatgttttttatatacacatatatatattacatatgttatataatgtacataatgtatattacatatgttatataatgtacataatgtatattacatatgttatataatgtacataatgtatattacatatgttatataatgtacataatgtatattacatatgttacataatgtacataatgtatattacatatgttatataatgtacataatgtatattacatatgttatataatgtacataatgtatattacatatgttatataatgtacataatgtatattacatatgttatataatgtacataatgtatattacatatgttatataatgtacataatgtatattatatgttatatacgtatattaatatgtatatacatattaatatacatattaatatatgtatattatatatgtatatgtatatagacataatgtatattatatatgtatatacatatgtatacatgtttattatatacgtatgttatataacatatataatatacgtatgttatataacatatataatatacgtatgttatataacatatataatatacgtatgttatataacatatataatatacgtatgttatataacatatacgtatgttatataacatatataatatacgtatgttatataacatataatatacgtatgttatataacatatataatatatgtatattatataacatataatatacatatgttatataacatatataatatacgtatgttatataacatatataatatacgtatgttatataacataatatacgtgttatataacatatataatatacgtatgttatatatgtatatatgtacacatatgtttatatgtatacatatatgtatatgtacacatatgtttatatgtatacatatatgtatatgtacacatatgtttatatgtatacatatatgtatatgtatagatctacacacatatacatatatatgtgtatatatatatgacagcatcagtcttaatagcttagatgatttctatttgctaattgctttaattgacctccaaattctggtccttacatctcatgtctacatctccattcatttctctagtgtgaaaaaaaaggaaaaaactgaaaatctcaagaggattccaggaaatcaaaacaatgaattattgaatcaagaatttgaaagagaaaatagatgcatactgaaaaaagaattttgtttagtgagatagatgtaataatgaaggcatgttgataacgggggagctatgtatatatgaggggagggatatattggaaatctctgtatcttcctctcaatcttgctgtgatcctaaaactgctctaaaaaatattttgagaaggaataatgatgtggtaaacatgttctgttatttaaaaagagagacttttcatagccgcctccctccccctctacacacacacagagtcctgtccgtcttcattcccttactcaataatttgtacagacacagccactgggctccagtaatcctaaagtttctagaaaatcaagcacagaaaaaggttaaaaccctgagggaataaaagaattcctttgcatccattgcatttctcaggaagtgaactaacaaattcactgcttttaaatgaggaaattttctcagtgaaattgattccaaaccttcgttaggtcaactgttcccagatttcttagctgatgcctgatctgactattccttatctttagtacagaaaccaaggtgaatgacctttaaaaaacatattagactgttgacgtgtcttctatgttgtactctaggtaaaaacgataaaccaggaaaaagaaagtaaaattcaaccttaggctcatggatccagagtggataattatgagtctgtagtatctacatgcatgtgatgaggttcaaggacaataaccataaagcaaagacttaaaaggttttatcattagaataattgtaattcacttgatctctcaatgtaacaatacttcggtctactgtctcaagccattattatgtcttacactcagcatattggtttgtctaccattaaatatttattttctacagtgctttctggaaggcaaacaaagcagccactctgctactttatattgattcctgagttgtccttcggaaacgctttcaggaagtttaataggtttgaaagatatttagacctgtgactggcaaatatacttccttctttttatttcaataagagagtactagaacttagatctttattgtttaatctagtcagtgctgtcattgtcaatcaagttctcaaatgacacttgtcctgagctgtaactgatctattcagaagaatatgaaaatagtaaagacggcaactatgcatgtttttaccggacacgattttaattgctttaaaatgaagttatgcaaccaatgaggaatggagcttttggagtggcctgaagctaaaggtttcaggtgtatttttgctttctttgaagaaagaaccaaatcattttatttaataaaaaggccatttatcaagaatttcttaaagctgttttaaacctgagtttgcaatttatagaatatgttcaagcagcctcagtgcccttttaattggatggttttcacagatttatccaatttgagatttatccagtgagaattccctttgttcaagtatatatgtcttctcttccataaagcagattcaaatgaaagagtgcaatctgatatatcagacatgtcagttatacatttgatgtggtaaatttataagagaggccaattattgttatgaaaaaatacaatgaaatacatgatagtcatttactgtttttataactaatctaaaagtatttactaaaaagaaactatttcttttcatatgtactttactttttactttaacccttcatatgtcctttaaataaagagaagaaaaaaagtcatttatatttatccacatattttctatttcaggtggtcctcattcattcttgtagatccaagttaccatctgttattattttctttgtcacctgaagaattttcagaactatttcttcctatatgtagcatgtatagatactctaaaaagtccattatatgatgtataaaacaaagcatacaatgtagtctctgccctaattatttgtaatttatataaaaccttttattttttatttttaattgtttattttattttgttttgttttatgtttttgagatagagtcttgctcttttgcccagactggagtgcaatagcgtggtcttggctcactgcaacctctgcctcccaggttcaagtgattctcctgcctcagcttctccattagctgggattacaggcagcaccaccatgcctggctaatttttgtattcttagtagaaatggagtttcaccctgttggccaggctggtcttgaactcctgacctcaggtaatctgtccgccttggcctcccaaactgttgggattacagatgtgagccactgcacccagcctaattggttattttattatttagactccacatatcaattttcttactatggcgatatgaaatagcaattaaccttgaaatatcatttatttttccctattattacatttcccttaagaactacaataagttattttactgaaaaacattgtccttaacgtaccatgagctaatcattcaagaattgtgactaaattatctaaattatttcagtgtaatcacctgaggttctaggtaagccctccttctcattctctgcttcacacatgccaatgattaaaagatcagattatcagccaggcacggtggctcatgcctgtaatcccagcactttgggaggccgaggtgggtggatcaggaggtcaggagttcgagaccagcctggccaacacagtgaaacgcccccccgccccccagtctctactgaaaatacaaaaaaaattagctgagtatggtggcaggcacctgtactcccagctactcaggaggctgaggcaggagaatcacttgaacttgcagtgagctgagactgcgccattgcactccagtctgagcaacagtgcgagactctgtctcaaaaaaaaaaaaaaaaaaagatcacattatctttaagtaaaaaaaagtagtcaactggagttccacttttggtaatggtagggtagctggcatcaaactagatctcctgcagatcaaaattatatactgtgaaaaaaatgtaaataatgtctatctgaaggcactggagggtgtctagaagcaggcagaaataagaagggaatcctttaaagaagggaactaaatatggtttttcagttgaggatactccccagaccttgtggtagaaagaagctagaactgaagctaaaaccacaattttaattgcttgaagggttaaaggacagaatttgggactgccaatatggctggattatgaggggagaaatttcagaaagatggtagccacagatatgggagcctctaaatccatgtgtaaactctctgcacacattcctgcagatctctgaactgtgtattgtgtaggagactccaaggaacccaaacaggaggctgaaaaactgagtagagatttcagctaatgccttgacaagggagaaaaaatttggggtttgagtccagctaggtaactgcctgctaaaacaaaactcaacactcagccaaaaaaataagaaaatcaagagtatgtaaaatgtctcatcaaatgcaccagacgcaatcaaaacttactagacatgcatgcaaagaaacagcatatctcttgacccagagtcaagaaaaattcaatcaatagaaatctattccaatatgtctcagatgttggaattaacagaaaagatctttttaaaactgttttaaatatatttaagatcttaaaagataatatcagtggaaaaatagaaagaaccaaagtaaattctagaatgaaaaaaatataataactaagtctttaaaatgggcttaacagcagattggaaacagtgaaagaaaagattagtgaattaaaaaaaaaagatcaacagaaatatctaatctgaaaaacagagaagaaaaagaaattgagaaaagtgagtaaaggatctatgaagaaacaacaaacatatgaacacagatatacttagagtcccagaaagagaggaggtagaaaacggggcagaaaaatatttgaaaaatcagccaggtgtggtggctcatgcctgtaatcccagcactttgggaggccgaggtgggtggatcacctgaggtcaggagttcaagaccagcctggccaagatggtgaaaccccatgtctactaaaaatagaaaaattaaccaggcatggtggcacacacctgtaatcccagctactcaggaggctgaggcaggagaatcagttgaacccaggagacagaggttgcagtgaaccaagatcatgccactgccctccagccagggtgataaagaaagactgtgtctcaaaaaaaataataataaaagaaaaatatttgaaacattgtggccaaaaatttcccaaaatttggtgaaaatataattgtacagatctaagaagttcaacaaacataagcagaaagaaaaataccgaaaattatgcctagatacatcatagtaaaataattttttaaaaaagataaacagaaaatcttgaaaatgtccataggtaaactacacatgagaaaaaggggactgattaatcaaattttgacaagtcaagagaaataatagattccaggagacaatggaattacatctctcaggtgctgaaagaaaagactgtccacccaattccacatccaatgaaaatgtccctcaaaaatgaaagagaagggccggtcgcagtggatcatgcttgtaatcccagcactttgggagtccaaggccagcggatcacgaggacaggagattgagaccacggtgaaaccccgtctctactaaaaatacaaaaaaaaattagccgggcgtggtggcgggcgcccacagtccctgctactcgggaggcggaggcaggagaatggcatgaacccaggaggtggagcttgcagtgagccgagatcatgccactgcactccagcctgggcgacagagccagactccatctcagaaaagaaagaaaaaaaaaaaacgaaagagaagtaaacacattctcaaataatgaaagtgagagaatgaatcaccaaccaacacacactacaagaaatgctatagaagattcttaaggtgacaaacgaaataatagcagatggtaacttggatctgcaagaatgaataaagaccaccagaaatggtaaatatatggatatatatatataaatgggtacattttttcttctcttatttaaaggacatatgaagggttaaagtaaaaattatcacactgtattgtaaagtttacaaaataagcagaagtaatatatatgataaaatagcacaaaaattgggcaaataaaattatgcagttgcaagacatattttacatgtaatgatgtaatattaactaagcagattgtactaaaattaaggatgtatactgcaatctctagaatcaccactaaaaaatgatgtaaagtagtagaactaaaaattcaggggccaggtatggtggcttatacctattatctcagtactttgggaggccgaggtggaaggatcactggaggtcaagagttcaacaccagcctaggcaatgaagaaagactccatctctacaaaaattaaaaattaaaaaaaaatagttgggtgcagtggcgtgtacctgtagtcttagttgcttaggaggctgagacaggaggatcacttgagcccatgacttcaaggctacagtgagctatctttcattgcaccactacactccagcctgggctgggtgacagagttagactctaaagaaaaaaaaaccaatagagaattgaaatgaaatactaaaatattgtattaacacaaaagaagccacaaaaagaggagcagagaaacaaatatcagactggacaaataagaaacaaataacaaaatgatagccctatatccaaaagtatttataattatattatatgtaagttaaaatgtagagattgtcagaatgaatttaaaaaagcaagaatcaaagatatgctgtctacaagagatgcactttaattgtaaaacacaaatagtttgaaagtaaatgaatagaaagtatataccatgtaaacagaaaccataaaaaagctggaaaggctttttttaacaattaaaaaaaatacactttaagagaaagagttttaccagaaataaagatgttgtataataatataaaagggtcattaatcaggaagatactatcatgaaagtatttgtacctagtaatagaccatcaaaatataataagcccaaattgacagaactaaagggagaaatagacaagttcacaattttgagtgagactttaacatagccgtctcagtaaacaataaggtaacaaaaaatcagtaaggatttagaatatctgaaaaacattatcaaacagcttggcctaattgacgtgtatagagcactatacctaacaacttcaggacatatttgcgtgtagaacattcatcaagatagaacataagttaggacatgaaataagtctcagtaaatttcaaaaggttgaagtcttacagaatatattctcggattataattagattataagtaaatatcgaaaagaacttccagatagttagaaattaaacagtatgcttttaaatgtgttgaagaagaaatcctaagaaaaattaggaaaaaatggaactgaatgatcacaaaagtacattccttccaaaaatctaaattcccaaatagaagtttgtgagactcatctaaagcatggtttagaagacaatttagagttttaaatggctatatcaaataagataaaactttcaaatcaatgatctttctacttaaaaagctagaaaaaagaggagaaatgaaaactatagtaagtaaaagagaggaaaataaataagactaaaaaccaacaacacagaaagcagacacaatagagaaacttaacaaagtcaaagttgattctttgcaaagataaataaaatgggtttgcaaagataaataaaatgggtatattctggtgagactgaaaaaatggaggagtgggacaggagaccataagagaaagaacacacattacctatgtgaggaataagaggtaataggagaatattataatcgactttatgtcaataaatgtgacaacttaggtgaaatgaaaaattactcagaaggccacttatcacacttgatacaagataaaatagaaaatttgaataactacatctattacataagctctttcagaaaacgggaaaaataaatacgtgtcaactcattttacaaggccatcaaaatactgttatctgactttggcagcataactctaacaaagacatgaacaaaggaaattagagaccaatgttcctaatacaagcacaataatcattaacaaaatattaaccaacttattcaataatatattaaaaagatattatatcatgaccaagtggggtttcttccaggaatgcaaagttggtcaacatttgaaaattagtgtaattcaccatattaacagaataaagaaaaaaaaacacatgataatttcaatagatgcacttgtgataaaaactctcaacaaactaggaataaaaagaaacttccaggtcaggggtggtggctcatgcctgtaatcccagcactctgggaggctgaggcgggcagatcacctgaggtcgggagttcgagaccagcctgaccaacatggagaaaccctgtctctactaaaaataaaaaattagccaggcatggtggcacatgcctgtaatcccagctacaagggaggctgaggcaggggaattgcttgaacccaggaggcggaggttgcagtgagcagagatcacaccattgcactccagcctgggcaacaagagcgaaactctgtctcaaaaaaaaaaaaaaagaaaaaaaaagaaacttcctcaacctgatatacagcatcagtcaatatcacacttgacagttaaagaggcaactcctcttacgtgattggaaaccaggcaaagatgcctcttctcctttaagttctattctattctataaacttctgaaccagtttgataagtcaaaaaatggaaataaaaaccagaacaattggatagaagaaggaactgattcctatttgcagataatataattctttatatagaaaatcttaaggaatctacaaaaagttactggaactaatgtgaatttagcaacacttcaagattcaagttcaatataaaatcaattgcatttctaaatactaacagtaaacacatttttaaatcaaattaaggttattactttaacaatagctttaagacataaaatacttagaaacaaattcagcaaaagatctgtaaaacctcaatgttcaaagctacaaatactaatcagtgcaattaaataacacatatagagataccccacgtccaaatgttgctagactcaatattattaagatgtcaattttccccacaatgattttaactataatcctagcaggcattttagtacaggtgacaatctgagtctaagacttattggaaatgtaaagggcctggaatagccaaaacaatcttgaaataaaggaacaaagctggaggatttatattatttaacttcaaaacttaacataaattatgataagatgtgtaatactggcaacaggatagacacatagatcaatgaaacaaagtacgaggcataaacagaccaacacctatctggttatttcattctgaagaaaggtggcaagacaattcagtgaggaaaggaaagtgtttaataaattatgtgggaaaacgagatatctatgtggaaacaaaacaaccataacttctacctcattcatccagggacctaaatataaaagctaaaactatagatggtctttaaaaaaaaaacctaagtctacagtgaaaacctcaggtaagtgaagatttcttaaaacagaaaacaaccacagaattgttttaaaagataaattaaactttatcaaaagttaagccttctcattaaaagacactttaaaaatgaacagaaagccacagactgggagaaaatgtaatgtacatatctgacaaaagacttgtattgagaatatataaataactgcagcaattcattagtaatgacaccaatgcaagaaataaagtaaataaaatctgtaatagacacacaacaaaggaaatattatgcatgtccaataagcacatgatcaagttctttcttagtcattggaaaaatgcaaattaaatcttcagtgaaatactagcttacacccaactaaaatggctaaaattaaaagtactgaagacaccaaatattgaccaagatgtgaagcaagtggaactattatacattgctaatgggaatcaaaaacaaaaaagattcgtaatttcttataaagttaagcatatacctgctctatgacccagaaattctacttctaaatgtttaccaaagagggattaaaacacaggtccaaaaagtcatgaatgaggacattcatggtcaccgaaaactgaaaacaaccgaattgctcattaataggtgaacggataaacagattgtgatattgtacactcaaacaatgacaaactatccacaggaaagaactcttgatatatccaaaatatggatgaatctctcagatgtgctgagtaaaggaagctggatacaaagagtatgttccatgattccacttacataaatttctcaaagaggttagaaaatatgtgttgaaaatctatggtggaaaaataatctggaatggaaaaaaaagaagagtttgcctctgccaggggtgttaattaggaagaggcattagggaacgtttagggtgaaaaaaaaagccctaaattttgatagagtgttatacagaatacacatgtgtcaaaagtcatcaaattgcacacttaagatttgtgaatttcatgatatttaaatgttacctcgaagacaaagaaccgaaaacaagtatcagctctagtagatttgcttttctcagtggattagcaattccaacaggagtttttgtgtattctaggttggaacaaatgtatgaatttattgaggataatgaaagccaggtttttaattgttcacggagaaagttagaaacattgaaaagggaaaccaagctgtagattggaatcagaggtacaaatatgaaataatgctttttagtatctagatatagatttgtagatagaggtagcaatagttatggaaatacatagatgtgtatatacatgtatttagatgtgtctatgtaagtgtatgtgattcctaaatctatccactcattggacctagaagggccttcagcaaagaacacagctgctacccagatcattgtctgtaaatatctttactctaataaatggaaccttgaagaaatgctgatcccaaaactagagcaggaaaagtggaagatgaatcaggaacatcttattgtatctgtaaggataggctcaaaatatgatagccacatatcaaaaggacacgggttggcttgaagtggttcccactaatccaaactggcaaaattgcacattaatataaataatagtaatactgggttaaaatctattgagtaaagttagaatgtatgagtccatactgatatgaataaaaagaaagaaaggagggagggaagtgggttagaccgtttttgcattgctgtaaaggaatacctgaaactggataatttataaagaaaagaggtttaattggctcatggttctgcagacagtacaagaagtgtggtgctgggcggggcacggtggctcatgcctgtaatcccagcactttgggaggctgaggcgggcagatcacctgaggtcaggagttcaagaccagcctgaccaacatagtgaaatcgtgtctctaacaaaaatacgaaaattagccaggtttggtggcacatgcctgtagtctcagctacttgggaggctgaggcaagataattgcttcaacccaggaggaggaggttgcagtgacccaagatcatgccactgcactccagcctgtgcaacagagtgagactccatctcaaaaaaaaaaataaaaaaagaagtgtgatgctcgaatctgcttatgatgagggccccaggaagcttccagtcataacagaaggcaaagggggaacaggtgtctcacatggcgagaggggaagcaagagagagatgggggaggtgccacatactctcattttaattttttaaaatttatttttaaatgtttaaatgtttgatgtttgtgggtacatagtaggtgtatatatttatagggtacatgagatgttttgatacaggcatgcaatacgtaataatcacatcatggagaatgaggtatccatcccctcaagcatttatcctttgttacacaaaatctaaatactcccttttagttatttagttatatgtacaattaagttattattgactgtagtcaccctgttgtgctatcaaatagtaggtcttactcattttttctattttttttgtacccattaaccatccccaccttccctccaccgctgccctcctcccagccctaccctttccagcctctggtaaccatccttctactctctacgtccatgagttcaattgttttgagttttagatcccacacataagtaagaacacgtgatgtttgtctttctgtgcctggcttatttcacttaacataaggatctccagttccacacacttttaaacaaccaaatctcgagtgaactcagagcaagaactcattcatcaccaaggagatggcgctgagccattcatgagggatccactcctgtaatccagttgcctctcaccaggtttcacctccaacgctggagattacatttcaacacgagcgtcggaagggactaacatccaaactatatcaggagggatggcgggaggaagggaggagggagggagggaaggacagaaggaacggaaggaggaaggttgtttactacactaccagcctcaaaaggaaaaatgttaacatagattgcatagggttttgcaatcatatacactcattttaatacctataatctttattcagcattttaaattaactgtatctatttcctatttatgccagctgaagaacatgtggctttgaattatttcaaatgcaaatttttttccccattttatcattttgttggctgtattggttttctatggctgttgtaacaaaataccacagatttagtgtcttaaaacaacgcaaatttattctgtcaccatgctggaggtcagaggctaacatgagtcttaaagggctggaatcaagctattagcaggactggttccatcgagaggttccaggagagaattctttctttccctttcccattccctctctccaatatgtctttggctttgccttctgctctaacagagtccaatttgtccctctgtttctttctttgaagaaaacctgtgattatatttaggacccatggggctaattcagtataatcttctcatccccaagtctttaacttcgtcacacctgtgacattcctttgccgtataagggcacactcatgggttctgggcattagaacatggacattttaagaggccattattaagcccaccacattgattattctaactatttagtctctgtccaccagaccactgaaatgaaatatttgtcattataataatttatatttttattattttactcttaaggtgaatttacaatactttatttcagatgaattagaatatttaaaaatatgaagactaaacttatacttaataagtaattagacatactttttttttttgagacagggtcttgctctgtctcccaggctagagtgcagtggttcaatcactactcactgcagcctctaccttttgggcttgaacaattctcctacctcagcctcctgagaaactgggacgacaggtgcatgccaccatgaccagctaatttttttttatttttcctgcagatgcagtctcgctatattgcacaggttggtcttgaactcctgggctcaagcgatcctcccgcatcagcctcccaaagtgctgggattacaggcatgagccactgaatatactatttatatatcatttataaataaatatataatatattaataataaatctgaacttcataagactattcaatctgaagttttttccgttagtttagttctctttatacttaagattctagccaaagagtaactatgaaaagtaataaacaagaatcagagttggaagatagtgtatcctattctagttgcttagtcattcattgaacaaatacttacttggtcccaagtgctattatagatactgtccagcaaagaagagtgtacttccatttgctcttctctgttatggcagattgtttttgccaagatggttataacaacacctcccgttctacctgctcatcttatcatgcaagttgtcactcttcactttgagagatggggactatattccctttcttcgaatccagacaggcctgtgatatagcagtttagccatgcgacttctaaggttaggtcctacaagttaacacagattctgcctggctctcttaggacgatcagtcttggaacccaactcccacactgtgaggagactgaggccacatggagaggtgactgtgttccatcacgtgggtgtcccaggcaaaagttcagtagcatcaactcaccagccagatatgtgactatggaagctttagagaataactccattatttcagttgaaccccaaaatcatgagaaatagtaatacaataatatagtttttcctaagctgctacgttttggagtgatttgttatatggtgacagataccctgaatatctcttacctactcattttatgaacatacacgaaacttacatttcataatataatatataaaattgagaatgagctcacttcctacctattttattaaactaaatgataccatgtatatgtcattctttcaatgtcaatgaaaaaataacaaattaaattcaaagtgctttctatgtgccttttagattgttattgaggagataaatggatataaaaaatcattcaagccggtcacggtggctcacgcctgtaatcccagcactttgggaggccgaggcgggcagatcatgaggtcaggagttcgagaccagcctgaccaacatggtgaaaccctgtctctactaaaaatacaaaaaattagctgggcgtggtggcgggcacctgtagtcccagctactcgggaggctgaggcagaatggcgtgaacccgggaggcagagcttgcagtgagccgagatcgtgctactgcactccagcctgggcaacagagtgagactctgtcgcaaataaataaataaataaataaataaataaataaataaataaatcattcaagcaagaatttcaagaaaaaatggaagcttcatgacttgctggggcaaaatcactattgcctttgtttttttcctttctgtctcatttttaagccatctgactttcaaaattaccctgcaaactctggtgctcttctaactttcctctcttcatgtgtgtcaccatcatccatgcagttactgaagccagaggttttagaagttgtccttgacctctctgtctttcacatccatatccaatctatcactaagtcctgaccagttcttcccaaagaacttcggaagttttctgctttccatctcccctgacatgatctcaattcaacagaaacctatcaattgttctccccaaatttctagtccccaccaatcctttgcatcagaatgcaaatctggtcatgtcactgccctgctttcctttttttgagacagagtctcactctatcacccaggctagagtgcagtggcatgatctcggctcaccgcaatctctctctcccaggttcaagcgattcttgggcctcccaagtagctgggactacaggcgtgtgccaccatgcccagctactttttgcatttctagtagagatggggtttgccatgttgggtaggctggtctcgaactcctgacctcaagtgatccgcctgcctttgcctcccaaaatgctgggattacagtcaagagccactgcgcccggccctgcttcatttcgatggcttctcaacgctctcagagaaggagatcaaatcctaaatgtggtccacgaggctttggatcgttggactcctttctccctctccaggttcttcgtggcagcttcttgccttgtattctagccataatggccttttgtcatttccctgtgtcttcctaccttggagtctccttgactaagatccctatgcctgaaatcttcttacgtcattttctttgttaatatggttctcatttaactgtccaagcctcccttaaaagattatttcatcaaaggattcttccctaaccccagcctaagtcaaattctctgcatttttacatctactgtactgtgtcactaaaaaatataacaggaacaaaaaaccaattcataagatttcatatttttttccaccaccacaatcactaaagaaaactctcgccaggaggtagcttcatttgcattgaggatagaacagatggaagaagaggaaaagataggagtaagaggtcaaagagctaagaacttctcgggccaacggtcaggaagaacttaggaaaattcatttttatcagtgagtaactggaaagagaaacactgagaatgtaagacacaggaaaagatgttaaagcttttctgttttgcaataagatggactctcttgggtattttctgaagagttgcaataaagtttttttctgctggactgaccaagagaggggctgctttatatagtttatgcatattgaatattaatttaacaacgctgtcctcctctcacctccacttacatacaaactttatgtggtcaatgtcttgttttgcttgtcattgcaaccttggtgtttacacaattagtagtgggggctgaatcaatattgattgaattaatgtgtgatttagggcaatttgcttaacctctccagacttcaatatttaccccctcctcccacctccagaagcctgggatagcctgaaacagctaattacagttctgatatttctctggagtttctttgaagtttcatgttttgtctaaaaaacttgttttatgattcattttacaactttaatgttaatattccataccattatatgtcagtatttatttaaaattaaaataattttatctcatgtcttctaacaaaaggaatggcattgtacctattacctccagtgctatacagacttcaaaccagtttgacaaactcaaggattcattaaataatcacaaaggctctctttgagccaaaagttttatgactcttggcttctaacaagtcgaacagctaatatttactgaattccttttatgttcaagtcacaggggagaatacaaggaacaatgagatgaactgccttggagatgcagttatgatgacaagtcatgcatatgtacaaaggtaatattgtgaggcagtacagactgccaagtgagtagagcagcttgttaatgcagaagaatccaggatgactgagccctctaggcctcaatttcctcacctgaaacatgggtaaccatgcttatgcttttatatcacaggatggctatagaggtcaataagatgaaatgtacctacatacaaattagaaagcatcttattctcggagggtttcgatcacatggcaaaaccttgagatggagtaggaaacaagttgatagacgagcatagcagaacggccttcatgaagacacagaaaaagaaatataccacaaagatacaggaaactaaaaatgacaatctttatggggtggaaagctcaatcaagtgagatagctctgaaaaagcaggatattgtgggccttgaattctaagttaggaaatttagaatcactactgtagatgtcattttcaaaagataaatcccttggtacataatttggttcatattttgagacagctgggaacatttggcacagacaaaagggctattttaaatgctttgactcctttaaagaatattaaagggacacgtgaagaaatcagataattgcttgcagggatcaagtgtcaggatggtaatattgctaaaagaggaaagaagagaacatggttgtttttttgagttaaaaatgaactggcattatgccagatgtgggcaaacagaatagaagtaaatttgaaaggagtttcaatataactcttgatgcttggaggcaaaaagcaaatggccttcagcgtaatttggaataaattctagcattattggatgaacaacacatggcttaaattttaatccaaaagctcaaccagctctctaagatgaaagtgtggcattggtagaagaatgagtttttggaaaataatatagaggaaatagtacctggtgttggtgataactctatatattcaattgtttaaatgagatttttgaaagtcaactaaaaagaaaatacattgttagtatacagtattagcatttgtttaatggaagaacgtaagtgcaaaacaaatctttattttaagaagtttccagaaagcacatctcttttgcaaaatgtggaaaagcccaccagtgttgaaaccatatacctttgagtgctcttaaagatggctgcatttgaacactgcatattgtgctataatttgtgtagaaaagaaagaatacatctacttgttactatgttaataaaataaccctggaaatatacaaaactaacctatcatcttggtttgccactaggacataggagtgaaagggagaaatttcttaggttttttttttttcgtttttgagacagagtcttgctctgtcacccaggctgaagggcagtggtgcgatgctggctcactgcaacctcttcctcccgggttcaagcgattctcatgtctcaacctcccgagtagctgggattataggcgcctgccaccacgcccagctaatttctatatttttgtagagacagggtttcaccgtgttggccaggctgatcttgaactcctgaccacaagtgatctgcccgcctcggcctctcaaagtgctgggattacaggagtgagccgccccgcctggccgagaaatttctttgtatatcattttggatttttaaagtttgaatcgtatattttgtagtccaataaacagataaacaaatcaaatgacctcaaataaaatgattatctttgatatggtttctagagtttgaagttcactttattaataaataagtcaacttaccctacgtactcagatgggtaagatgataatcctttttctccagcacattctttccaagcttctttagtgtgcatcagaatcacctggggactgttcaaaacagattgcttggcctcatcccccagattctctgactcagactggctggggcaagtcccaggaattctcatttcaacaagttcccaggtgctgctgctgctggttgtctggggaccaaaatttgagaaccacgtttttgtgttgttgttgttgtttgtttttttgagagagtcttcttgctctgttgaccaggctggagtgcagtggcatgacctcggctcactgcaacctctgcctcccaggttcaagcaatcctcctgcctcagcgcccctcgtaggtgggattacaggcatgtgccactatgcgcagctaatttttgtatttttggtagagaaggggatttgccgtgttggccaggctggtcttgaactcaagacctcaggtgatccactcacctcagcctcccaaagtgctgggattacatgcatgagccaccgtgcccggccaagaaccactgttctagcagtaacatcagcaatgagtcactggtgctgtaaaacgcttcacattccatagcagaaataaaaatgtatatgaattagaagtctgctgggtgcggtggctcatgcctgtaatcccagcactttgggaggccgaggtgggcggatcacctgagatcaggagtttgagaccagcctggccaacatggtgaaaccccgtctttactaaaaatacaaaaattagccaggcgtggtggtgggcgcctgtaatcccagcttctcgggaagctgaggcacaagaatcgcttgaaccagggaggcggaggttgcagtgagccaagatcacgccactgcactccagcctggacaacaagagtgaaactccacctaaaaaaataaaaaaagtcaccaggctctagagaacgtaagcaaaacttcaaaactttataaatctaaaatgtaacccgttttgaaggtagcatctctagataaattgctttaaaaagtcttctctgtgatcggtaaatcaatgccatgcccagcactctactgttatgattactctaatgacatagaagatacccctctgccatcaaggagctttgaatctagtttaaaccaatgagtccccttttgagacatgatccatttaaatgtttgttttaatactgaattacatagaaggtgtaactcaagaagtttcgtgaaaagttttagtatctcttgtatttatttctcattaacttttacccaaattcagacctgtcaatgctggtgaagagtaaataatttgcaatttgcacatggtgaattgaaagcccatgaaaatacagatgtgggccgggcgcagtggctcacacctgcaatcccagcactttgggagaccaaggcgggtggatcgcttgaacccaggagtttgagaccagcccgggcaacatggcaaaaccctatctctactaaaaatacaaaaattagccaggtgggtgcgcctgtagttccagctacttgggaggctgaggtggagggatcacttgagcccaggaggtcaaggctgcagtcagctgtgattgtgccactacactccagcctgggtgacttgtctcaaaaataacaaaacaaaacaaaaaatagatgtgggttgaaggacaagttctactgctaatgttatgtaagcttaacttttcttatactgtttcttcatctaaaactgagtataattttaactataccaaatgtgatactctatgacaataataataaaatctaacatttattgaacatttactaataatttacatgcattaattcattcactcttcccaacaaccctataagataggtactattattatcattttccagataagaaaacagaagctcagagaggtttaagaaacatgtccaaggttagttggccagtaagtaatagagccaggattcgaatactggtcccttccgtaatcaccatgcttgctgcttttcttaaaagttggagatgaaggtagaccttttttcacctcaaacaccttagctatctttagtgggtcatataaaggggcctttgtacttttaaaaacatattgccctggtaagtttctataaatgtggagaaaacacatgtacttacctgattgtatgatatggttttttgtgtgcgcacaaggtagtgctctgtgagaccattgcatataagtctgttaagttcaggtaatatcttggctgggcgcggtggctcaagcctgtaatcccagcactttgggaggctgaagtgggtggatcatctgaggtcaggagtttgagaccagcctggccaacatagtgaaaccccttctctactaaaaatacaaaaagtagctgggcatggtggtgggcacctgtaatcccagctacttgggaggctgaggcagaagaatcggttgagactgtgtctcaaaaaaataaataaataaataaataaaaccaaaaatcaataccaaaatgcctatcaatcccaacactttgggagtccaaggcaggagaatcacttgaaccctggagttcacaatcagcctgggcaatatagtgagaacccatctctacaaaaaacaaaaaagttagctgggtgtgagtgtgatggcacatacctgtagtcccagttactaggaaggctgaggtgggaggattgcttgagcccaaaaattcaacgctgcaatgaaccgtgatcgcatcactgcagtccagtctgggcaacagagtgaaactccgattcaacgaaacaaaacaccaagaggaactctggaaaatatgtaaatatatggaaattaaccaacatgctcctgaatgaccactgggtcaacaaagaaattaaggtgggaataaaaaaaatttctagaaacaaataatggaaagaacatatcaaaacctataggattcagcaaaaatagtgctaagaggaaagtttatatcaataaatgcctatgtcaaaaaagtggaaatgttacaaattagcaatccagcaatgcacctagaagagctgaaaaagcaagaacaaaccaaacccaaaattagtagaagaaaatagataaataaagatcagagcagaactaaatgaaatagagaaaaaaatcaacaaaaaggactggtgaaaggaaaaattggttctttgaaacgataaacaaaatcgataaaagtagactttattttttagggcagttttaagtttacaacaaaattaagcagaaagtacagagagttacgatatgtctcccaccttcacgcgtacataatctctcccataatcaacattccaccctcaagtggtacatttgttaacaatcaatgaatctatgttgacacatcattatcacccaaagcccatatttaggattcactctcgatatggtatattgtataagttttgacaaatgcatagtgacatatatcctccattgtagtatacagaataatttcactgccctaaaaatccttgggctctgcctattcaccccctctccccacataacccagtaatattttttctttttcttttttttttttttttagagaaagtctcactctgtcattcagggtggcgtgcagtggcacaatctcagctcactgcaacctccgcatccagagcaagagattctcatgcctcagcctcctgagcagctggaattactggtgcccgccatgacacctggctaatttttgtattttttagtacagacagatggggtttcaccatgttggtcaagttggtctcgaactcctgacctcaggtgatctgcccaccttggcctctcaaagtggtgggattacaggcatgagccattgctcttggccataaccaagtaatttttaatatgtttttcttatacaaataatatatagggaggaagaaatattttcatctaaataatatagtatggttaagaatgtttgcttagtatagacatgaaactaattatcaagaatgtcagacaagtctatcaagcagtataacttcagaatgataggataagccttcatgtgtcttgtacttaattcgtcctcttctatgcttaggtaaagatttcttaaactgctgtttaaaaacactaaccacaaaaacaaaactaataaatacgcaagaactacccatcaaaagagaatgagaaggcaagccacagccacggagaatatatttgcagagcttatatccgtatataaaggaaacctacaaacccttagaaaaagacaaacaactgaattttaagatgggccaaaagactcgaatagatccttcccaaaagaagttacccaatgggcgtaatggaatgagtatatgaaaaagtgctcagtctcttagttatcagggaaatgcctattattgagatgccatgatgtacccatcaagatgatgagttaaaaacaaaacaaaacaaaacaaaaagcctgaaaatacacactgttggaaacaatgtggagcgactagaagtctcatacgttgctggtgggggtataagttggaaagataactttgaaaaatagttttgcaggattaaactaaagctaaacatctgtatacctcacacaaggtacatatagaagagaagcaaatgctttcgtccaccaaaaggaatatgcaagaatgttccaagaatgttcatcgcaactatattcatcataaaccaaacctgaaaacagcccaaaagctcaacaatagtagaattggtaaatgagttcgggtatattcatacaatggattctactacaagcaacaggaagaaacaaacaattgttgcatgttagaaaatgtgtgaatctcactgaaaaatgtttagcaaaagaggccaggcacaaaagtacctactcgtgtgtgtgcgtgcgtgtgtgtgtgggtgtgtgtgtgtgtgtgtgtgtaaagttcaaatacaggcaaaatgatggtgatgaaatttagaatagtataacagtaattgcttcaaagttcaaggacagggaacagtaacggggaagagatgtgacagagcctttgggatgctggaatgttctatatcttgatttaagtagttctgcaccaatgaatacacatgaaaattcatcgggttaagattcacgcactttacacctgaataaaaaagaaaacaaagtcattctgtttaatataataaaatacgtatttccacgctaaatattacgtttacagctttgaaagattaaaagactgaaaaagtactgagtattaatctaggcagaagggtctgactgcctttgctaaatatggaattggcttggtaaaattacactttacccatgcagtggtgtgcaatgattccatcagtgggacacttggaggaaaatattattgaataactttcacccagtgaatatgctttttgttaagagacgcttgcttctaattgctttaaatttgtgagtcagaaattggaggaagagggggtggaaccattccccacccttctccccttggcacccctactgaccacagatctttcgctttgattcttattagaggttttctgtccaattttatggttttccgcgttctaaaacacacattgtataaataaatgacacatgcttagggcttgcagatgcctttagatgtttctcaaacttccctgtgggccagttctccaccttcctggtgtttgggcttgaattcacagtcaatagttggaattttactttggactttcatttgtctattgtcccagtggctctaggtaggatttgattaggattagcccataggatttcagtaaacgaattttagaaattgttggaaatgtcacatccaccaaaataaattttgtatgatgtccctaatgcatgttaataatccgttggtatatcatatgctgcattctgtaaaacttaactggaacatatcaaatataattggtaaaggtagaattcagtcagctcctaccttcaagttcaaggatacatcctgctggctaggcagaaaagagaggctgaaatttctgcatagcagcttgacttaaggtttctgcaaagacagcacactagaaatgataacgaatgtttgcaagctctttcttcacttaccactgactacaccagattaggaggagtaaaatatctaggatctggagaagatggagccttatgttatcttgatgtacagtatcagatgcagattagggctaagggcttacgtggtgaaacgtcattctgagattgtaaatattctcccactgctcacccagccatgtgcaggacgtaatagtttctaattgctctgagtctgtgggctcctgagtcctcattcatccatccgagctggggttttggtacagagacaatgatgataagaagtactttcttctctttgtccctgcagacggttgcaaaatgaatcttttcaggattttatcatcggggtgtcaggtcagatccatgaggcaggaatgtcaagttggctaaaggacattctaaagtgaatttattaaaatgattctaagagagaattaaaattgtgctaagaaatttttttttactgggtttacacaaaaccttcatgttggtagtcatttacctgtctttgaaaagtagaatttcgagaattgaaattgctagtgtgtgattccttagtcaattttctttacaattgccttgatttctttcctccatgactcatttctttctcttcagcttagagatactttgtaaagtgtgattaggtgttaagtgtgcggattctagagccaaggtaaccgaattcaaatcccagcctactagctgcatgatcttaggcattattacttaacctctatctgactgtttcttcatccgtcacaaggtgggggtgattattataaaacctagtcacggggtcactggtaggatgaatgagtaagtagagataaagctcctagcacagtgtctggcacgcagtaaacactgcattaaggatcaactttatctctgttcttgttgagggactcccctgtatctttcactgcatggcttggctcttcctgatgctctttctttcccagtcttaactccatggtttgctctacatcagcgtgccaactttgtttatttcttggtatagtttattcaaaagttttgaatcctaaaatctgggtggtggagaaggaggagattattattgaccttcattacatgcctccaaagaccttggtgtagtacgttaagactgtcacttgccaagtgactcattcattacccaatactgtcacgcactagtcataagacaattggaagggacagatgaaaagaacagccatctactttaattgctatgttttggaaataatgtataatattaaaaccacaactccaaatcataaagcctaaggtttggaagagaccgaaaatcactcagcctaaccacccaagtgatgcttgtgtgtatttgcaatattctgtatggaaggttcagcctcagttaagtatggtgatactcttatcaactcaagaagcagtttatcttttagatggctcggattctttggaggatctttctaactttagtcaaaattaatatactcacagtttccatctattatgtattttcttttattaatttactcttgaagtcttatggaataaatgttatgcatctttccattaaaagccctccagatatttgctgactgctagcatgtttcttctggagtcctctctggatattccagtcgagctaaatattactcatcttctccaatgtggatggtctgttctgaatgagctatgatttcttaatatccttttaatgctggtcccaaattgaacccaatactccatatatagttgggtaagctcaaagtagttactacctgtgtctactattctagcttctagatggttatacttctattagtgaactccaagatcatattagcttatttttggtagctacgtcatatttgtgaaaaatattgtattaattttgtccaaatgactttttccgtgccctaagacagacctaaccagcagcttattctttggagtttccacagcattttgtatggattgctattgtaaaacaaaaccaaaaaatttatctacagttatacactgcatcagaacatcttggtcaatggtggaccgcatagacaatggtggtcccataagattataatactatatttttactgtactctttctatgtttggatatatttagattcacaaatacttatcattgtgttacaatttcctgcagtattccgtacagtaaatgttatacaggtttgtagccatctagatttgtgtaagtatactctacgatgttcacacaacagcaaaatcacctaaagatgcatttcctagaatgtatccctgttgttaagtgatacatgactgtatattataatattgtgtttctattctaactattttattgtgttcttgcatttgactatgaactctgcataggtaaatttttcattattttgttgtagtggctaataacccatctgttactcaaaatatgtttgtcaaataaatgttgaactaatcccttgatagagcattttaaggtaactagttaacaaagaccactgcaccataatgtcatatgaaaattttgatatcagaggcccacagagattgatagccccatctccttttctagagtcctacttatacctaaaccatccagctaaaggtttgtagaactgaggtctaatggacttcaggaaaggggattattaaacccagtagcttagtcaagtgcatgccctatgtacgcctctaactatacaaccattggaagtattatgcaagagtgtggctagatcactttgcagtcagcactcaccatggcaaagcaatcagctttagaagacagaggccatgtgcgagcctgttccaaggaaacctgatcctggaaacttgcagtgaattcggctgccttggcagtgacatctcatctggcagcctggaacaggaaaacttatttagagaacaaacatgccttttaggagctcgcagtgagtccgatcttaaactgaaaactaggggcctaggagattatggttctgtttatgttgtttgtgttttacatatgctgcgtatcctcccttaagtggtctttggttaatacatattcctggctaacagttgctgtattgaacacagaggaacagacacacctctagaccttcattcttctggattttgcaaacccgatagtcaatttccagctcagctttgatagtaatatttccaaatgataaggaacaggaaatgtcgcaacaagttctcctgacaatgaggtcctgtgtgcctaggttttgtagaacatactgaaaaagtaggtggccatgtctttgatatgctttccaaggtgcatccaactacagtctccttcctttctgcccagtaattcccatcagtgaacttaggcccaaaatcaataaagctgttttttataaactattattaaagggcatttccactacctgagaaggaagggaagacgttctagctcacccttattagcaccgtaggaggcactcgtgaatcaatacctgaaaatgtacaagtcccagacaatcagtgctcagagcgagagcgggcagtggctgaacttggccccaggcccacctatgaagcctcccgaagacactgaacagcctgatgcagagaatgccaagtactggaggggcggatgcaaaggttccagaccaagctcaagggtgttccagtgcgctggccagcatcttagggaggaaggggtaaaggaaggaaaagaagcctagattcacctacaatttgatctgtgaggagtgttgtttatgagcggcatcctttgcaaatatagctttggagggaaaacaaatgcatgctataaatttccagtaacatcctgcctgaggtagactcagtcactctgtaagaccccactgtgcagacagggaaaagagacataactgcagctgattctgcaaacagtggccacagtgtcctaccaagatgacagaacagaggtcacagccaccctctaaagggcctcgggtctggcacccaccccctcgccaccgccttcttgccaaactcataaacacccaagctggaaaaagctgacaatgtatcttcctctcccacccctgttggaactttcttggatgaaccacttcataaactttccccctcatgcagaggaagacttcttatattttttttctcttactttaggaaatttgaacaaaatatttttttcaggtaaaatatacaaatatttatttttaaatatttgcatgtcaaaatacactcaggcccagaaagtactcttaatgggagactcatcagatcttggtattgaaggctctgtgttttggcaggttttatttatggttatagaaaaaaaaaaggagtaactgaaaatgaaaatggttgaatagactgccccacaatttaccaatttctttcttttattttctttttgctctgggcctgagaccagcatggaaaagttttagcttctaaatagactctttcaggaagatttgtatgctgatgaagatggtgtaaagaaaagtagtgtaccaccctaacttgagcttttttttttgagacagagtctcactctgttgctcaggctggagtgcagttgtgctttcttggctcactgcaacctccacctcttgggttcaagcgattcttttgcctcagactcctgagtaactgggattacaggcacccaccaccatgcccggctaatttttgtagttttagttgagatggggtttcatcatgttggccaggctggtctcgaactcctgacctcaagtgatccgcccacctgggcctctcaaagtgctgggattacaggcatgagccgctgcgcccaggcacttgtgctttgattaacattattttcctgtgaaacaaattaaagtgatcaatgagctccagggattcatttttaattaaatcatgaagcagctggcattcatggcctcttggcaggtagtccagcctgggcttgctgactggaggaatgagagtggggaacttaccagctgtctaagcgtcttggttccaggtaaatgatacttatcaggctgttgaagaatttagggagcacacctgatagataaatctgcacacagctttattgaattactcttttcttgctctgtttcagaaaactgtatgagaatataaatccaaacttttcacataaacttttatcgcttttaggtttgttcagaaagattgtccttgaactgaaatgaacacatcaaaactgctcagcttctctgaatgggaagtattgagaaatgatctttaaactttgcggtgaatcagatttatttatggaactttttaaaaatgaagcagcccaggcttaaaacttggtatgaaaaccagccttgagagtaaaatacccagttcctccaaactcctagttcctctgcgttacttatcctaccgcgtggtgactcacatacaaacaatatacagatgttctttgaacctggatttc

SEQ ID NO: 776 - DNA, 9686 bp, Homo sapiens
acttaagaaaagtccattctgacctgcatactgcctcttgcttccaagatcaatgacagtattctcatctcctttatcaaggaactggacttcattctcctgcaaaagctgcttgatcttgacctgttgctgtttgacccgggtctcaagcaggcgcacctgggctctgagccgcatctgctcctgggcacagtcctcgagcgcctgcaaaacaggtgagatgagatgagtatgcacctcattttcatggaaaacaagtgctttttaaacatttggataaatcagtgattccattttgtctccagttcccatttcagaatattattccaaagagaaagtggcttgaaaagttctaatactgcctactatttgaagaattggaaattatggcttatgcgaaaactcctggactcaaaagatcaaataatataaaataattggaatcgctatgctaggagctttatagttgtctcctttgatcctcataacaattccatgcggtaggaaagggctcagtcttgatgcccagtgggtaagcggaggtgggattcaaattcagttcaaggactgtgctctcaatctctatatgacattgcttatgtgttttctaaacagtaatgtggtttatagaagttaattgtactgttggcatgtaaatctccataataaatgaggtttttgaatggctgtctggtataaatacttttaaatatgtatatttaatgtatattatatattatatatattatatatgcatataaataatatataatatatataatatataatatattaaacaatatataatatatagtatataatatattaaacaatatataatatatcatatataatatattaaataatatataatatatatcatatataatatattaaataatatataatatatctcatatataatatattaaataatatataatatatctcatatataatatattaaataatatataatatatatcatatataatatattaaatatataatatatatcatatgtaatatattaaatatataatatatatcatatgtaatatattaaatatataatatatatcatatgtaatatattaaatatataatatatatcatatgtaatatattaaataatatatatcatatataatatattaaataatatataatatatatcatatataatatattaaataatatataatatatatcatatataatatattaaataatatataatatatatcatatataatatattaaataatatataatatatatcatatataatatattaaataatatatcatatatatcatatataatatattaaataacatataataatatataatatattaaataatatataatataataataatatataatatataaaataatatacaatataataataatatataatatatattacaaaatatataatatgaatatatatgaatataaatgaatagatattatataatatataaatataaataatatataatatattaaatatatttatatataatataatgtaatataattgtatttattatattatagtctactttatataatatattatatttatacataatatacgtatatataaaattacataatggatttatatagtatatattatatcaaatacatatgcatatataatacatttatatttatatagtctataatatatatatattttttatatatatatatatgtagtacatctcccctccctcccatctctaggtccaagtcatggaacctctcccagccatttttctaggatggtttctcccttttccttccccttcccctttcccttcctcttcccttacgtttcctttctcagaacctctcccagatatcttttctaggatgatttctttctcctcttttctttttcttttcttttgttcttttcctctctttctccttccctccttccctcccttccttccttcctttcttttctttcctttcttcccatccctaggtccaagtcacagaacctctcccagccatttttctaaaatgatttctttctcctcttctttttcttttcttttgttcttttcctttctttctccttccctccctccctcccttccttcttttcttttctttctttcctttcttcccatccctaggtccaagtcacagaacctctcccagccatttttctaggatgattccttctctctctctctctctttctttcaacagagtcttgctctgttgcccaggctggagtgcagtggtgcgatctcggctccctgcaacctctgcctctctggttcaagcgattcttgtgcttcatcctggcaagtagctgggactatacaggttgtgtgccataacacccagctaatttttgtatttttagtagagatggggttttgccatgttgcccagtctggtctcaaacttctggcttcaagcgatccacccacctcggcccctcaaagtgctgggattacaggcgtgagccactgcaccaggcctctctaggattacttcttatttgttcttgttactctatccctaacactcagatttatcccttctgagatagttatttgcttagcaccttgagtcacataggctaaaaaatgaacagcaagaacattttatggtgtctgggtcctgagttgttttacaacagtgggggatcggttgtgatattgttaaacatagtgcactatgcaattttaaaataattgaagacatcacaggtcaagtatgcccaatctttatgagattgcatacgcatatttagtaagcttatttaaaacctaggagttttctttctccaagaactttgaatgaatgttttgtcttttttattcacaaatgaaggacaacacaagttcgatgtaattactttcaaataatctggttagttttacacttttcaatattgaaaagctcaaggttaattttaattactatggacagtttcaaatttctaatattccaaccaaataactccagtgaatttttaaaaattacttatttattatgaatactttttatttaaaaaaatgtaaagcactttttttttttttgagatggagtctcactctgtcgcccaggctggagtgaagtggcatgatctcagttcactgcaatctccgcctcctgggttcaagggattctcctgcctcagcctcacgagtagctaggactacagatgcgtgccatcacgcccggctaattttttgtattttttttagtaaagatggggtttcaccatattggccaggctggttgcgaactcctgaccttgtgatccacccatctcggcctcccctgcaaaaatgtaaagcgctttaaagtgctgctttactatgtgtccagtatttctaccagcctctttgcttttcccacatagttaagttttttcaatgacaagtcactataggtttaatgcaaaatgaaagaaaattcagataaaagcaggcattataaatatgacaatagttttcccaagaagcttaccgaaatttccctgcccattgtcagagcggtggtaacaaggatgaaactgaacacctttgccatgttcccccttgaaaaaactgcaagaacaaaaagaattttataaatgtatcaaccttgaatttttcatgagaccagagttcagacttcagtagctccaggaagtcggatgcagccgcaggccatccctaatcttagagtcgccgaggaaattctcccagactttcccagcctctcaccacacagaatgacactgagtgttaactagaattgaatctgtttcatcacaaaaacagaggaaggactctggttcttttcgctatcctaatgtgctgtttgtgttatgctgtggaaaggcacaggagcattttaatcagttatttaatgttacacatcaaggaagtggcgtagtcaaaatctgcacgctggtctctgcttatggagcttgtgtctttttctccctatgttgtgaggctggtctcaaactcctgggcttgagtgatcctcccgccttggcctcccaaagtgctgggattacaggcgtgagccactgcctagagtaagatttttgaaagcaaaggtcacaccttgctaattttggtatccctagcatttaattcttgtggtgaccccaataactgttgttgcttctacggaattattcctcaggaggcaaaatcgttctcagagggaaaaatgtaatttccttgctttaaactacagtctgtttatactgacatactttcctcttttactggaaaacaatgggctaagtatagttttgaaggtaagagttaagaaggagttggggacttttggtttgattgaacacatgaatttaattttttccttctcacaaagcccactagaaaatgagtgaagaaaaagtttaaaagatgcgaactgacaaagtcaaagagaaagggaaagaacagctagtgtgcaatgtcagcaagttggtagatgataaaaaggcatgtggggggcctggtgcggtggctcacgcctgtaatcccagcactttgggaggtcgaggtgggcagatcactcgaggtcaggagctcgagaccagcctggtcaacatggcgaaaccctgtctctactaaaaatacaaaaattagccaggcgtggtggtgggcgcctgtactcccagccactcgggaggctgaggcaggagaattgcttgaacccgggagatggaggttgcagtgagccgagatcgtgccaatgcactccagcctgggtgacagagtgagtccctgtctagaaagaaacgaaatgagaggagaagagaggagaggagaggagaggagaggagagaagagaagtaggggaattggcaaagcagcagtagagaggagcaccatgagaagcgagagaagtcacagtgtagcaccctaggggattctggattggaggcactgctagcttggaagtgaaggtagaggcaaatgggctaacagtcagatcctcatctaaatcctgtgcagccaggtgaatgctgcttctcgtaccctttcagaatatggaagatttactttctattaagattgcccagagatgctccaggtgacatgacagcagaagtgctggaggggaggagagagaccctgttcaaaaagggtgaggctttcccaggcttcttctcttgcagccaggcaaccggctctacactcttcctaccactttccaggccaaagaacataggattcctcgctggaggaacagcagagcttcaccgaaaagatcttcagagactgacattggaggattctccatcaaaggaggcttttccttgactgatcgctctccaaagaatcccaccagttgggaagcctccttcatgcacctgggagaggtataaaaggtataggcacactattctgcttatttctttcaacgtaagtcttctttctgaagagaggcatattttacatttcattctctgtccacatcaaatggtctaaagagaaacaccaaatttctgtattacaacactgggcagaaattcatatgatagcaattagtcatgacttaaccctttcacccaacactgtgaacaaaataaccaagatgggccgggcgtgttggctcacacctgtaatcccagcacttcgagaggccgaggcgggcggatcactgaggccagcatggccaacatagtgaaaccctgtctctataaaaatacaaaaaattagctaggtgtggtggtgggtgcctgtaatcccagcaaattgggaggctgaggcaggagaattgcttgaacctgggaggtggaggttgcagtgagccgagatcacgccactgcactccagcccaggtgacagtgcgagactccatctcaaaaaaaaaaaaaagtatctctagacccatttttccattaaagttatccttttaaacatatgatataatttgtagcaacaatttataagaactctggcatttcactctttattttatcttagtaaatattttttctttaaaattcaattgtatattgagtatgtacctatcttaggcccagtgatagaaatagtagtcttaggcccagtgatagaaatagtaatcttaggcccagtaatagaaatagtagatgtttttatatgtaatgtattaaatataattgattatattaaaatatttgcttatgttaaaaatagagaaaattaactttctgatatttaaaacatttaccaatgtgaaaaagagacaccctctgtgtatttttataaaagataaaatggggtgagaataggattgcaaaggaacagaagtcgtgaccaaattagaagaaaagatgattaggtttgctatcaattaatattcgctaattaatataataagcttggaattatttaaggaacacttttctaggtcacatttattattgtcatgaaaggtaaaatcattttctttaagataaaaacattgactgcactaaagagtcatcatttgcaatgcagtagtgtcctaaatctcttattcccagatgtcaagattatgtctacaaattaagaaaatttcaagttgaaataagtattctaaaccgaagacatctgatgttaggagcaaatacattttcattccgatcctgggggtagtttcatgttttcttttgtttttctttttttgtctgagggtccttgggaacactccttattcattgtggctgaattttttcaacatcagcattgaatactacaaaggattgtatcagatataaatcaatagtcaataattttattaagaagtaaaaaccatccatttaaactgaattacagtgggaaaatatatttgtaaagaaggcttagaaaataaacaataacaataaactagaatgagattatttcaagcatatattttctaactattcgtaggtaaagttttaaaaattgaatggattctagtcctctaatccctgtcactagaaaatgactgacctacagcatgctttagtatcttttcttcacaataagagaataatattttaataatgacacacaataattgctaaacaggcttgatgggacagtaagcgtagttccacaaagatgccaagcagcctgcgtggcctggggcattatataaaaatgagctagccattcaagtagaatgtacctctgcaaggctgcaatattacttacattaaagggcccatcatcaaggggacaagggctatttccccaagtctaacgtggattggaaaaataaggaatactcatctgaaaccatattgtgtttgtgtttgggcatcactaaacactctgccgaactttggctgggcgtggtggcttacgcctgtaatctcagcactttgggaggacgaagtgggaggatcgccagaggccaggagttcaagaccagcctggccaacatgataaaactccatcgctactaaaaatacaaaaattagccaggtgtggtggtgcacacctgtaatcccagctactcgggaggctgaagcatgagaatcacttgaacctgggaggcggaggttgcagtgagctgagattgtctcactgtagttaagcctgggtgacagagcgacactccacctcaaacaacaacaacactatcaaaacactatcaaattttaattggccattttattttatttcattagcctcacagtgaaaataagaaaacaagcacaaggatgcttatgatttctccaggaccattcagcctctggggatatcccctgggaatatctcccaaatctcctgaacctctttctttattgcctggttaatcctttcttactgtattatgttgaactataagaaatggcagatgtttgaacatttctgacttagaaaaatggcaatttcattgtttcaaattaatgcatattgtttagataggaagaacacacttgaaaatcattataaccatttatactacaatgaataccaaaaaaataggttcaaaatatactgtttgcagcttacttgatcagagagagaacaaattggcaagaacctgtttttatatcaatgctgcctcccatgttaatacattaatgtgtgccatttaaaatatgtttacaaaattgctaatacatcatcaacacatgaaatctcacgatgtctttagaagacacattatgtttactttttactaaaggaagctcaaatagtgaagcaaagtaactttcctaaggaaagactctacgttcaaaatttatacaacatccaatcatttctcaccacctctattgctaatgtctggcccaagctaccaatggaagattccaaacaattttttagaattacaatgagacaacattctatactgagcctttcctgggcaaaccgggatatttggtcattcaccgacaaagctttacataatctgtgagcatccacctcctcaacacatctcttttcccatcatttttgcctgttctggctacattggcctctttggcatttttggaaaaccctgaaatacacagacttctcagggcgattgcacttgctgttctctctacctggaatgctcttctgaaaatctctgtggtttgctccatgacatccttcaggtctttgctcaggtattcccttcccagagataccttccctgactaccacatataaaataacagctgtcccctactgtcttagtccattctcattttataaatttacccagtaaagatctgcctgagactgggtaatttataaaggaaaaaggtttaattgactcacagtttgccatgactggggaggccccaggaaacttacagtcgtggtggaaggggaagcaaacatgtccttcttcacatgatggcaggaaggggaagagccaagcaaaagccccttataaaaccatcagatctcaggagaactcactatcacgaaaacagcagcatgggggtagctgcccccatgattcaattaccttccactgggtccatcccataacatgtgggattacgagaactacaattcaagatgagatttgggtggagacacacgcaaacaacatcacccacacacttcatatctctatcacaatggattcagtttctccttagcacttatcaccaaatataatgaaatattataatatatgtgtttattgtctacctactccaaccgccctgtacaatgtaagcacgaagaggtgagtggctacatctattatgtatactgccctaatgctaggtggatagttaggtactgtactagtttcttgaggccaccataacaaattaccataaactgagtggcctaaaacaacaggagtttattatctcacagttctggaggatacaagtccaaaatcaagaagaacagggccatacttccttcaaaggctctaagagaaaatcctttctggactcttctagcatttggtggttgccagcaattcttgacatcctttgacttgtggcagtatcactctattctctgataccatcttcacatagctgtctttcctctgtgtgtctctgtgtctaatttccctcttcatataaggacatcggtcattggattagggtctgccctaatccagtatgacctcatcttaactcagttacatgtacaaagaccctatttgcaaatgagatcacattcacaggtaataaaagttaggaatgtacatgttttgggggcacagctgaacctagcacaggtactcgacaaaatatctactgaatagat

SEQ ID NO: 777 - DNA, 19611 bp, Homo sapiens
attcaatactctttgattttctgctacaacatttccttgagactaatccaactccaccagttttatacatatgaagtagaatccagactgatgaactggttcttggagctacagatactgtagttttcaagttgcctttttttttgcttcagatgagagctgtgcacctgcgtgcgtgcgcgtgcacacacacacatacacactcatatactgtatatatgttcaaactggaaacccagaatttcaggaagggatgcattttaatagccattgtgttagggttatacaggtattcatccagcaaatatttttgaacacttatattttactgtgcattttgctaggcactggaatatcacagtaaacaaaacagcagtcttcctctaatgagcttacactgaagttggggagattacaaatcaacaaacaagtaaataatataatattaggatatgttaggtactgtgatgaaaagtgaagctgataagggtatagtggtgacttagggtgctgatttagagtttggtcagagaaagtctttctgaggagctgtgtgaggtttgttactatctagaggcacagaggagattcagcccaatgaagatgagaaacgctcctggaacacattacccacattttctgtaggacactgttttgtcaaaatatacatatatggctaaatagtctgaaactatggattcagtgaagcaaacggtatgtgcccatggaagagttataccaggaaaagaaaataattcattacagttttactggcactctgaaaaggaacaggagctgtgaagctgctgaggactaaggctgctgctatctgtggactcaaatggagaagcgtctatgaaaaatgctggctgcaaggggcacattatataattctatgtgtgatatcctaattttagaatgaatgaactaaactctttctgagtatgtttttgtattagcacaaaaatgcctgggaggtgaggacacctaactacagccattggctgttcttgggcattgccagcagagaggaacagccgcttttacctttcatctgaactggttgactttttttttaaaaaaaaaaaaacaaaattaacacattaatctctttctttctttctctttctttctttctttttctgtctttctttctctttctttctttctttttctttctttctgtctttgtctttctccctctctttctctctctctctctctctctctctctctctctcctcctttcccttcccctcctttcccctcccttccccttcccctcctgtcttgaaagatacccaccagtcaccatgatgctttctctaaacctggtgtacgttagattgagagctgaggaatcgcttttctcagatatcttatttttcaagtctgagtaagaaattgaagaaatgggaataaacgttttgtgtatttgtttgtgacattcttgaggcctgggttgaaattccaagggacagtttttaatgtattccttatagaaaaccttttttttcttttcttttcttgattcttggaggtagggggaaagttgtttgagcaggaaagaagaaaatggggtgatgacattggtagttaaagcttaccaactttaataatgaaaacagagccagttggggtggtgcacgcctgtagtcccagccactcaaaaagctgaggcaggaagatctcttgagcccagcgtgggcaacacagtgaaaccccattaaaaaaatagaaaaaaaataatgaaagcatattgtgaggcagagttgtctgtgactattgggactttttcatcaccagcagcctgcagcatttctctggggaagatgtgaagatatagccactctgtcctcctttggaggcactgggtaccatatgtgtatatatccctggctttggaagcaatctgggtttgaatcctagctttacaacttgcagactgtatgacttgtcttgactctttctatttccctatctgtaaaattaggtaaacaatagtgttcatctttgagacgatcctgtagggcacttagcataatactaagcaacatggagagggctcagtcaaagttagctctcctgactgcctggggcatggagaggagagttctgcctagcatttctgagatatgcatacaaatcgatggagataatgtacattgacaattttaatgagcaaagaaataaaaggtacatgttaagggaaaagtaaaaaaggatttcaagtctatttgcacatcttcaattttccagtgaccagggagggcaagaaggccaagcccctttgcttgtacttcactccccatgacacgggacaggtggcagctctgcagtggaagtggcagaccagaccaaaaaattcatgtcaaaaccaggatttctgtagatcagggatttccggtttttctgcctgaacttaccaaatagtaaacgtttatctccttttctttctttctcccttccctccctccccccctcctttcttttctcttctcttctcttctcttctcttttctttcttttctctgagacggactgtctctctgttgcccaggctggagtgctgtggcacaatctggtctcactgcaagctccacttcctatgttcacgccattctcctgcctcagcctcccgagtagctgggactacaggcgcccgccaccacgcctggctaattttttgtatttttagtagagatggggtttcaccatgttagccaggatggtctcgatctcctgcccttgtgatctgcccacattggcctcccaaagtgctgggattacaggtgtgagccatcatgcccttcctttcctttcctttttcctttttcctttcctttcctttttcctttttcctttcctttcctttcctttcctttcctttcctttcctttcctttcctttcctttcctttcctttccttctctctctctctctctttctttctctttcttttcttttctttttttcttgatctagactttgctggaatattcttttttgtttcattttgttttttctttttttgagacagagtttcactcttattgcccgggctggagtgcaatagtacgatctcggctcactgcaacctctgcctcccaggttcaagtgattctcctgcctcagcctcccgagtcgctgggattccaggtgcatgtcaccacatgtggctaatttttgtatttttagtagagacggggttttgccatgttggccaggctggtctcgaactcctcacctcaggtgatctgcctgccttggcctcccaaagtactgggattacaggtatgagccaccatatctggcctttgctggaatattctaaacacacattaaaaacagttttaatgtgagatttttggagaagagacaggagagtgtggtggctaagtaagtttggatcagacaacatggctttgaataacaattaacctaaaaaaaaaaggctctgggaccctgttttgcttgtctataaattggagatgacaaaagtatcttcctgatgggatcagaaatacatgggaaaattacgtaaggcctatagtacaatggctcacacagagtaaagactcagtaagttctggtggttattatgaatggcttatggacaagtgggtttttttttttttttttttttttttttttttgagatgaagtcttgctctgtcacccaggctagagagcggtggtgcgatcttggctgactacaacctctgcctcctgggttcaaatgattctcctgcctcagcctcccaagtagctagaattacaggcacttgccaccatgcccagctaatttttgtatttttagtagagacagggtttcaccaggttggccaggctggtctcgaactcctgacctcatgatccgctcgcctcggcctcccaaagtgctgggattacaggcatgagccactgtgcctggcctgaattttttattgatatgtaatagttgtacatattttatgtagggaaattattaatgttcattatgtcaataggatataaatgttgggtttatagaaaaaaactttctttcatcttgcctaaaatgtcctgagactctttaggacatatactgaattgctgatggttattaataatttttagagtttttattttaagaaaaaaatgagaacaaggaactattataggctaattgtatctactttttttgttttgttttttggagacaggatctcactctgttgcccaggctggagtgcagtggcacagtcatggctcactgcaacctctgcttcctgcgctcaagtgatcctcctacctcagccttccaagtggctgggaccacagctgcctgtcactgcacctggctaatttttgtattttttgtagagacaaggttttaccatgttgcccaggctggtctcaaactcctgggctcaagagatactcccaccttggcctcccaaagttctgggataacaggcatgagccactgtgcccaaccttgtatccacttcttaaataatttattctgctatagtttttatgattttatctttagataaaatccactttattttttgaatcttgaatagcaagggagcagtctgggatctgcccgccctgctagcattcttcctggatgagttgaggctggaatcttaaactctctgggccttagtgctttagttataaaataacagggttgaagtagctctctgaggtccgtttcatgaccaaatgctatattgctgtaactatcaagggctggctgttctaaatagattatgttttggtagcttatagcagtggatcttaaccagggacatttccagttcttatgagacatttataaagcttgtggacatgtttttggtggtcattacgatgggaggttttatcatctataaatttcatttcatttcagaaatgaaatgaaattatcactgctttaaagagtagccaatgatagtggttttcaagcctataccctgtgtccctttttactgtgtaaaaaagccaatgatagtggttttcaagtctgaaaacaaagctttactttggttaaaagggacacaggctataggcttgaaaaccactactttaaagggtagtaaatgataacagtaacagctttactataaaaatattttgatgatggtactgggttgttagattttggattagagaatacaggaagcagtgatgctaagggtttcctgaccttgtgtttcagtgtgagaccctaatgggctggaaagttgaaaacaggaccagaggctgtcatcaatcacagtttagaaaaacaccctgttggggcctcttactcctggatatttctagctctcttgtacccagggcctctgttgactctggggtctgctgggctggctgactggttttctgctggccacatagcctctgtttacttctcccggctgcttgtgttcacaggatgtccttgttggccagcacattcctgtacaccttctggacttgacgtggggaggcatctgcagatggcctccctaaagaaagcatgttttgcagctgggtgcagtagctcatgcctgtaatctcagcactttgggaggctgaggcaggtggatcacctgaggtcaggagtttgagactagcctggccagcatggtgaaaccccatctctactaaaaatacataaattagcttagggtggtggcaggtgcctgtaatcccagctactccggaggctgaggcaggagaatcgcttgaacccaggaggcagaggtttcagtgagctgagatcgcaccactgctctccagcctgggtgacagagtgagactctgtctcaaaaaaaacaaaaaaacaaaaaacccaacaaaaccaaacaacaacaacaacaaaaacccatgtttttttcaagcttactgcctttaaaccatttggcagtactctgtggagcctttggtgattgcaacagcagctcagttacgttttccctgagagtatgatatcaacaacaataatattatttaaagtggtatttatatttaaaatgatggtaaggataacagtaataatgaattttattagtacataatatgtactgggcactgtgttaatgcttacaaaaacactgtgaggcagagtgtcttaatttttatgtgggaaaggctcaaagagttgagttacttgccaaaggtctcacagctactaagcaatggaggcaggatttgaatgcatatcggtctcactggaacacctatgccttgaatcactctgttaccctctctgacctgtgcgtaattcttaaaccgctgggtacagagaggtgatgcactttgggtacagagaggtgacgcactctggacatttctgattatgtgtttatcctaatgaaaaaggcccaattgccttggcatgcgtcaaacccagtggaagagttattgtgggtccccaagggccctgcacgtgatggctgtgggccctcaccctgaggctggagcaggcggcctttcctccagtagacgaagaacagcagccgaggccaggagaaaaacatgcctctcctgaggattagctgcctggagcctttcccacatatattttttcctctggtagaggttcagagctataattcctgttcattccagtctgaaagttggcagtttgatcaatgatttcctgtgccttgatgatgaatggctttcgtatttaaaagataaatttgtattttgagggttcaatgccctttgatttctttataatggaatttcattcaaattggcttcttaactgtgacctgttccaggggctcttggccaaagtaaattgtgctaatgaggaataacagaaacttcaggaaaatcatgtactcctaaattgaagtcatgaatgaggccttggaaatcatctagtccagccttttcgttttacagataaggaaatgggtcccagggagagaagaaagagcgtgtctaggatcacgtcgccacttccggctctttctactgaaatgacctccactgaggggtgtgaagatagtatcaattatttgtctaagacttgtcatttcaaaaacttgtcgatgtaaattctagtgcatactagacttgtaggttgtcagtaaatatagactattttttcttagtctattggaattttttcttaaaactttttttgggtgtgctagacatgtaggacaaattttcttttaaactaggttgctttatggtttgtgaatggtctctgttttacttatgaaagttatacatgttcactttgtagaacggggggtgacaaactatgtcctgtgggccaaaagggttctgttttgcaaatcaggttttattggcacccagccatgctccttcatttacttattctctgtaatgacagagttgagtagttgagaccttaggacctgcaaaacctatatatatatgtgtgtgtgtgtgggtgtatgtgtgtgtatatatatgatttattaaatataatttttatttaatataattacacatatttattaatgcacatatttaattatacttataaccatatagttatgctatatatagatatgtataatatagttatatataaaatatataatatatattctttacacatatatataaatatatttaattaaaaatatacatatataaaatttattttatttttaggttatagcttactgtaaactcaaactcctgggctcaggccatcctcctactttggcctcccaaagtgctaggattacaggtgtgagccaccatacccagcccaaacccaaaaacccttcatagaaaaaaattgttaaaccctgctgtagaacgtctgaaaaaatacagagaaatcgaacatctgaaaacatacggaaaaatcgcacgaagaaaacagctatccatatctcaccttcagtgaagtaggttgactgtaattttaccattctcatggccaaataattttgaaaatatctgattatttcctaaggctaagtttctcgaagtggaattcctaggccagtgagtgtgagtggcttttttttttttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagcgtttgggtccctgggtacttgagattagggagtggtgatgactcttaatgagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcctccctttctattccacaaagccaccattgtcatcctggcccgttctcaatgagctgttgggcacacctcccagatggggtggtggccgggcagaggggctcctcacttcccagtaggggcggccgggcagaggcacccctcacctcccggatggggcggctggccgggcggggggctgacccccccacctccttcccggacggggcggctggccgggcagaggggctcctcacttcccagtaggggcggtcgggcagaggtgcccctcacctcccggacggggcggctggccgggtagggggctgacctcctccaggacggggcggctggccgggcagggggctgacccccccacctccctcccggacggggtggctgccgggcggagacgctcctcacttctcagacggggcggctgccgggcggagggtctcctcacttctcagacggggcggccgggcagagacgctcctcacctcccagacggggtggcggccgggcagaggcgctcctcacatcccagacagggcggcggggcagaggcgctccccacatcccagatgatgggcggccgggcagagacgctcctcacttcctagatgtgatggcggccgggaagaggcgctcctcacttcccagatggaatggcagccgggcagagatgctcctcactttccagactgggcagccaggcagaggggctcctcacatcccagacgatggccggccaggcagagacgctcctcacttcccagacggggtggcggccgggcagaggctgcaatctcggcactttgggaggccaaggcaggcagctgggaggtggaggttgtagcgagccgagatcacgccactgcactccagcctgggcgccattgagcactgagtgaaccagactccgtctgcaatcccggcacctcaggaggccgaggctggcggatcactcgcggttaggagctggagaccagcctggccaacacagcgaaaccccgtctccaccaaaaaaatacgaaaaccagtcaggtgtggcggtgcgcgcctgcaattgcaggcactccgcaggctgaggcaggagaatcaggcagggaggttgcagtgagccgagatggcagcagtatagtccagcttcggctcggcatgagagggagaccctctctttttttttttaagacgaagtctcgctctgtcgccgtgagtggctttttgaaccttggtacttagcgcagaatttcttttcagcttgtatttctggcaatgcctgtaccttgctaacattaaacaaacaaacaaacaagaactccttttctaatggatttggttttgctttcatggattcaggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtaggtgccatcattcctgcctacccttagctgtccccgtgctgggaacacaccagttcggggcttctttgctgtcctgtagcagaagaggagttttattccttgtgaagagttagttgctgactgttggatggaagcaatttgatggtttggttcaaaatactggtaatctcattttcagtaggaggggagcagctgttgagcagatgcagtgcatcccactgatcacaagctagcttaccaggaccatctcagtacctagatcaagctgtctagacttaattctgtagaaaagaaaagtcctagaaaggttatcgcattcacacacagaaggaaaaagaggaagggggcagggaaagtgagtttgtatctataaggaaatatgcacttcaggtggactgcagttgactatgatactttctctgaggcttaatgtctcatttacaatctattaggtaaaggttttgctctttgcattagcattttcttttgggaacttgtgtactcaaatgcaaaaatcagctgggcatggtggtgggcacctgtaatcccagctactcaggaggctgaggcaggagaatcgcctgaacctaggaggcagaagttgcagtgagctgagatcacactgctgtactccagcctgggtgacagagtgagacttgtctcaaaaaaaggaaaaaaaaagccgggcgcagtggctcatgcctgtaatcccagtactttgggaggccgaggagggcggatcacgaggtcaggagatggagaccatcctggctaacacagtgaaaccccgtctctactaaaaatacaaaaaattagctgggcatggtggcgggcgcctgtagtcccagctacttgggaggctgaggcaggagaatggtgtgaacccgggaggcggagcttgcagtgagccgcgattgtgccactgcattccagcctgggtgacagagcgagactctatctcaaaaaacagaaaaagaagaaagaagaaagcccttcttttttttttttttcttaatagagacaaagtcccactgtgctcaggggttctcaaactcctggcctcaagcagtcctcttgcctcagcgtcccaaagtattgggattgcaggtgtgagccactgcagccagcctgcccttccttcttgaatcccttgcagtctggctcccctccccatctttagtctgaaatgttcattcaagagtcactaatgacgttttttaaaaaactaattttatcaagtagctcatatttttttgtagataaattggagaatatagacaagcaaaaaagaaatctgtcacttattcaggaaaattaatatttgatagtacttggctcatagtttttatgtactaaataaaaataaaataaccaaacctgccatttgataatgactgttagctttttggtgtatcttgtatcttcttacagccttttttattctttgccatctttaaaaaaaaatctagctgtattttttttaaataaaaattagctcattctcgtatgagttaatctgaaatttgactttctcacttaggaatgtattgtagtcctccttctctgtaaatcaatacagatctaggtcctcgttttaaatggccatgtaggattgtaatttacttttaatttattttaattagtcaacacatttcctgtttttgaccatttaggttgtttccagtttttcattattagaaatatctctgtgatgaacatctttgtgtatctttgtgcacttattacattatttccttaggctgtgctaatggccttctacttccaaatagaatagcttgttttcagtgctccctatccttggctgtctgaagaatctgacactgtcagcctcctccctctctgaattttcttcttttggcttctctgatcctgtgtaatacaggctttcatacctgactgttcctactctgctcctttgcttcctaaggtaggcattctccaagattgtgtattcaaccttttctgttcttgaaaatctcattcaccctcttgtgttcagctgtcatcactctgcatggttttctgcagtccatcctcgtctctttcctgaagtccagtttcatattcccagctatctgctgggtatcccagtcagagccttcctaaactgtaataggcaagattactgtcttggctgcatgccctgtttgcctacgatttccctcagtgcctttcccaaattctgtcttagagtccccaaatgattttaatggtgtcactattttctgactccattacacttgaaatcctacaatcattgggtccctcatctcctgccacctcaggtgattgctggatttcatggaatcgccctctgcaatgtttcatctgtcacctcctcccatatccattgctccaccctcacacccctccagaggaccattgcatttgctttctaaccagtctcttcttcctccaatctcttctttcagactgttactcccttatcctttacaaaaaccttcagtggcgcctcgttgtctaagcttcccttagagctttttcttcctctgtttccttctgcatgtcctatgaccaaccaatttggaccacctccttgttttctggtcttcagatctttgctcatactttcttctccccctgaaatgccctttcctactactactttccaaaatcctaccccttctgcaatgtgcatcctagacacctgctccttcacgaggcctttcttaaccccttcttatcccctcaaccagatgtaattgccctcttcctaaactctttgtgcttttacattgtacttagcgcattctctcttaaatatagatacttatctccttttcttctcatcttcctctctgatgttgtgttctcaaaggcagtaattttattttgtggaactctgaattttccatggtgcccattacctctgaaaagtcaaaggtctgtatcttgctaatgactgggcaagatacagagttatgaaatttcttgagactccctcagtttagtggagcatgggttatggggctagaaagtcctgagtttgggtctcagttcaggcttttactagcctggaaactttgggcatttacttcacttacttaggtcttactgtccttatttgaaattgaataataatacttagatctcatagtcttgcagtaaggattaaataagatatttagtctagtatctgtcacatggtagatctcagcaaatacttgttgcctttccttttccttgccactatgtttcagcaagtatagctaaatcatctgcttcttcctattgtatctgttttttagggatcttacctttattatccaggaactctccctaatgtgccttgggtgaagatgttagttgaagtgacttctctgccgtgtttgtggacctggagggactggctcctgggcctttggctccatttgcatcctcctctagccaactctggatgttaacacatcttaaagctctttggcaaacacataattaaattgctggtgacaacatctgaaatgatttccatttgtagcatgcagtccagtgatgctagcttatattaggcttgaagtgaatagaatgttctggatttagctctgtttcttgagaattcactgcagtctagtttcattgtaactcttgagtgtaataatatgttttagcttataattttgttataagaaaagggaaagggaaaggttttttgtttgtttgtttgttttgtttttgagatgggatcttgctctgttgcccaggctggagtgcagtagcatgatcatagctcattgcatcttcgaactcctgcacttaggtaatcttcccacctcagcctcccaaagtgctgagattacaggtgtgagccactgcacccagctgagaaaatattttaagttcataagacctaaagaagagcaaatggaggacacaagtggttagggcagattattatgcagtttaaataaattctacttcacaattgtgatctttacataaggaaatatattttcctttaatattctaatctttgtaaataattacataagaaataatttgtttcatgcttaaaatgttctgccctggaaaagctagccatcactaaagctaattggtcttcatcatcacattaacaagtggtagtttcatggcaggtaaactttcttccattagggttggtcttctacgaattgattattccctccactctcctatgtccatttcactcctgtacattgtcctctatattgctgctccctctctaaaggggcttgctttttttttttttggagacgtagtctcgctctgtcacccaggctggagtgcagtggcaagatctcggctcactgtaaccttcacctccaggttcaagcaattctcctgcttcagcctccccagtagagtagttgggattacaggtgtgtgccaccatgcctggctaatttttgtagttttagtagagacccagcctaaaggggctttcttatcagcctgtaaacacatctgagtctctactgccttctcaaacacccagcctggactaatccacatccacatctctagctactaccctttcacccttgctgtcatagccaaacttctttaaaagctccatcggctgggcttggtggctcatgcctgtaatcccatcactttgggaggccgaggagggtggatcacgaggtcaggagttcaagactagcctggccaacaggatgaaacctcatctctactaaaaacacaaaaaattagctgagtgtggtggcagatgcttgtaatcccagctattcgggaggctgaggcaggagaatcacttgaatccaggaggcggaggttgtggtgcgtggagatgtggagatcacgccattgcactacagcctgggcaacagagcaagactccatccccccgcccccaaagaaagctccctttatcccttacctctcatttactcttcaactcttgccaatctggtttctgcccctactttgttacccaaatccctctctataggctatacacccagtgatcagttttcagacccccctgtatcttatgtattattctctcggctgctcgcccaattagttctcctcaccatgcttgaaatgttctttgccatggctcctgtgataacacatcctcctggctttcccactacctctcggcagctccttttcagtctcttgcgtagactcctacttttctacacagctttgcatgtaggaatcccttaaggtgcaccctcaactccctgcttgctatggtctgaatgtttgtatctcccctgaattcatatgttgaaatactaattaataaggtgatgatattaggaggtgggcccttttggaaggtgtttaagtcagtgggggtagagccctcctacatgggattagtgcttttctaaaagaggtcccagagagctgccttggcccttctaccatgtgaggacacagctctagtaggtgtcatctgtgaggaatggccctcactagacactgattctgctggcaccttgatctcagacttcccagcctctagaactatgagaaacaaatttctgtttttatcagccacccagtatacaatgttttgttataacagcctgcatggattaagacactgtttttctccctttttacgtccccctgaaagatctcctctacttctgtggctttaattcctctacatatgtggatgactcctaaacttacgtctccaacccagtccttcctcttaactctactattatgtgtctagctgcctgcctaacctgtctaattccatgtatcacaggcatctcaaattcaacttgaccaaacccagattcctgatctgccttttctagctctgattctcttcatcatatttcaagttgcagaaaaggggagcaccatttacccagttactgaagcctgaaacctggcatcctcttccttccccaaacatgccatttcagcacatttttctttttctttttctttttttttttttttttgagacagagtcctactgtgtcacccaggctggagtgcagtggcatgatctcacagctcactgcaacctccgcctcccgggttcaagcgatttttctgcctcagcctcccaagtagctgggaccacaggcatgtgccaccatgcctggctactttttcgtatttttagtagagatggggtttcaccatgttagccaggatggtctcaatctgctgacctcatgatctgccctccttggcctcccaaattgctgagattacaggcatgagccacatgcccagccctgagcacagtcatttttctaccagtcgatgttgcaatgaagataaagttccaaatccttgacatgctccagccttcccctgtgagctgatcactcccacaagaagctcctctgccttccatcctcagccactctgaccttctgtttcttctggggaccctgcacctgccagccccagccccttccttatttatgccatccctttttctggccctcttgcttggctaacttatactcatccttcagtttgggctgagctatttatatgctgttccaggaccctgaacttctcctttatggcacccatcctgattgtaattatattatttatattgttttgtttgttgtctgtcccctctgctgaacatcgacttcacataggcagggacggggtctcttttttcactgctttgtcacttaccacaccagttcccagccaggaaaagaaaagacggttgtttccctgctttgataaaatacccagacaaaaggatgcccttattgctcttagacctctttcccgaatcttccctggttgtcacctgcaatgatgttatgtctgagttgaatgtttctcactgcacgctagtttgctcagaggtaatagaggaggaactgttttctcactttctctttctctttagcctttattcctaaagcttgtttctagtcatttcttttaaccagcttcctgagaagtatttccattgtcttttctgaactctcccttagaccatgagaaaacaaaagtttatgctgattttgggtcatgacctgacactgaaattggtggtgttaagtacattgccgagtaactcagatacattgatatttaaaaaaatactttttctgattataggagtgattttattgttaagaaaaaattgagaatataatcaagggtctagaagagaagaaatgggagagattcagacttttctcttgtagaataaggtcctgctgtacatgtgatttttgtccgccctttttcacttcacattgatattttgataaaagccctgagaaatgggagtgaaacctaatggaccgcagctttggacaagccccgagtgcaaataaggctggtcagcagcttctagcaggatctgcttcttctagaagcagagaaaggtaacaggctgccctgagaccaggctctacagagcctccctcctgcctcgtacatgccaagccggccctgtcctggcacttacagtgactaacggccgggcacctccctctcggttgatgccctccatgcaggacatctccaacacattgctctccgttctggtgtgttccttaagccaaactttctaggtttaatttcactggatgttcatagatcctcgtgtcccagactaattgtctatgtatttgttgatatttgttcttgcctattttcattttattttttaaattcaaggcaagaggcctatttattttgtattttatagtgcctagcatggaatttggtgcccaataaatactttttttttttttgagatggggtctcgctctgtcgcccaggctggagtgcggtggcactatctcggctcactgcaacctccgcctcctgggttcaagcgattctcttacctcagcctcccgagtagctgggactacagatgcatgccatcatgcccggctaatttattgtatttttattttttaatttttaattttatttatttattttttgagacggagtcttgctcagtcgcccaggctggagtgcagtggcgcgatctcggctcactgcaagctccgcctcccgggttcgcgccattctcctgcttcagtctccggagtagctgggacttcaggtgcctgccaccatgcccagctaattttttttgtatttttagtagagacagggtttcaccacgttagccaggatggtcttgatctcctgaactcgtgatccacctgcttcagcctcccaaagtgctgggattacaggtgtgagccaccacgcccggcacatttattgtgtttttagtagatacggggtttcaccctgtcagccaggatggtcttgatctcctgacctcgtgatcccccggccttggcctccaagagtgttgggattacaggcatgagccaccgtgcctggccaataatcttaaataatctaaaaataatgttctgcccaaattacaaattaccaaattagggtccatttatgcataattttatccattaattcaggaagcatttaacagtgcctggcacagttgccaggcatggagtatacattagtgaataaaacaggggtagttcctctgggattctaggctagtttgtttgtttgtttgtttgtttattgagatggagtcttgctcttgaagctcaggctggagcagtggtgcgatctcagctctctgcaacctccacaatctgggttcaagtgattctcctgcctcagcctcccaagtagctgggattacaggcatgtgccaccacccccggctaatttttgtatttttggtagagacgggatatcaccacattggccaggctgatctccaactcctgatctcaagtgatcctcccaccttggcctcccaaagtgctgggattacaggggtgagctcccggcctctaggctagtttaataccagatgttacacagataataaattcatagtttcaacttgtgatgagagttatgaaggaacatggcagggtgccctgagagaatgcgctaaggcaggggtgtccgctcttttggtttccctgggccatattggaagaaaaattgtcttaggccacacaaaaaatacactaatgatagctgatgagctaaaaaaaaaaaaaagaaaagaaaaaaaaaaagaaagtcgcaaaaaaaaaaaatctcataatggttttttttttttgagacggagtcttgctctgtcccctgggctggagtgcagtggcgcgatctcggctcactgcaagctccgcctcccgggttcacgccattctcctgcctcagcctcccgagtagctgggactacaggcgcccgccaccacgcccgactaatttttttgtatttttagtagagacgaggtttcaccggattagccaggatggtctcgatctcctgacctctggtccgcccgcctcggcctcccaaagtgctggaattacaggcttgagccaccgcgcccggcataaaatctcataatgttttaagaaagtttacaaatttgtgttgggcctcattcgaaaccatcctggtcggcatgcagcctgtgggccacggttgtggacgagcttgcactgaggggagacctatagtatctggcattgtgtgtgggaagaagcctggagactgagccctggagagaaggagagggtgggtcaaggtgagagatgagctctttttgagagggaaccagcccaaaggcgaggcattcaaggtag

SEQ ID NO: 778 - DNA, 314675 bp, Homo sapiens
gccacaaaacagtaaaatagttatgaataatccaagcaaaaaagtgtgcaagacctgagtgaagaaaatcaacaaattcattttatgtgtgtgtgtttgtttttgacatggggccttgctgtttcacaggctataatgcagtggcacttacggctcaaacaatcctcttgcctcagcctcctgtgtagctgggatcacaggcatgtgccacaacacccagctaattttaaatttttttgtaggggctaggtctcactttgttgcccaggctggtctcaaactcctggggtcaaatgatcctcccacttcagcctcccaaattgctgggattgcaggcatgagccactgtgcctagccaggtcaagatttttttctcaactctttatgtcaaaatactgtcttcaaaagttatatgtggctgggcgctgtagctaatacctgtaatccagtgctttaggatgtcaaggtgggacgattgcatgaggccaggagtttgagatcagcctgggaaatgtagcaggacctccatctctactgtactagtctgttctcacatggctgacatacccaagtgactcacgcctgtaatcccagcactttggggggctgaggcgggtagatcacctgaggtcaggagttcaggaccagcctgaccaatatggtgaaacccccatctctactaaaaatacaaaaattagctgggcatagtggcgtgcacctgtaatcccagctacatgggaggctgagacaggagaattgcttgaacccaggaggtggaggttgcagtgagtaatttttgtagtttttgtagaaatggggtttcgccacgttgaccaggctggtcttgaactcctaatctcaagtgatctgcccccgctcagcctcccaaagtgtttagattacaaacgtgagtcgctgcacccgaccccaaagtcttaactcattttgacattaactcaaaagtccacagtccaaagtctcatctgagacaaggcaagtttcctccgccgattagcttgtaaaatcaaaagcaagttagttacttcctggattcaatgggggcacaggcattgggtaaatacagccatttcaaatgggagaaattggccaaaatgaaggggctacaggccccatgcaagtctgaaatccagcggggtggtcaagtcttaaagctccacaatgatctcctttgactccatgtctcacgtccaggtcacactgctgcaagaagtgggttcccatggtcttgggcaactccacccctgtggctttgcagggtacctagcctccctccggtgtgctttcatgggctggtgatgagtgtctgcagcttttccaggagaacgatgcaaactgtgggaggatctactattctggggtatggaggacggtgaccaccttctcacagctccgctaggcagcaccccagtggggaccctttgtgggggctcccaccccacatttcccttccacactgccctagcagaggttctccatgagggccccgcccctgcagcaaatttcttcctgcccatccaggcatttccatacatcctctgaaatctaggcggtggttcgcaaaccctagttcttgacttctgtgcactcacaggcttaacatcatgtggaagcttccaaggcttggggcttgcaccctctgaaaccatggcctgagctgtaccttggctcattttaatcacagctggagtggctgggatgcagagcaccaagtccctaggctgcacacagcaaggggatgctgggcccagcccacaaaaccactttttctttcaaggcctctgggcctgtgatgggagaggctgctgtgaagacctctgacataccttggagacattttccccctctgtcttggggattaacattccactcttcgttacttatgtaaatttctgtagctggcttgaatttctcctcagaaaatgggattttcttttctattgcattgtcaggatgcaaattttctgaacttttatgctctgcttcccctgtaaaagtgaatgcttttaagagcacccaagtcacttcttgaaagctttgctgcttagaaatttcttctgccagataccctaaatcatctctctcaagttcaaagttccacaaatctctaggacaggagcaaaatgctgccagtctgtttgctaaaacgtaacaagagtcacctttgctccagtttccaacaagttcctcatctccatctgagaccacttcagcctgaactttattgtccatatcacgatcagcattttggtcaaagccacttaacaagtctctagggagttccaaactttcccacattttcctctctccttctgagccctccaaactgttccagcctctgcctgttacccagttcgaaagtcgcttccacattttcggatatcttttcagcagtgccccactctcctggtaccaatttactgtattagtctgttctcacgctgctaataaaggcatacctgagactgggcaatttacaaaggaaaggggtttattggacttacagttccatgtggctggggaggcctcacaatcatggcagaaggcaaggaggagcaagtcacgtcttatgtgaatggcagcaggcaaatagagagctggtgcagggaaactcccttttcttttaaaaccatcagatctcgtgagacttattcacttccatgagaacagcatgggaaagaccctcccctgtgattcaattacctctcaccaggttcctcccatgacatgtgggaattgtgggagttacaattcaagataagatttgggtgggaacacagccaaaccgtatcatctacattaaaaaaaagattaactgggtgtggtgctgcacatctgtagtcatagctactcatcaggaggctgaaatgggaggattgtttgagcccaggagtctaaggctgtggtgagctataatggcaccactctactctagcctgagtgacagagtgagatcctgtctcttaaaataaaataattatttggattaatttttcattcctttcaatgtggttgtgttatcagtttgatagcttcattggctcacatatctttattggtaaagctaggcatttaaccaaatcagcgtgtgtatacacacacacacacacacacacacacacatactttttttttttggcgtagtcttcctctgtcactcaggctagggtgcagtggcactatcttggctcactgcaacctctgcctccggggttcaagtaattctcatgcctcagccttccaagtatctaggaccacaggcacgagccgccacacctggctaattttttgtatttttagtagagatggggttttgccgtgttggccaggctggtctcaaaactcctgacctcaaatgatctgctccctgtgacctcccaaagtgctgggattacaggcgtgagccagcatacccagccagtcagtatatttcataatggaaattaaaagtgattcctctcttgacttttaacctttagatgcatatgccttcttacgtagtgttgtttggacttcttaatgtttagaagtttttaattagttgccaatattttaaaacttggacatttatataaaaatcctgatttctttaaaaaggtagaaaggaagctctgatttttccaagttcatttggcaactattggatggttcctagtagtagtggcagcctgcattctctctagttcccacaactcttaatatcatgcccaacgccttttaggcatttgttatttgcatcccttctttataaccctcttatgtataaaactttcagtggcaggtacaatggtagagaattaaactaactgccttgtgttctgaaaaaggaactgattttatctgaaatgatttcagttttgtagttctgtgacccagtcaacatgactttgataatgctttctaatggtagttaccaagcccctattttaaattgcttaaatgtagcaaatagctttgataaaactgtactttctttgtggtttaacaaagttcatcattcattttgcatggtttgggttaccagggaacatacagctgtttttgaacctttaaaaaatatcttttattacaatgagaggaattacatgaactgcatttagttttttttatcttttttttgagacaaggtctcactctgagcgacctaacccagtgcatttagtcttgtaattgaagttaatagtgttttgttgatattaatggcatttattagaatgtgtgctgttctaaacagtaaggtggctgagcaaggtggctcattcctgtagtcccagtgcttagggaggctgaggcaggtggattgcttgagcccagaagttcagaaccagcctacgcaacatagtgagataccatgtctacaaaaaatacaaaaattatagttggaaaatgaattttaattgttaaactgtatatctaagttgatttttacaagtcgttttattttttcttcaaaagcttttgttaatacaaagtatcaatatgggtatggcgaaagagaactcttgtaccctattggtgggaatgtaaattggaacagccattatggagcacaatatggaggttcttctcaaaattaaaaatagaactactgtacaattcagcaatcccacttctaggtatatatccaaaggaagtgaaatcagtagattgaagagatatctgtacccccatgttaattgtagcattattcacaatagctgagatgtggaagtaacgttagtgtccatcgacggatgaatgtgtaaagaaattgtggcatacacacacacagcagaatactatttagccataaaaagaaggaaatcctgtcattggtgacattatggatgaaactgggagatattatgctaagtgaaataagccagatacagaaagacaaatattgtatagtctcattaatatgtggaatccaacaagttgaactcataaaagcagagcatacaagggtggttgctagtgcctggggaggaggtaggggaaatagggaggggatgtaatgtacagcatggttactatagttgattatactgtattgcttacttgaaatttgataaagagagcaaattgtaagtgacccatggtcactatgggtggtggtgttgattgtgttaatttgactgtggtagtcagtacataatgtgtatatatataccaaatcatcattttatataccttgaatgttatatatatattttttcaattacatgttttaaaattaaaaagttggccgggaccgggtgtgggggctcgtgcctgtaacccccgcactttgggaggctgaggcgtgtagatcatcttgaggtcaggagttcaggaccagcctggccaatatggtgaaaccctgtctgtactaaaaatacaaaaattagccaggtgtggtggtggtggagggggggccgcctgtaattccagcgactcgggagactgaggcaggagagtcacttgaaccccgctggggtggaggttgcagtgagccaagattgtgccgttgcactccagcctgggtggcaagagcgaaactctgtctcagtctcagtggctcaggaggtggaggctggagggccacttgaggccaggagttcaagaccagcttgggtagcatagagagaccctgatctctacaaaagttagaaaaaattagctggatatggtggtgcgtgcctgtagtcccagctactcaggaggctgagctagaaggatcacttgagcctgggagtttgaggctgaagtgagctatgattgtgccactgcattccagcctgggcaacagagtgagatcctgcctccaaaaaaaaaaatttttttttaatgtaaaaaccatcaaaatactgttatctacacatcactaatgtttacaatcaacaggtttatacatttattttaggtaaatctaaaggcatcctatatatacattttatgtgagaggaaagtattaataaaatctgaaattgaaaagtagcttttatttcatacagactggtttttatcaggaatgaagaagggtaattttttaatgctttttttataatgataaaggaattagttgaaaggatataacaattcttaatgtttatgcctttaataacagtttcaaaatacatgaagcaaaaactgatagactgaaaggagaaaaagacaaatccataattttagtcagagattttaatgccattctcgtactagttgatagcacaagtggacagaaaaccatcaaggatgtagtagacttgttacaacactatttacttgacttgatttatagagccctctgtgcaacaacagagagacattctgctaaagtgcacatggaatattcatcaagacagaccacattcaggctgagcatggtgtcttaactcctgtaatcccagcactttgggaggccagggtgggaggattgcttgaggccaggagttcaagaccaggctgggcaacatagcaagaccctgtctctgcaaaaaaataaatgaaaaaaaaaaaaagaccagattcttagccataaaacaagtcttgataactatgaaagaatttgggttatacaaagtacattctctgaccataaggcatttaagttagaaatcagtaacagaaagattcttggaaaattcccaagtactgaatttggaaactgaaaaacatactttatttttaaaaaaatttttcttttttttcttttctgtttttttttttgtttttttttttttttttgagatggagtttcgctcttgttgcccaggctggagtgcaagggcgcaatctctgctcactgctcactgccatctccacctcctgagttcaagcgattctcctgtcgcagcctcccgagtagctgggattacaggcatgcgccaccacacccggctaattttgtacttttagaagagagaggtttctctgtgttggttaggctggtcacgagctcccaacctcaggtgatctgcccgcctcagccttccaaagtgctgggattacaggcgagagccaccacgcctggcacttgcttttctttaaattttatttttttactctttaaaattaaatctgtgtcttttttatgttattttttattttaatttgtagttttttagtaagaaacctcatccgagaaaaaatactttaaaattatctattgggcaaagaaaatattttttaaaaaaggaaataaaacaaggccgggtgcagtggctcacgcctgaaatcccagcactttgggaggccgaggcaggtggatcacgaggtctggagatcgagaccatcctggctaacatggtgaaaccctgttgctactaaaaatacaaaaaattagccgggcgtggtggcaggcgcctgcagtcccagctactcaggaggctgaggcaggagaatggtgtgaacctgggaggcggaggttgcagtgagccgagatcacgccactgtactccagcctgggcgacagagtgagactccgtctcaaaaaaaaaaaaggaaatatattttgatccaggtgaggtttcagaaaacagagtgaagaaaaggaaaaaaaggaaaaaagaattaaagtttaaaaaagaaaacggctataaaaaaatattctgaacagaataaaaagaaggccgggtgcggtggcttgcacctgtaatcccagctactcaggaggctgaggtgtgagaatcgcttaaacccaggaggcggaggttgcagtgatccaagatcacatcactacactccagcctaggtgacagagtgacactctgtctcaaaaaaaaaaaaaaagaaaacacaacatatctagatttgtggggtaccactaaaacattgcttaggaaatgatttgtagcactaaataactaaattagaaaagatctcaaatcattgacttcagcttccaccttaaaaaacttgaaaaagaagagcaaattaaactctacataagcagagaaaagaaaataataaagatcaaagtaaaattcaaagaaatatgaaacagaaaagcaagagaaaaatcaatgaaaccaaatgtgatttttaaaatggttaaacttctaaccaggctgatcagacataaaagagaagatacaaattactgatatcagaattagagaggtgacatcactacatattctaaagacactaaatggatagtaatagaatattatgaacaactttatgccaataaatttgacaacttagatggaatgacaaattccttgaaagacacaaactacaaaagtttattcaggaagaaataggggctgggcaaggtggctcattcctgtaatcccagcactttgggagggggagaatcgcttgagcccaggagttttagaccagcctgggaaacatggtgagacctcatctccagaaaaataaattaactggatgtggtggttcatgtccacggtaccagctacttgagatgctgaggtgggaggaacacttgagcctgggaggttgagactgcagtgagctgtcattgtgtcactgcactccagcctgggcaacagagtaagaccctgtctcaaaaaatcaatcaatcaatctatctatctatcaatcaagaagaaataggcaagccaaatagcctcgtatgtgttaaaggaattgaaatcatagtttaaaaatctacccgcataaagatccagactcatgtaatttcacaggcaaattctatcagacgtttaaggaagaaataacaccatttctctacaaccttttccagaaaattgaagaggaggaaatttttcccaacttgttctgtcatgttagcattatcttgataccagaaccaaagatattacaggaaaactatatgccagtattcctcgttaacatatataaaatttcacacaaaattgtagcaaatagaattcaagaacatataaaaaggatgacagatcatgacccaagtggggtttatgccagaaattcaggattgatctataacttgaaaatcaatgtaatttaccatattaacaaataaaagaaaagccataatgatctcagtagatgcagaaaaagtgcttgataaattctaatatccattctattttctttaaattttaagtttttttttttaaagacagattcttgctctgtttccaggttggagtgcagtggcgtgatctcggctcactgcagcctctgccttctgggttcaggagattctcctgcctcagcctccagagtagctgggactacaggtgcacgccaccaggcccagctaatttttgtatttttattagagacggggtttcaccatgttggccaggctggtcttgaactcctgacctcaggtgatttgcctgcctcggcctcccaaagtgctgggattacaggtgtgagccaccctgcctggcctaaattttaagtttttatgggtacatagtaggtgtatatatttatgggatacatgagatattttgatacaggcatacagtgtgtgttcacatcagggtaaatggagtatccatcacttcaagtgtttatcatttctttgttcgaacattccaatggtacttttagttattttaaaatatacaataaattattgttgactgtagtcatcctgttgtgctatcaaatactagatcttattcattctaaccctatttttgtatgcattaaccgtctccattccgcccccgccacctccccactgccctttgcagcgtctgatagctattattctattttctgtttccattagtttaattgttttaagttgtagctcccacaaatgagtaagtgaagtgaaaacgtgaagtttgtgtttctgtgcctggcttactttacttaatataatgacctccagttctatctatgttgttctaaatgacacaatcttgctcttttttatggctgaatagtactccgttgggtatatataccatattttcttttcttttttcttttttttttttttttgagatggagttttgctcttgttgcccaggctggagtgcagtggcgcgatcttggctcactgcagcctccgcctcccaggttcaagcgatttctcctgccttagcctcccgagtagctgggattacaggcatgtcccaccactcctggctaattttgtatttttagtagagacggagtttctccatgttggtcaggctggtctcaaactcctgacctcaggtgatccgcccgcctcggcctcccacaatgctgggattacaggcgtcagccaccacgcctggctcgaatgccacattttctttatccatttgtctgttgttgaataacttagggttgctaagttgaagcaacttaggttccttccaaatcttggctattgtgaatagtgctgcaataaacatgggagtgtcagtatttctttgatgtactgatttcctttctttttggtatatatctatcataggggattgctggattgtatgatagttctgtttctaattttttgaggaacctctatactattctccatagttaccatactagtttgtgttcccactaacagtgtatgagggttcccttttcttcatatccttgccagcatttgttattgcctgtcttttggacctaagccattttaactggtgtgagatgatatctcattttagttttgatcaaagaaattttgatgcatttctctgatgaccagtgatgtagagcaccttttcgtatacctgtttgacattcatatgtcttcttttgagaaaaacctattcagatattttgcctgtttttaaaactggattattagatttttttcctgtagagttgtttgatgtccttatatgttctggttatgttatgttatgttatgttatgttatgttatgttatttttgagatggaatcttgctgtgtcacccaggctggaatggggtggcatgatctcggcttactgcaacctccacctcctgggttcaagcagttctcccacctcagcctcccgagtagctggatctacaggtgtgtgccatcacacccggctaatttttgtatttttagtagagacggggtttcattatgttggccaggctggtcttgaactcctcacctaggtgatccacccgccttggtctcccaaagtgctgtaattacaggtgtaagcaaccatgctcggcctatgttctggttattaataccttatcaaatggatagtttgcaaatattttctcccatctgtaggttgtctcttcactttgttgattgtttcctttgctgtgcagaagcattttaacttgatgtgatcctatttacctatttttgctttggttacctatgcttttggggtcgtaatcaagaaatccggtctggatgacagagtgagaccctgtctcaaaaagaaaaaagaaagagatctttccccagaccagtgtcctggagagtatccccaatattttcttgtagtagtttcatggtttgaggttttagacttaagtatttgtcttgatttgatttttgtatatggtgagaaatagggatctagtttccttcttctgcatattgatatctagttttcccagcaatatttgttaaagagactgtcctttcctcaatgtctgttcctaccacctttgtcaaaaataagttcgttgtagatgtatggatttatttctgggttctctattgtgttccattggtctctgtgtcttattttaatgccactgacatgctgtttggctactatagctctagtataatttgaagtcagataatgtgattcttccagttttgtttttgctcagaatagctttgactattctgggtcttttgtggctccatataaattttaggatttatttttctatttctgtggaaaatgtcattggtattttgatagggattgcatttaatctgtagattgtgtagtatggacttttttttttttttaaacaactttgagtctttcaatccatggacatggaatatctttttccttttttttggagatagggtctcacactattgtacaggctggagtacagtggcacaatcacggctcactgcagtcttgacctcctaggctcaagagatcttctcgcctcagcctcctcagtacctgaggactacaagtgaatcccaccaggccgggctaatttttttttttttactcttagagacaacttcttgctatgttgcccagcttggacccattggctcactcaagcagtcttcccaccttggctttccaacatgctgggatacagacatgagccaccatgcctggtctctttccgttttttgtgtgtgtgttctctttaatttcttgcatcaattatttattgttttagttgtagcaattttttacttctttgattattaggttaaccttaacttaggttaacttattaagtactttattttatttgtagatactgtaaatgggagtactgttttcatttctttttcagatgggtcattgttgacatatggaaatactgatttttactgatttttgtatattgattttatatcctgaaactttagtgaatttattagttctttttttttttttttttttttttttttttgagacaagtcttgttctgtcgcccaggctggagtgcagtggtgtgatctcagcttactgcaacctccacctcctgagttcaggggattcttcgacctcagcctccagagtagttggcactacaggcgtgtgccagcatgcctggctaatttttgtatttttagtagagatgggggtttcaccatgttggccaggctggtcttgaactcctgacctcaggtgatccacccacctcagcctcccagagtgctgggattagaggcgtgagcctctgtgcctggctgaatgtattagttttcatagtttttggtggagtctttacatttttccaaatatatcatatctttttttttttttgagacagtcacccaggctggagtgtagtggtgctatctcggctctctgcaacccccacctcccaggttcacatgattctcatgcttcagcctcccaagtagctgggactacaggtgtgcactcccacacccagctaatttttgtatttttagtagagatggggttttgccatatcggccagactggtctttaattcctggcctcaagtgatccatctgcctcggcctcccagagtgctgggattacaggtgtgagccactgctcctggctacatttttgtattttttggtagagatggggtttcaccatgttggccaggctggtctcaaactcctgacctcaagtgatccacctgccttggcctcccaaagtgctgggattacaggtgtgagccaccatgcctggcctcatatcatttataaataagagtaatttgactagttcctttccaatttggatgtctttatttcttccttatgtaatcgctctagctaggactttcagtactatgttgaataacagtattgaaagtgggcatccttgttgtgtttcatatcttagaggaaggcttttaatataatactaaatggggaaaacagtctgttatgggtctgttgtatatagctcttactgtgttaaggtatgttccttctataaccaatttttgagagtttttgtcatgaaaggatattgagttttatcaaatgctttttcaacatcaattgaaatgatcatatggtttttgtcttttattctgttgataggctgtatcacattgatcgatttgtttatttggaactatccttgtctccctggtttaaatcccacagggtcatgttgaataatctttttaatacgttgttgaatttggtttgcttgttgttttttgtttgtttgtttatttgtttttttgagacagagtttcactcttgtcacccaggctagagtgcaatggcatgatctcggctcactgcaacctctgcctcctgggttcaagcaattttcctgcctcagcctcccaaggagctgggattacaggcgtgcgccaccgtgccctgctaatttttttgtgtttttagtagaaacaaggtttcaccctgttggccaagctggtcttgaattaggtttgctattgttttgttgaggaattttgcatcaatgttcattggagatagtggcctgtaattttcttcccattttttttttttttaagacagaatctcgctcttgtcacccaggctgaagtgcaatggcacgatctgggcttgctgcaacctctgccttccgggttcaagcgattttcttgcctcagcctcccgagtagctggggactacaggcgcccaccaccacgcccggctaaattttttttgtatttttggtagagacaggatttcaccatgttggccaggctggtctcgaactcctgacctcaggtgatctgcccgccttggcctcccaaagtgctggaattacaggtgtgagccactgcgcctggccaattttctttctttgatgtgtctttgtctggttttggtaacaggttcatactggccttacagaataagtttggaagtattctgttcactgtttttcagaataatttgagtaggaatggtattagttctttaaatctttggtaaaattcagcagtgaagccattaggtcctgggcttttcttggctgggagacttcttactactgcttcaatctcattttgttgttggtcttttcaggttttggatgtcagtatggttcggttttggtaggttgtatgtttctaggaatttagcagtttcttctacgttttccagtttattggtatatagttgctcatagtagttccttttttttttttgagacggagtctcaccctgttatccaggctagagtgcagaatgcagtggcgcaatttcggctcactacaacctccacctcccaggttcaagtgattctcctgcctcagcctcttaaatagctgggattacaggtgcctgccaccatgcctggctaatttttgtatttttagtggagatggggtttcactatgttggccaggctggtcttgaactcctcacctcaagtgatccgcctgctttggcctctcaaagtgctgggattacaggcgttagccaccatgcctggccagtagtttctaatgatcttttgaatttctgtggtattgcttgtaatgtctcatctctgatcttatttatttgagccttctctctttttttcttagtctggctaaaggtttgtccattttgtttatcttttcaaaacaccaagtttttttttcctttcatcttttgtgttttttctgtttcaatttgatttatttctgctgtgatctttttcttctactaattttgggtttggtttgcttttgcttttctaattctttaagattcatttttaggttgtttatttgaagtttttctacttttttgatgtaggcacttttgctataaactttcttcatagtactgtttttgctgtatcctgtaggttttagtatgttgtgtttccattttcatttgtttcaagaaattttaaaattttctttctttttttgagacaaggtctcactctgtcacccaggcaggagtgcagtggcacaattacagccactgccaccttgacctcttgggctcaggagattctcccacctcagcctcctaaatagctggaactacaggtttacaccaccaggcctggctaagttactgtatttttttttagagttgaggttctaccatgttgtccaggctggtctcgcactctggggctcaagcagtctgtcccccttgctctcccaaaatgctgggattacaggtgtaagccactgtgctcggccaattttttaaattttccttctgaatctcttcattgacccagtggtcatttaggaacatattctttaatttccatgtgtttacgtagttcccaaagttcctcttgttactgatttcttttttatttttatttatttatttatttattttttattatactttaagttctagggtacatgtgcacaacatgcaggtttgttacatatgtatacatgtgccatgttggtgtgctgtacccattaactcatcatttacattaggtatatctcctaatgctatccacccctcctccccctaccccacgacaggccccggtgtgtgatgttccccaccctgtgtccaagtgttcttattgttcaattcccacctataagtgagaacatgcggtgtttggttttctgtccttgcgatagtttgttcagaatgatggtttccagcttcatccatgtcactacaaaggacaagaactcaaccttttttatggctgcatagtattccatggtgtatatgtgccacattttcttaatccagtctatcattgttggacatttgggttggttccaagtctttactattgtgaatagtgccacagtaaacatatgtgtgcatgtgtgtctttatagcagcatgatttttaatcctttgggtatatacccagtaatgggatggctgggtcaaatggtatttctagttctagatccttgaggaatcgccacactgtcttccacaatggttgaactagtttacagtcccaccaacagtgtaaaagtgttcctatttctccacatcctctccagcacctgtagtttcctgactttttaatgatcgtcattctaactggtgtgagatggtatcccattgtggttttgatttgcatttctctgatggccagtgatgatgagcattttttcatgtgtctgttggctgcataaatatatcttcttttgagaggtatttgttcatatccttcacccactttttgatggggtggtttgattttttcttgtaaatttgtttaagttctttgtagattctggatattagccctttgtcagatgggtagattgtaaaaattttctcctgttctataggttgcctgttcaatctgatggtagtttcttttgctatggagaagctctttagttgaattagatcccatttgtcaattttggcttttgttgcaaaaaacaggctgcattgccaagacaatcctaagccaaaagaacaaagctggaggcatcatgctacgtgacttcaaactatactacaaggctacagtaaccaaaacagcatggtactggtaccaaaacagagatatagaccaatggaacagaacagagccctcagaaataataccacacatctacaaccatctgatctttgacaaacctgacaaaaacaaaaaatggggaaaggattccttatttaataaatggtgctgggaaaactggctagccgtatgtagagggctgaaactggatcccttccttacaccttatacaaaaattaattcaagatggattaaagacttaaatgttagacctaaaaccatgaaaaccctagaagaaaacctaggcagtaccattcaggacataggtatgggcaaggacttcatgactaaaactgatttcttttttatcacatcgtggtcagagacctatttgacgtactttcagttttgttttttttaattttaagactttttgtggcctaatagatgctctgttcttgaggatgttatatatgctgaggagaagaatgtgtatattctgcagccgttagatgaaatgttctgtaagtatctgtttggtccatttagtctatagtgcagattcagtcaaatgtttcttagttttatgtctggaagatctgtccagtgctgaaagtgggatgttgaagtttccagcaattactgtgttggagtccatctctctttagctctaataatgtttactttatatatctgggtgctccagtgttgggtgcatgtgtatttataaatgttacatcctcttgctgaattgacacccttattatataatgaccttctttgtctctttttatggtttttatcttaaaatctgttttatctgatacaagtatacctactcctgctctttcagtttccatttgcctggaatatcttttttgacccctttatttttagtctgtgtgtatctttataggtgaagtgtgtttcttttttaaaaaattttacttaaagtttttttgtttttttagagaccggttctcactttatcccccaggctggagtgcagtggtgtgatcacggattactgtgacctgaaactcctgagctcaggggatcttcccacctcagcttcccaagtagctaggactacaggcacatgacactgcacctggccaatttttctttattttttatggagacagggtctcaccatcttgcccaggctagtctcaaattcctggggtctagcaatcctcctgcatcagcctcctaaagtgctgagattgtaggcatgaaccactgtgcccagcctgtttcttgtaggccgcagatggtcggactgtgcttgtttaaatccgttcagcctctgtatgtcttttgattggagaatttagtctgtttacattcaatgtcattattgataaggactttctactaccattttgttatttgttttctggtcttcttttccttccttccttcccatcttcctttatgggaaagtgattattttctggtggtatgttttaatgtcttgccttttatgttttgtgtatgtgttgtaggtttttgggtattttttttttttcccgtacagagtcttattctgtcgcccatgctggagtgcagtggcataatctcagctcactgtagcctcgacctctccggcttaagccatccctgcacctcagcctcctgagtagctgggaccccaggtgtgcaccactatacctggcgaatttttgtattttttgtagagacggggttttgccatgttgtccaggctggtattgaacgcctgagctcaagccatctgcctacccccacctcccagagttctgggaatacaggcgtgagccaccgcacctggttgtagttattatttttgataggttcatcttttattctttctgtttgagatatgagtagtttacacaccagaattacggtgttaatattctctatatgtttgtctatgtatttgctattaccagggagttttgtatcttcaggtaatttctcattgctcattactgttcttttctttcagattgaagaactccctttagtatttcctgtaggacaggtctggtgttgacgaaatccctcagcttttgtttgtttgggaaagtctttatttctccttcatgtttgaaggatattttcagtggatatactgaaaatacaggataaaagttttgtttttttttcagtactttaaatatgtcatacactctctcctagcctgtaaagtttctactgagaagtgtgctgccagacacattagagctcctttgtatgctatgtgtttttcttttgctgcttttagaatcctttcttcattcttgacctttgggagtttgacaattaaatgtctggaggtagttttgagttaaatttccttgctgttccataaccttcttgtacttgaatattgatatctttctctatgtttgggaagttctctgtagtatatctctttgaataaacttggtacatacttctctctacctttttgttaaggcccataactcttagattttcccttttgaggctattttctagattttgtaggtgtgcttcattcttttttattctttactattttgtctcctctgactgtatttcctttctttctttcttttttgttttgagatggagtttcgcttttgttgctgaggctggagtgcaatggcgtgatcttagctcactgcaacctctgcttccgggttcaagcaattcccctgcctcgcctcccgagtagctggaattacaggtgcccgctaccatgcccggctaatttgtatttttagtagagacagggtttcaccacgttggccaggctggtctcgaactcctgacctcgggtgatctgcccgtctcggcctcccaaaatgctgggattacaggcctgagccaccgtgtccggccccttgactgtgttttcaaatagtgtgtcttcaagctcatgatttctttattctgctaaatcaattctgctgttgaaagactctgattcattcttgtttatcagttgaatttttcagctccagaatttctgctggattttaaacaattatttcaatctctttttaaaattcatctgataggattctgaattccttctctgtattatcttgaatttcattgagcttctttaaaacagctattttgactttgtctgtctgaaaggtcacacatgtctgtcattccaggattggtcactggtgcctcatttagtttgtttggtgaggtcatgttttcctgtatggtcttgatgcttgtggatgtttgttgatgtctgggcattgaagagttaggtatttatggtagtcttcacagtctgggcttgtttgtacccatccttctagaaaaagctttccaagtattcaaaggtaattgattgttttgatctaagtccttggtctctatagccgtatctacattagggagcaccttaagcccagtaatgctgtgactcttgtagacttatagctgtatggccttagtggtcttgggtaatagccagtattccctggattaccaggcacagtctcttgttctctttccttattttcccccaaacaaatggcatcgctctccatgctgagctacctggagttgaggggaggagtgacacaagcacccctgcaaccaccaccactgggactgtgctgggttagacctgaaaccagcacagtactgagtctcatcagtacagtaatattgcctggctaccactgatgtttattcaaggcccaagggctctttattcagcgggttgtgaatctagccaggcttgtgtttttcccttcagggtggagggttcccttttggcctaggatgggtctagaaatgctgtccagaagctagggcctctagcctctggagttgggaactttaggaatctacttggtgctttattttactgtggatgagctcatacccaagttgcaagacaaagcagggtttttctattttgtaacataggttggcattacattctttttgaagggtgaataatactccattgtaggtttatatcacatttttaaaaatccattcatctcttgatggttacttgggttgttttcaccttttggctattgtgaatagtgcttctgtgaccagtgatgaacatatttgtctattggtcatttgggtatctttggttaccatttatcttaacagtgtaccggatgttctagccagtgcaataaggcaagaaaaagaaaaaaaaggcagctacaatggaaagaaagaagtaaaaattgtctttattcacacatacattatgtggaaagtctgatagaatctacaaaattgctctaaactaataagtgattttagcaggattgcattatatgagatcaatatgtaaaaatcaattgtatttctatatagtagcaatgaataattgaattaaaaataaaatgatgccattcacagtagcatctaaattattaagtacttaggaataaatctgaccaaagatgtggaagacctgtatgttgcaaactcagaaacatcgctgaaaaaaatttaaaagatctaagtaaatgcagagattaaccttgttcatggattagaagactcaataaccctaattatttaatgcagtcctaattaaaatcacagtaggctttttttttaggtaaaaattaatatggattcttttttttttttttttttgagacagtcttgctctgccacccaggttggaatgcagtggcgcaatcctggctcactgcaatctctgcctcactaattcaagtgattctcatgcctcagcgtcccgagtagctgggattacagatgtattccaccatgccccactaatgttttgtatttttagtaaagactgggtttgtctatgttggccaggctgttcttgaactcctggcctcaagtgatccgcctacctctggccttccagattgctggaattacaggtgtgagctaccgcctctggccagtaagtggattctaaattgcttattgaaatgcaaaggacctagtatagtcaaaaaacagttttgaaaaagaacagcagtgaggcccagtgaggtggctcacgcctgtaatcccagcactttgggaggctgaggcgggcggatcacctgaggtggttgagttaaagaccagcctgaccaacatggagaaaccccgtctctactaaaaatacaaaattagctggagtggtggtgcatgcctgtaatcccagctactcgggaggctgaggcaggagaatcgcttgaacctgggaggcgaacgaaggttgcgttgagttgagatcgcgccattgcactccagcctgggcaaaaagagtgaaactctgtctcaaaaaaaaaaaaaaaaagagaaaagaaaacagagaaacaacagctttcaaagctaaggctgcctgatttcaggactaattataaagctacagtaatcagaaccatgtagtactggcatatagacacatagatcaatggaacagaataaagaatccagaaataaattggatgcacatgttgagcaattgacttttgaacaaaggtatgaaatcattacagtggagaaaggatagtattttttttttctttttaaataaaagagagactggcccaggcatggtggctcatgcctataatcccagcactttgggaggccaaggtgggcggatcacctgaggtcgagagtttgagaccagcctggccaacatggggaaagcctggtctctacaaaaaatacaaaattagccaggcgtggtgggacatgcctgtaatcccagctactcaggaggctgaggcaggagaatcacttgaacctgggaggcagaggttgcagtgagccgagattgcgccattgcactcccgcctgggcaacaagaacgaaactccatctcaaaaaacaaaaacaaaaacaaaaaacaaaaaaatgtttcccaggctggtcttgaactactggacttaagcaatcctccctcccacctcggcctcccaaagtgctgggattagagacatgagccaatgtgcctggccagaatagttttttcaacgcagggtccttgaaaaatgggatatccatatgtaaaaaaatgaatcttcatttatacctcacgccatatgcaaaaatcagtttaaaatgtatcgtagacctaaatgtaaaacctaaaattataaaacatttagaagaaaatgtgggggaaatgttttctttatgacattggattagacatgtttttttatttttatttttattttgttttttgagatggagtcttgctctctcgcccaggttggagcacagtggcgtgatcttggctcactgcagcctctgcctcccgggttcaagtgattctcctgtctcagcctcctgagtagctgggatttcaggcacatgccactacgcctggctaatttttgtatcctttttttttttttttttttttgagatggagtctcgctctgtcacccaggctggagtgcagtggcgcgatcttggctcactgcaagctccacctcccgggttcacgccattctcctgcctcagcctccaaagtagctgggactacaggcacccgccgccaccatgccaggctaattttgttgtatttttagtagagacagagtttcactaggttagccagatggtctcaatctcctgacctcgtgatccacctgcctcggcctcccaaagtgctggtattacaggcgtgagccactgcgcctggcaatttttgtattttttagtagagatggggtttcaccatgttggccaggctggtctggaactcctgacctcaggtgatccacccaccttggcctcccaaagtgcaggaattataggtgtaagccaccacgcttggctgacatgatttcttacgacatcgcaagcatgatctgtaagagaataggttaataaattggagttcatcaaaaacctctgtttttcataagaccctgtaagagaataaaaacacaagccgcagactgggagaaaatatttgcaaagcatatgtctgatagatgacttgtctcaagaatacataaagaactcaaaactcatgagaaaacaactcagttaaaaaaaatggacaaaagatttgaacagaaatttccccaaagaagatatatggatggaaaataaatcaatgaaaagatgttcagcatcaatagtaattgcaaattaaaaccagaagttgatatcagtacatactgattagaatgtctaaattaaaaagactgatcttacaacgtgttgaagaggatgtagaacaattggaactctcaaagctgacaagagtgaaaaaaatggtacactccctttagaaaactattaggtagttttttagaactatatacacctaatccagccatcctgttttaggaatttacccaagacaaatgaaagcattatgtccataagatttgtacatgggtattcacagcagctttatctgtgatagtttcacacgggaaataacctaaatgtccattaatataggtgaatggataaacattgtggtatattcattcagtagaataccactcagtaataaaagggaatgaactgttgatacaagcaacaacatggatttatcacaaaataattatgatgagtaaagaagccagagaaaaaagaatacatactgtatgagtctacttattatataaattctagaaacttatctataatgataggaagctgataacttgttgcctgaggaggagaaataatgagggaggaacaagaaaattttgatgttgatggatatgtttctttctttttttttttgagatggaattttgctcttgttgcccaggctggagtgcaatggtgcgatctcggctcaccgcaacctccgcctaccgggttcaagcgattctcctgcctcagactcctgagtagctgggattacaggcatgcgccaccgcacccagctaattttgtatatttagtagagatgggatttctccatgttgatcaggctggtctcaaactcccaacctcaggtgttgcaccctcctcggccttccaaagtgctgggattacaggcgtgagccaccgtgcccggcctggatatgtttcactatcttgattgtggtaatggttttattggttgttgtttcttatgctctatctggtatttttagatataaaagatttaatgattcctgagcttacttattttacatggtatttatggaaagtttaattcttataaagcacaagagttctaactggattgttgagaaactgctttaatgatatttattactgttaccttaatttttctgatcttggatcttgactgatgatgcactcaatttatttaaatgtggagtttagctctaagactcctgtaacttaaaagagaatgatattttgaatgatctgaatattgttcattaagtacattttgctcaaaggaaaataccgtagtccacctctgacagtttagtattattatttttttgagatggagtcttgctctgttgtccaggctggagtgcagtggcacgatcctggctcactgcaaacctctgccccccaggttcaagcgattctcctgcctcagcctcccgagtagctgggattacaggtgcccaccaccacacctggctaatttttgtatttttagtagagacagggtttcaccatgttagccaggctggtgtcaaattcctgacctcaagtgatccacccgcctcggcctcccaaagtgcagggattacaggtgtgagccaccaggcccggccttttttttttttttctttctcttttttttttttgagacagagtctcactctgtcttccaggctggagtgcagtggcgcaatttgggctcactgaaacctccgccttccggggtcgagcgattctcatgccccagcctcccgagtagctgggactgacaggcgcacaccaccacgcctggctaatgtttattttcatttttatttattttttgagatggagtttctctctttcacccaggctgaggtgaagtggagcaatctccgctcactgcagcttctgccccctgggttcaagcgattctcctgcctcagcctcccgggtagctgggattataggcgccccccaccaggctcagctaaatttttgtatttttgtagagatggggttttgccgtggtggctaggctgttctcgagctcctgacctcaggtgatccacccacctccacctcccatagtgctaagattacaggtgtgagccaccatgcccagcctaatatttatatttttagtagagacagggtttcaccaggttgggcacactggtcgcgaacttaagacctcaggtgatccacttgccttggccccccaaagtgctaggattacaggcatgagccatcgcgcccggccccagtttaattatccttaatagaatatgagaagattatagttgtattacagatgaattgatgctgttaacttgtacttttgcttttaccaactgacaagatgataaaagcaggcttcttctcagaatggcaatttgattataaatctagctgggaagtgtgctagttgatgattgttaactcaaggatatattaatttttgtcaggataaagtattttattttattggtatctttcccctccctcttctagaaaatacagtagcagccatgatagaagacaaaggaccaagagtgacagactactttgtcgtagctggtctcactgacacatctactcttttggatcaagaaataaatcgtttagatactaagtcaactggacctaaagctccaattacagacattgccattattatcaaatcagctggagaaacagtacctgaaggttacacctgtgtagaagccactccatcagctctccaagcaaacttgaactatggaagtctgaaaagcccagaacttttcctctgttataagagagggagagataaaccaccgcttacagatattgggtatggtgacttcttttctttgctatagtgaaggagtaaaatttatttaagggccatggaagtaggaatttgaaatccttgatagttttattattactgatagtttattattattgatagttttatggttacttcaggattcattatagtaatatattacatgccagtatccacccttactgaatttctttgcattgccttgaattgttagatcatttgctttcaaaagaatattgaaatgaagacatttgaccctaaagtgtcattttgtttctgttgtacttatcaaataagattattaattaaacacaatagaatgagaagctataataaagacactatcattttaaggagttgcttgggttatgtaatgagtttttgtgaagacctgtacttgtttaactaaagagcagtcctattttaaatacagttgtaacgtgtggctttcaatgctgggaggagggtgtttacagataagtgctacagttttcatgaagtatctagtatctagtctaccagtgaaggacattcttttttgtaaatgcctacaaaggtccaccctttccccaaatggctaccttgactcttctgtaaaaaggatgtgcttttagaatacctataacactttaccatatatacatgtgatgtattggggtgttttgtttattatcattaccattactaaaatatagatatttgggaacatcctggcaagtattttaggatcagcttatctatttatacaaaatgtgtagtaggaattttgatagagattacattaactttagattaatctgcagagtattgtcatctttacaatattaaacgattcagcttgtgaacgtggaatgttttccattggtttaggtcttctttaatttctttcagcaacattgtgtattttttaaatctgattaattttatttctaggtattttattcttttggattctattataaatagtgttgttttcttaatttttggattgtttgttgctggtgtatagaaatagctgatttttgtgtgctaatcttgcactctgcaactttgccgaatttattagttctaataacttgtgggttcttcgggatttttttaaatatataggatcatgtcatctgcaaatagaaatagttttactccttcctttgcagtttggatgctttgtgtgtgtgtgtgtgtgtgtaattactctggctagaacttttagtatgttgaatagcagtggtgaaagcaggcatcttgtctcattcctgattttaggtggaaagctttcagtcttttactattgagtatgatgttaactgtaaatattccttaaataccatttatcatgttgaggaaatgttcttctattcctagttttctgagagattttatcaggaaagtgtgttaaattttgtcagatgccttttgtcaattgagatgatcatgtattttttcttcctttgttctcttagtgtcatgtattacattgattttcttttgttgaatctttcttttaatataactatgataccataccttaaaaaatgattaattccttaatattatcacatatccaaatttttctaattcatgaagccttttttttcttttttttttttttttgaacacttggttgctggttgttctctttttgttgttgtggttgttttttgtttgtttgtttttgagacagagtctggcttcgttgcccaggctggagtgcagtggcgcaatcttggctcactgcaacctccgcctcccgggttcaagtgattctcctgcctcagcctcttgagtagctaggattacaggcgtgcaccactatgcctggctaatttttgtatttttagtagcagagacagggtttcaccatattggcaaagctggtcttgaactcctgaccttaggggatctgcctcccaaagtgctggggttacaagcgtgagttaccacacctggccactgattgttctctttatagttgttcaggtattaaggggtagccatttgaccaccacttgttacgctcatcacccactcttgttgcattagagctctggcgaaattgttataaagatcctcatactccatggaagtcggaatccacgaaggagtgtgtaacaactcaggctgaaaaagagaaaaaagtttaaaaagtcctcattttcaaatttttaaaaccaaaggatgatttgtctttatcttacttgacctttatgcagcattcgtttaactcctttagtattgtccatcctatttagctactgtagttttccttcaagtcagtatagttaggatggtgatctttcagctttatagggtcattgagcatatgagccaggttagaaagacagggttcagaaatgactgggaattggattaataaaggccccctccactctgcccccccagaagcttgactttaagggaaggggaagatagttaagggcctaactattcaaattgtagcccatggaccagtattgtccaaaagacctggaagcttgttagaaactcagaaacttaggcactattccagacctactgaatcacaatctgtattctggtccagtgtggtggcttacactgtaatcccagctaacctgtaatcccagcactttgggaggccgaggcaagcggatcacaaggtcaagggatcaagaccatcctggccaacatgatgaaaccccatctctactaaaaatacaaaaattagctgggtgtggcagtgtgcgcctgtagtcccagctactcaggaggctgaggcaggagaatcacttgaacccgggaggcggaggttgcagtgaaccaagatcacaccactgcactccagcctccctaatcccaacgctttgggaggctgaggtgggaggaggattgcttgaggccaggagttcacaaaaaataaaaataaaaatgagcaagggcccggtgtggtggttcacgcctgtaatcccagcactttgggaggcggaggcaagccgatcacttgtggtcaggagttcaagaccagcctgtccaacatggtgaaaccccctctttactaaaaaaatacaaaaattagttgggcatggtggcgagcacctgtagttcctgctacttgggaggctgaggcaggagaatcacttgaacccaggaggtggaggttgcagtgagccaagattgtgccactgggctccagtctgggcaacagagtgaaactccttctcaagacaaaaaaaaaaaaaaaattagcaaggtgtggtggcatgcacatgtagtcctagctactcagaaggctgaggtgggaggatcactggagcccaggagtggctccgattgtgccactgtagcactccagcgtgggcaacagagcaaaagaccctgcctcagaagaaaaaaaaatctatttttaacaaaattcccagaaacaatggtttaaaatacctagagggtgaagatatatgaattcaagggttgttttttaaccttcctctcagggaataacctagaacattttcatattgaaggaagaaatcagtggagaaggaagggtaggaaatataggaaaaagatattttatagaataaaattattgaagggatgatgttaacagcataggtgactggattagcttttatttgaaggggccggcctgcctgcttgccttcctgccttcctgcctacctgcctgccttcctcccttcctcccttcctttttttttggacagagtctcgctctgtccaggctggagtgcagtggtgcgatctcggctcactgcaacctccacctcgggttcaagcaattctctgcctcagcctcccaagtagctgggattacaggcacccaccaccacgcccagctaacttttgtatttttagtagagacggggtttcaccatgttggccaggctggtcttgaactcctgacctcgtgatccacctgcctctgcctcccaaagtgttgaggttacaggcatgagcccctgtgccccgccggaaggggcttttcctttgagaagaagaaagtaagttaaaatgggtgtaaacacagagtattggttgcagtggagtgacattaatggttttattgttctgtttttttttctctatggtttccttaagaagataggtaatatatatccctaaggatgtaggataaaattgtggtaacctccatgttagttgaagggaaaccagccaggtacttattttgtgttccagcattcactgttccctcttttaggcatcttttttttttaattaaaaaaattgttttttttaatatataaaaataaggagaatttttttgagacagtgtctcactgtggttgctcaggctgcagtgcaatggtgtgatcacagcttactgcagcctccgccttctgggctcaggtggtcctcccacctcagcctcccgagtagctgggactacaggcaagcaccaccatacccggctaagtttttgtagtttttgtagaggtggggtttctcatgttgcccaggctagtcttgagctcctggactcaagcaatctgctcacctcggcctcccgaagtgctgggattacaggagtgagccactgtgccgggccagtcgtcttttagagtccatcttttgacaagcccacctgccacccctcccatacagtcatgactgaaagatgtgaatctctgcaaaattgttgttgcttgtgatacaacttaaaaataaaatgatgacttacgtaattatatgtaggtgctttcagattgcaagtggctttttcatacacatcttgcagttcctaaggcttctaatttttgttatggtagtttattgatacagatttgctagagtgtatggttgtccttaagctaatcatgatggttaatatttctctccagatcaaataattgttaatgtctggtgacttaaatgttttggcctgttctcctcactttccccccactctttcctcactctagtgtgaaggggtttggaaaacctattagcttctgtatttatagtaggaaagcctattagctactggaaatacagacacccatctcattaagtttaatatgaaacactgttgctaaacttttgtcttttttactgttttataaactgagatgaggtatttataaaaatagtacttttctctagaaaagatgttaagttaaaatatgtaaaatctgatattcccatagaaataccgtatatactataaagtacaatcatgtatcacttaacgatgggaatacattctgagaaatgtgttctatggcgattttgtcattgtgtgaacatcatagagtgtacatacacaaacctaggtggcatagcttactacatatacaactatagcctatttttcttaggctgcaaacctgtacagcatgttactggggtaatagatactgtaggcaacttacacagtggtgagtatatgtatatctaaacatagaaaaggtacagaaaaatctggcataaaaaataagtcacacctgtatagggcacttaccatgaatggaccttgcaggactggaagttgctctaggtgagtcagtgagtgagtgttgagtgaatatgaaggcctaggacattactgtatactactatagactttagtaaattaactttagctttattatagcctttttactttataaacttttaaagtttttgttaatttttttgattcttttgtaataatacttagtttaaaacacttaccatacagctgtacaaaaatatttttctttctttaaatccttattttattaagtttttttgtattttaaaattttattttaaaaatttattcttttattttttattttttgagacagggtctcactttgttgcccaggctggagtgtagtggtatagtctaggctcactgcagcctccacctcctgggctcaggcgataatcctttcacctcagcttcctgagtagctgaactacaagtgtatgccaccactcctggctaattttctttttgtagagatggggtttcgccttgttgcccaggctgctctggaacacctgagctcaagtgatctgcttgccttggcctcccaaagtgctgggattacaggcatgtgccaccacgcctggcaaaaattaaaaaaaaaaaaaaaataatggggtcttgccttgttgcccaggctggcattgcactcctaggctcaagtgatccagcctcagcctgctgaatagctggcactagcttggtttttaaactttattttttgtttttctttttctttttttcttctctctttttttttttttttttttgagacagagtctcactctgtcttccaggctggagtgcagtggtatgattggggctcactacaatctctgcttcctgggttcaggtgattctcctgcctcagcctctggagtagctgcgattacaggcatctgccaccacacctggctaatttttttttattttcagtagagacagggtttcaccatattggccaggctggttttgaactcctgacctcaagtgatccacccatcttgacctcccaaagtgctggaattacaggcgtgagccaccgcctctgaccagtttttattttcttattttgaaattttttgcaaagatgaggtcctcctatgttgcccaggctgttcttgaactcctggcctcaagcaattctgcattggccccttaaagtgctgggattatagatatgaactactgtgcctggatttttttttttaactgtttaaactattttgttaaaatttaagacaaaaagacacatgttagcctagccctacagagtcaggatcatcactatctctgccttccatcgccacatcttgtcccactggaaggtcttcagggcagtaacccacatagagctgtcttctatgataagaatgccttctggaatacctcctgaaggacctgcctgagactgttttacagttaactttttttgtaagtaggaatatactctaaagtaatgataaaaggtatagtattgtaaatactaggtgataagaatttctcagctccattataatctatggcaccaccatagtatatgcagtctgtgcttgcatcatcattatgtggtgcatgattgtatagtataatttaaacagggcagtatgttatcttatatatcagatgcatttcttttttctttcttttttttttttttttttgagacagagtttcgttcttgttgctcaggccagagtgcaatgacccgatcttggctcactgcaactccgcgccccctcacccccacccccgccagtagctgggactacaggcacctgccaccatgccaggctaattttttatttttagtagagacggtgtttttccatgttggtcaggctggttgcgaactcccaacctcaggtgatccgcccacttctgtctcccaaagtgctgggattataggcgtgagccactgcgcccgcccagatgcatttcttgagacacagaatcatagaccatacgaagttcttattttcttccctttgtcagattcattggctttcaactgatttgtttctccagttcttttgttttttgagaaatttcaaacatgtgaaaagttgataaactattataatacacaagtatccttttctcctagatgatagactgtagaataatgaacaatatacttgtcacctacaaattgacattttttttcatttgtttgctaagctaattgaaaggaagtgggagccagtgtgcctagcctatttctttctcttaaacaaaatgtagatactctataccctattttgtactttgcctttttcacctaagagtatatactggcaatcactctgtatctgaatataagatcttcctcattttttgtgtgtgactgtataatacttatttgtgtggatgtatttactttattcaatgaaacctctactgatggacatttggattgttctcagttttgtgctattaaaagaatgctttgatgaataactgtgcatttattgttatgtatttgtggaggtgtgttttcaggtagatcctagaaaaaattgctggattaaaagataaatgtgtaaataattttgttaaatgttactaaatttttctctatagtgtttgtgccattttatattctgccatatatgtgtttttttaatccacatcccatcaacaaagtatgtggtctgacatattttttgtcaatctcacagagattaatggtgtatcagagtaatttcattgaggttaatcattgctccataagtttaaggggcgattttctttattcttttgcttatactataaacagatttttaatctttaccttgatttttttaaaggaaattttttatgtgttaggaagatgagctttttgtgaaataagttgccaagtattttcttcagtcaacttgtcttttatcttggcttatggtgttcgttgtcatgtaacgtttattttatgtagtttatttttctactcccatattttattggtactggattttgagtcatagtcttttcccactgctagatatacttttagcactagtatgatttaattccttatgtttagatctgtgatccaccgggggatccccttctggtgtgtagtgtgaagtatagacagaattttatttttttccaaataatatttttttccaaataacaatccagttatctaagtcctgcttattacatttaaaaatccattcttcccttagtatattgagaaattaccttcatgatagactagatttttcttctgtttcattgtctttctgttcacttccttgctaatactctcctgatttaaataaagaggctttatagtacattttaatattagttgggttttaacagctttatggagatacaattcacatgtcatacagttcacttacttaaagtgtacaattcaatggtttttagtattgtttacagtgttgtgcagctaccaccacaattaattttagaacattttcatcagcctaaaaagaaaccccatacccattagcagttgctatttagtattctttcccaccttctacccctaggtaactattaatctactttctgtctgtatggatttgcctattctggacatttcttaaaaactgaatcactgtatgtggtctttgtgactttttttttttttttcacttaacatgtttagctgcttgtgcttttggtgtcatatctaagaaggctttgtctaacctaaggtcacaaagatttatttctgtttttcaaagagtgctatagttcttacattgattttgatccatttttagttttttgatgagtagtataaggaaggggtccagcttcatgcttttgcaggtggatatccagttattccaacactacatattgaaaagactattccttcctgattgcattgtcttggcactcttgttgaaatcaattgactgcaaatataagggcttaattttggacactccattttattctgttgatctatatgtttattcttatgccaatacattgcactgattactgtagatgtgtggtagttttgaagtagggaagtgtgagtcctccaactttcttctttttccagattgctttgacaagaaaaaacaaaagcagctggggtttaaataggaattgcattgaatttattgatctatttgagggtattgccaaaggcagctggaatttagataggaattgcattgactttattaatctatttgggggtattgccatcttatcaattttcattaattcatttttcagttttcattaatcaaattgaagattgaattaatcagattaattcaattttcattaatctatttgagggtattgccatcattgtctttttgtccataagcatgagatgtcttatttattcagctctttaatttctttaaataacgttttatagttttcagaggatttttaaagctaaaaaattgacaaattatgaagcgaatttttatgaaaacatctgaatacttggtgaaacttctaggaattgacctgaagatgtttgtggtgttgcccctttcttttttcatatgtttcttataataagcaatacaaaatcaagttgttcaatcctgtttacacttcttaaattatgttttggcttttgaaaaatagtttagagacttgtagttcccaaaggaataattttaattttggtttctagtgaagatttgggaaacaataggagagaccaaaaaaattttctttgatttcaagaagaaaaccagcattaacctgaaatgcatgtactatatatatgtacatatgtatgtgtgtatgtatatatctatatctatttcttccccttcctgccatgcagagttctatatgaagggaaagaacggcttattccaggatgtgaagtgatcctagccacaccctatggtcgctgtgccaatgtcaacaatagttcaactacttcacaaagaatctttatcacttatcgaagggctcctccagttcgaccccagaattccttggctgtaactgatatctgtgttattgtaaccagtaaaggagaaactcctcctcataccttctgcaaagttgacaaaaacttaaattgtggaatggtaagaataaagttttcatcttcaaagtttcatatgaaaccaaaaagggatacgttttggattcctgtttactgttgggtatatactcacattttatattttcatgatgcttgtttttatttttcctaatttttatgatttgtaataatttttaaagtcctatcccatgatttataataatttcatctttaagtcagggatatttttgagggagtaaatcctaatattgtctgtgttacattaacaaaggttttattcacttttggatttcagtggtgtcttcagggacaactgtggggttagagtgggtagaagctctccttacattcatttattcattcattcattcatttgtttgctttttttatttttttgagacagggtcttgctttgtcgcccaggctggagtacagtggtgcaatcacagctcactgcagccttgaccccccaccaggctcaagtgatcttcccaccttagcctcccgagtagctgggactacaggatagtagagacagggtttcatcatgttggccaggctggtcttgaactcttgaccttaagtgatccacctcccttggcctcccaaagtgttggaattacaggcgtgagccaccatgcccggcctgtttttgtttttgagacagggtctccttaagttgcccaggatgctcctgaactctagggctcaagagaaaatattgcagttttgcatacttatttttttttttcagacggagtctcgctctgtcgcccaggctggagtgcagtggcgtgatcttggctcactgcaacctccacctcccaggttcaagcgattctcctgtctcagcctcccaggtagctggggctacgggcgtgcgccactacgcccacctaattttgtatgtttagtagagatgaggtttcaccatgttggttggccaggatggtcttgatctcttgaccttgtgatccacctgcctcagcttcccaaagtgctgggattacaggcgcaagccaccacacccaatccatgcatacttactctttaaaaggactgtagtgaagaagaaaatgaacataaatgtttgattcatagtttttaaagactacagcttacttttggttcagatttactttgaaaaatatcttcaggtcaaactaatattagcttaatgttgtataggcggagatgacaaatgcacccagaacaattagtgaagacagggttgcctctggaggtgatgacctcatagtcctccagtgacccaagtcttccccaatttgggctccagtgcacactccgttttgtgctgtgtcttacaagaaggggcaatctctgagtgattgtgaaattctaaatcttttgaaatggccttcatatcagtttgatttttgtagcattgttttcttactctcttattttagtgttctgaacttcatgctttgctgtattttatactgcatagttcattatataaacgttttaaatagactcttctgagtaaataaatgaatctttagttggtatccaacaaaatcaatttcttttcactcttttgtcttttttataaacctaattcatgttttacagtggggttccagcgtgtttctgtgttataagaagtctgtacctgcttcaaatgcaatagcatataaggctggtaagtgagttaaaaaaaattgtctcaattgctatagttattggtgcatattaacatttggctaaaagagataaagtatgctcccttacatagtttgtagaattgatctattcataaaattatctataattttagcatataaagatatgtgttttcttaaatacatatacaagatatattaatacccccaccaaacatgctgttaatttaatttaaacatttatctaaagcaaacatatgtggaataaacattcaagcttttggtctacgttaatagacttaacagtataatggaaagttgctgactctctgaccttttatattttggcaatcagaaaggtgtcaaactgcgtctttacttcttatatttccttctcttatctctttgtgtctgatttgaaaccacatgttacttgccatgaaaggtggacttgcttcctttctcctttgttgcaaagaatcagctatatggaggagaggagggcctgagaaacttttctgccatgaagtgtttgagaaatctatcgccacattcttactgcacattaaagtgtcaagggctgtaaagatttaagtgtcacgtcttcattccactggtatggtgggataaaaactgaaaatacaggtatgctccagttgtaaatagaaaagatactggaatacttctttgtgaaaagaagcagtgctaattactatttgattatgcacagttcttgaaataaagttttacttcagggaagtcaggcaaattcatatccaaaaaatcgtgattttcataaaaacattcatactaatgaaccaaaccatttaatttataatataaaaataatggcaacgactaacgtataaaattcagtatcattttaaaatctgatactgtaggctgggcatggtggctcacgcctgtaattccagcactttgggagagtgaggcgggcagatcgcttgaggccaggagtttgagaccagcctggccaacatggtgaaaccccgtctctactaaaaatacaaaaattagccaggcgtggtggcacgcatctgtagtcccagctacttgggaggctgaggcacgagaatcgcttgaacccaggaggcggaggttgcagtgagccgagatcacaccactgcactccagcctgggtgacaaagcaagatcctgtctcaaaaaaaaaaaaaaaaagtgatactgttaatactgctgtaatatgttgattatgtgtgatgtcctttttttgttgttgttgttgtttttggtggagaaaagatatcacttaaaaaacttatagaaagaaactgtaccaaagtattcagttatttgatatgagacacttattttagaatagagagttttagatactgaatttgggctcaaaattctactactgattttgaagtttttcacttagagatggtctatatattgatgaccttagaggctaatgaacagatgccatgtagctaatttattctgtgggtcttcattgtggttctcaaagtgtcacttgctcctactttctgggtctcacatactctgtacttagtcacagtgtttctgtctcatttacttttcatgttgcatgccttttacactgcttccctcttaagatgagtttaggggctgtgataatttctgttgcctcagcattatttcataacacttgtctcttccctgaatttttcacagaagactaactgaaatagttggtaaatttttctgtatgtttcttaccattttccacaaggtgttggcatgtgtagaagaaaatacattaagattggtgatcaagattggttgaatggaatctcaactagtatattaatacattttaaatgttacaatgaactgtaaattcatgggtaaaatatcaggggtaaacttattttagtttctgttatagcaagggggaaatcaattttaaaataccacacaagtattgccatgaaattcggcattaaaatattccattaatacctatcatatgcaatttatggaaaagtaactatttaaaaaatttattgttgtctcattcttcaaaaggtttaatttttagatatccagaagaggactatgagtcatttccactctcagaatcagatgtacctcttttctgccttcctatgggagctactattgagtgctgggatcctgaaaccaaatatccacttccagttttttcaacttttgtcttgacaggttcttcagccaaaaaggtatgtttttgtctcattgattaaacacattttgtccatgtttttatttcataaaaaggttaatacaagttttatttgaatgttaggattatttggacatgatacattttggtttaaatttacactgtcatccccaaggtgagaaatcaacatgaaaattgctatcaggatattgatacctctggaacttctacagaagcaaagataaagtctctctggatagacaccttcaaaacccaggtgtcaagatgagatgattatgacagatcaaggacataggtaccatagaaagaatcgacagacacaattaaaaagcagggttagaccctcaagacattgaaatgacagaatgacaatataaaggatgttataaattaaaatatcattgagatgacctaagaactaatggaggggctcaaaatatcaaggaaggaacaggatattttgaaaaatgaatagattgggaaaagaatcaagtgtttagaaatgaaaaatatggtccttaaaattaaaaattcagtgaatgggttaaacagcagagataaggccaggtgcggtggctcacgcctgcaattccagcactttgggaggctgagacaggtggatcacttcaggccaggagttcaaggccagcctgggcaacatagcacaactccgtctctactgaaaatacaaaaaattagccaggcttggtggtacacgcctgtaatcctggctactcgggagggtgaggcatgagaattgcttgaacccgggagacagaggttgcaatgagctgagactgcaccattgcactccagcctaggctacagagcgatactctttctaaaaaaaaaaaaaaaaaaatagcagagataagacatacatgaagggataattaatgaagtggaagataggttaccttaaatgtggtacatacaaatgtaaaacataaaaggagttttaaaatgtagcagatagaactagaaggtctaatagatatttaatgagttactgaaggagagactagaaaaggacaaggctacatcctaagagctaatggttgagagttttccaaggttgatgaaaaaattgagtcttcaggttaaagatgtactctgaatctgcagcagagaaaaataaacaaataagtaaataaataaataatcccacctcttttttttttgagacggaatgtcactcttgttgcccaggctggagtgcagtggtgcgatctcggctcactgcaacctccacctaccaggttcaagtgattctcctgcctcagcctcttaagcagtgggattacaggtgtgcgtcaccacgcccagctaattttgtattttttttttttagtagagacaggatttcaccctgttggtcaggctggtctcaaactcctgacctaaagtgatccacctgcctcagcctcccaaagtcctggattatacaggtatgaggcaccatgcctggcctatcccgcctcttattatatcatggtgctatcatggaacaccggagacaaaacaactagagagaaaagacatttattgtcttatgtaaaacatatattgtatataacagtaataatgacataaactgatttataaagaagagaaggcaaaaataaacaatattcagtataaaaagctgatagcagtagaaatttcaaaattgaaaactttcttttcttttttttttttttttgagacgaaacctcactcttatcccccaggctggagtgcaatggcacaatctgggctcactgcaacctccgcctcccgggttcaagcgattctcctgccttggctccccgagtagctgggattacaggcacctgccaccacgcccggctaatttttgtatttttagttgagatggggtttcaccatgttggccaggctggtctcgaactcctgacctcaggtgatccacctgcctcagcctcccaaaatgctgggattacaggtgtcagccaatgcgcccagcaaaaattgaaaactttctaaggaaatttaataggcgattttattgaaaaaatatataatctgaactgactcatgcagatgaaacaaaatacatctgtgacctcattctacaggtacaggctacacctttataactactgtgataaagataatatatgtaaagtatccagcatagtgcctggaacatagaaaatactgagtgaaggtcaatattatattaacttgattgcccactactaacttgttagcttaataatcatttacaatttctcctgctgaaagtagtaaatataactgaaaattttaagatcttcaaacattagttacctaatatgctttggcagtagagaacaataaagtctcatttgagatgtgggtactaggtgatctgcttggctttttcattgtttaggggatatcaacatgtaagcattgaggtgtgtaaaatttaggtatttgtcattgcttgttaaaaactttgagatcactttgaaataattatatctgggaatattgtgtgtataaaggcaagggttataatgaaaaaacagttggcaagatttataaaatacagaagtaaggattgattgttgggagaaggggatgggttaaaaactttgagatcactttgaaataattgtatctgggaatgtgtgtgtaaaggcaagggttcctgtgatatatataatgactaaacagttggcaagatttataaaacacagaggtaaggattgattgctgggagaaggggatgggtatagtgatagaatttctttgcagtgttttaaggaatgggcagatcagaggaagtaccaaggctaaacaaaatacataaaagcacaaaattatgaactagtctatatgcctggtagctctgtattgttgaaaagcaacagcaggtactgtgaggaattgagagcatcatgccacttacacggactgtggcattttacctgtaatggggaacttttgaaggatgagatattacctctgaaggactgtttcttcagtgtatttttcactaaaatactttctcttctgacttgagaccagttagggcttcagtagttgctttgatatgtggtaagtggaagtggaattgaacatgacttcgaagtttctaccttgggaattgtgtagcatgactgagtaagattaggaatattggatgaagtgtttagatgatgagctcacttttgaaaatattggtttgagatgcctgtatgacatccaggtggagattagtgagtagtcattttgaaaataggagtctgaggttcaggggagaggtcaggtagacctagagataaagatttgtgttttgttagtataatgattatagttaaaaccatgagagaatgaaatgttccaaatagaagtgtgaagttagaaccttagggaatgctagtatttaaatgatgggtgacataattggatctagtataggaaagagagaagtagccagaaagcagagaaatttgtactgtcaaagacagcaaaggaataaagagtttgaagacagaggagtgtcagctttatcttgtgtcatacaaggaaagggtgtggaggaattgaacctgtcaacattgctgatgagaaagtcaaatgctgctgctgtggaaaacagtttggcagctcctccaaaagttaaacttagaattaccatatgatcgagcagtttcatgcctaggcatatacctaaaataattgaaagcagagactcaaacagatacttgtacgccaatgtttgtagcagggttattcacgataggcggaaggtggaaacaacccaaacgtgcatcaacgtatgaatggatacacaaaatatggtatatatatatgatggaattatgatttcttccttaacaaggaatgaaattcagatatttgctacaatataggtgaatcttaaaaacattattctaagtgaaataagccagacacaaaagcataaattttgtatgattcctcttataggaggtacctagaatagctacccttatagagatagaaagtacaatagagattaccagggacttggattgagggcaagagaatgggaagttaccatttaagggttacagagcttttgtttggggtaatgaaaaaagttctggaaatgaatagtgctactgggtgcactgcattgtgaaggtacttaataccagtgaattgtacacttgaaaatggttaaagtggtacgtttaatgttatatatatttcaccccaattaaaaaaaaatcacaggccgggtgcagtggctcatgcctataatcccagcactttgggaggctgaggctggtggatcaccaggtcaggagataaagaccatcctggctaacacagtgaaaccccgtctctactaaaaatagaaaaaattaggccgggcgcagtggcgcacgccgtaatcccagcactttggaaggccgaggtgggcggatcatgaggtcaggagatcgagaccatcctggctaacacggtgaaaccctgtctctactaaaaatacaaaaaattagctaggtgtggtggtgggcgcctatagtcccagttacttgggaggctgagtcaggagaatggcgtgaacccaggaggtggagcttgcagtgagccgagatcgtgccactgtactccagcctgggtgacagagcaagactccatctcaaaaaaaaaggaaaaaaaaaattagccaggtgtggtggcacatgcctgtaatgccagctactcgggaggctgaagcagtcacttgaacctgggaggcggaggttgcagtgagctgagattgcgctactgcactccagcctgggcgactgagtgagactccatctcaaaaaaaaaaaaaaaaagaaaaagaaaaatccacaaaaaacttaagttgagtgagatcattagagttcattctctaatgcttaagttgtaagaggttaccatccatttttgtataagatacatagttgaatgtataaaattgcagtggaaaaaatcttgagggatttatatcaaaatctggttatctctgggacagaaatttgggtgagattttttttttcataatttatctgtataagtgtactccaagcaaatatttcttgtgtaataagaaaaaaagagaagttaattttttcaaacaaactcaaatcttataacagaattctgttactctttaggtatatggagctgccattcagttttatgaaccttactctcgggaacttctatcagagaaacagcttatgcacctgggcttgttgacgcctgtggagagaaaaatggtctccaaatccatcaatacaaacaaatgcatttgtttactctcacactggcctttttttgaagcttttaggaaatttcttatgtttatctacaaactttctgtgtctggaccacatcctcttcccattgaaaagtatgtataatgattagaaagatggctggtggaaaactgggtatataaatatatacatttgtttgtgtaatttttagcagcaaagttggaagggaaggaagcctgcatttaactgaacttttttttttttttttttgagatggagtattgctctgtcacccaggctggagtgcagtggtgtgatcttggttcactgcaacctccacctcctgggttcatgcagttctctgtgtcagcctcccgagtagctgggattacaggcacctgccaccacgcctggctaatttttgtagagacaaggtttcaccatcttggccaggctggtcttgaactcctgacctcatggtccacctgcctcagcctcccaaagtgctgggattacaggcatgagccaccaactttttacttactcccttcttcgcctgaatcattgactgtgagcttaaaattggatagtagtggtaaggttggccaaataataatcctttgagaattcagctgaagaagtaactcttataaattatattgtgagtgttcttcttcctatttattctctaataaccaagagacaaatagttactgctgcacacacacccaccaatgcaagtggccattccaaattctaaccgtaatacctctctaaagtgatgtagaaattagtcggaatgagttaattgatgttaaaagtggagttttggttttagcattgacagaattatttgagctttctctttaatttttaattctttttgtcatgcgatctttctttcctaagaaagaaaaatgtatgttgagctactcttttttaaagcatcttttctgatttctagtggcgcattgacttctgtttatgatagtttataatttatgtatcctgctaacaaactaaaaagtgtcaagagctgtaatgtattaaagtatgtgtaagcttagatgtttcttacaatttcagaacttttacattatagcagaaagaatatcagtgaaacatactagtttagtggataaggtaggggtaattatgtgagggtttaaaaataatgctgtccaaaaatcaactttaaaaagagtgaagtactgtgcataaactcatcataatttgatattgaaatatggttgcaactttcattttgtactcttgaaatggcagtttaatgatttatagttctgggtttaactttcagctgtcagattaatttaaagtttattgaagtaaaatgtaacattagtgtcaagttagcaaccttttgaaaaattaagattctatgaatagcttgtgataaaatcaatgtatataatcaatatttttttcagttgaagtaatatgttgcgtttttatggctcctaagagctccaaactttggagaaacttaagaagcaatttttataggtgcaaaaatagaatgggtaggtggttcatccagtgttagaggagtaaatctgggattaaactgaattttagtgtaaattcattatagcacagttagttgctccctgtactggcacagataaccagggctataaaaattcacttctttcatgaaaactatttttatgttatttttatttgttgggtaatgataggggatataaatagactttaagtcaggaaatacattgtgtatttcagaagtttaatgggcatggataaattcatttacatggagcaaatttacttacttagcctacattttagataaatggccatgtcatatctgggatgatatatagtgatatttaagatttgttaaaaactgtgatgcatttagaaaagtaattattatatttatttcaaatttttttttctaggcacatttcacattttatgcaaaacatcccttttccttcaccacaaagaccgagaatccttgtccaggtaatcaaaagagagtatatttggggagaactttgcatatgctcacctgagtcattgcagagtggattctgtatacctttgggtttgaggtggagcaatatgcattcataaagtccttggattttctgtgctttgtagctttactgaacaccctttcttactgggttttggatttgagtgtactgaattggaataattataacccttggttcataacattttcatttttggcccatgcatgacctttatgtagctagttttaataacataaaacccagattatgtttgggcatgtttttaataccagattctctaataaatattgaatataaaatgagcaatggttggaggaggttaatttaaacaaggtctataatagtactgtgctaaaggaccagtttctttttattttcagtaagtagcagacgtaggtaggtgtacagcttgtgacatatgcaacatgaacaggtctatatcctctctataataatagttctactgatcacatgcttggatataggagagaggtcagattgtcataaaagttgcttaatggtttgctcttcatttatatactgtatctttctggaccataacaattaacttactgacatacttaacatactttcagtagcactgatctatagagggaagccatttaaaagtttttctaagacattcttaacattatgtatggtgggattaagtcagatattgttgatcttgaatgttatttcagttccacaagtatttacgtgccaagcaactgccaagtgcctacagtctgttgagtaaatgaatttgaagcttttcagaagcagtagttccataaattttaaataattgtactttaaccaattaagtgaatcaaaattcagtcaaattaaccatttaatgaaaaagaactaatgtaacacttctgagtaaatacagctatcattttatattttagtacctgtttccaaaagtgtgtttgcatattaaattattaatgttttcaatattacctttgatctaaatatatagatttcaaaagtagttttgaaacttatctcttggtttggttaatttatctttggttaatttatcttttttttttttttaagctgtcagtccatgatgcattaatattatcacagccagtttctacacctttaccactaaggtaattactggtatttaaaatgatatatttattcagttggagcagaatgctttaaaatattttagtgattagtatattattaatatattagtgattgttattttacaattaactttattagttaaaactaggcaaaaatagccttaatgtttctgactttggtaactgggtggatggtggggctattttataaatgggaacaattaagagagttgcaagattggatgtagaggatacttcccttttcttctcatctccccttcccatatccagttcataactaaaggtttaaggtgagctgattttaaccttttaaatgtctcaaatccttttacttcttttcatctgcatcatagtaggcttccttgatgtcttaccagactatttcactattagcctcttaattggtacctttttacttatcttcctttagttctttatccaccctgtagccagtgtgtccttttgaaaacgcaaatataatagtatatttcaatttcagcctaatctgttgctgttttcaccctttcccttactatgctttagtcacaatagatttatttcaatttcttggctatgacaacagctttttcttgccccagggcccttgcatatattgtctgtcaccccttcactcccatccttgtctccattcttctgagctcaactcaaatggctgttcaggaaaatctttcttgataaatgccttttattaccagaggatgagtttaaatcaccccgttatctatcttattaaatttgctacttttcattgataaataagtaaagactagaaattaacactagactctcaatctgttgatactttaataagcaaatcttaacatatttcagcaaaatagttcacaatgatctacttttctcttttttttccctagtggagccaactttagcaccttgctaatgaatctgggtcctgagaattgtgcaacactgctgctctttgttttacttgagagtaaaattctgctgcattctcttaggccagctgtcttgactggggtagctgaagctgttgtagctgtaagtatagaattttccttttagtacaaaattactgacataatttttactccaaagggaaattttcttcaaaaacagcaactttgtaaacaacaacaaatttaaaaaaaggaactttgaaaaatttccagcccagtaaaagttgaatataatctgctggcaaagagaagtaggaaatataaagaaaacaaaggtgatttctattttaggaaaaacgtcaatttccaatttttcatatttttgagttcttcccagagtaaaaactatatgattatataataaaacctgagaatgaagctggttgtattgagaggctctggccaatttcagctgttctaaaattatgcaaatgattacatggttaatttctccctattttaacttttaataattgtgaatcagtaatatacaggaaattctaagtgattgtgaaataggataatatacagaggcttagctcttgtgtaaagcgtaaataaaattaaattgttaaattgttaagaaattaaagttgttccctgcttaaaaccctttggcttcccattgcacttagaatgaagtctgattgacaggcatggtggcttacacctgtaatcccagcaatttgggaggctgaggtaggcggatcacctgaggtcaggagttcgagaccagcctgaccaatatggagaaaccctgctctactaaaaacacaaagttagccgggtgtggtggcacatgcctataatcccagctactcaggaggctgaggcaggagaattgcttgaacccaggaggcggaggttatggtgagctgagatcacaccattgcactccagcctgggcaactagagtgaaactccgtctcaaaaaaaaaaaaaagactgaagaatgaagtctgattgtatagggctttataggccattgtatagaactttagatggtccacttctccaaccctatcacccattagttgtttaatttaaaatagctgactctcttctcttcccttccccattttaagaatgtaagtctcctgggagtaaggacctaatctcttgtttactcctgtattttcagcacttgttacagttgcctagcacagagtaggccctcagtaaatacttgttaaaacaacaaatggggtatgtctccaagatcttaatctggttgaagaagtgctgttaggactgaaaacaatagtaaccatatgagaaagcttccaggaggatcctcattaagtattacttttccaagtcatcacagttgtgtgtgaaagcaaaagttgttagaatatgaaaatatttgttaatgaactgaccagttctagaaagttcccacccaggccaggcacagtgtggcacacacctgtaatcccagcactttgggaggccaaggcaggcagatcacgaggtcaagagatcgagaccatcctggccaacatggtgaaactccatttctactaaaaatacaaaaattagctgggcgtggtggtgcacgcctgtagtcccagctactcgggaggctgaggcaggaaaatcgcctaaacccaggaggtgaaggttgctatgagctgagattgcgccactgcactccagcctggtgacacagcaagactccgtctcaaaaaaaataagttcccaccaaaatattccttactaaaacagtgtttattgaagcccctttgtcagaatcgtggtggccaagtcttttgatggatttcagtagtatggtgcaagaacagctgaaaaaagtgctacatggaattggtaatcatatgaaaaatgccagagtatatgaggtttatgcaactgatgttggagagctgtctgaattgcatgcaaaattatttataagtcatgatttggtagttatgccagttaccatttgaagaagagaacattgaaaagaatggttacaaaacaaatgcatcaaaaggagaatgatttaaatatcaaagaatatcaaagaattaagggagacccatagcaaagattgataaaatgtacaagtgctttataaaaagtgaccctatagtgttgcaaaaaggcaaaggtgaagagaaggatatcatattttgctagcatatagctttttttctaaggtttcttagatagttggaggtgtaacataccttttgttgaaaaggagatagttgtcactcaaggaaatctgaagtccttgcagggtcctttgtgagtgatagttgcagatgtaacataccttttgttgaatagaagataattgtcactcaaagaaatctgaagtccttgcaggatcctttgtgagtgatagttgcaggtgtaacataccttttgttgaatagaagataattgtcactcaaagaaatctgaagtccttgcagggtcctttgtgagtggctctgcccttcagcaatctgatcttattttccactcctcttcctcttgctcactcttctccagcattctggccttaccatcccgggagcattaggcattccccataccttaaggcctctgccctagctgttccttctcattaaagcactcttctcttatatatccccttggctaaatctctcaccttcttcaggtttcagctctgttgtcactttattaatgagtcctgttctgtttgtcctaatagaacctgcttttcttctcttctgctctgaactctaatgtcctttacttggctttacttttccttttttttttttcatagcacttattactttctgacatataggttgaatatcccttatctaaaatgcttggaaagaagtgctttggattgaggacttttttggattttggcatgtttgcagaatacatgctggttgaacatccctaatctaaaaatctgaagtcctaaatgcttctgtgagcaatttcttttctgtgtcatgttggtgctcaaaaagtgttggattttgcagcactttggattttggattttcaggttagggatgctcaacctgtagtataatattttattccttatgtttttcatttattttctctcttcctgctagacaaggtgtttgcaaatggtggccgaatcctgcctgccaaatcctgcctgccacttgtttctataaagttttattggaacacaggccatttattcatatattgcctatgactgctttcatgcatgacagcagagttaaatggttgtgacagagacaatatggttcacaaggcctaaaatatttactgtcttttacagaaaaagttgctgacttttatcctaaactataaacctcatgaggagagtgatctctttcatttattgttaagctctcattatgtagaacagtgattggtacatagcaagtgcccaaatattaagtaaataaatgtttgaagacaaaattccaatcctgaataaccctctgtaatagctggcaggggtagtaagcgttataggcatttctttggggtgagtgatgacagataagggtgataattgaactagaccttaaaagataacagggatttttatagtagaagaaaaacattatcatcagtaaaattttagtactagctaattattaaatttttttttgtaaaatttattcatttatttaatttttttgtggagatgagggtctcactctgttgtccaggctggccttgaactactggcctcaagcagtcctcctgcctcagcctcccaaagtgttgagaatcactgcatttggccttaacatgttttagtcttttttaaaaaacatcaaaacctgtcttttttaaaaaaaaaaaaaacccacaaatgatgcaattgaagtaaagctttgtaaaggaaaatgggtaaagattcttgaggaatgtttttttctcttttttctttttctgtcttatcatgtctagatagaggaatattttatattgatttttttttttttgagacagagtcttgctctgttgcccaggctggagtgcagtggtgcaaactcggctcactgcaacctctgcctcccgggttcaagcgattctcctgccccagcctcccgagtagctgggattacagacatgtgccaccacactcagctaatttttgtgtttcagtagaaacatggtttgtacatcttggccaggctggtctcaaacttctgaccacaagtgatccactcacctcagcctcccaaagtgctgggattatagatgtgagccaccgtgcccagccaattgacagtatttttaagatgtcaaacatcactgatgtttatttgaagagttacgaatttttttttttttgagaccgagtctcactctgtcacccaggctggagtgcagtggcacagtctctgctcactgcaagctccacctcccagattcacgccattctcctgcctcagcctcccgagtagctgggactataggggcccaccaccacgtctggctaattttttgtactttttttttttttttttagtagagacggggtttcaccttgttagccaggatggtctcgatctcctgaccttgtgatccacccgccttggcctcccaaagtgctgggattacaggcgtgagccaccgcgcccggccatgaatttttttttgttgagctctttaattatctgttagcattccctggaaaataattagtttttttttttttttaaatcctggatgcttttagttggattttgatctgaggtaattttgagaattaataggtgaatgaaatgtgtaagagttaaagataataagtttattttatgatatttggggccattttattttattttgattctttccataaaattggaatgtgtgctttgtatagatactagaagaattaacatgcaaaaagctgttagtatttttattgtgcttatgatcatcgtcatggcttgaaaattttaattacatttgttcttagcattgcttagtagtattttatagtcatttagttttggaatgaagtttaaggtaaacaaaacagacttaactgcttttcagtggtcccttttcagtaatactagttacttatatattttttattgcaaatttaaaatttggttaattttttaaaactttttccccagatgatctttccatttcagtggcaatgcccatatattcccctttgtcctctttcactggctgcagtgcttagtgcacctttaccatttatagttggagttgactcaaggtattttgatcttcatgacccaccacaagatgttgtttgcattgacttggatacgaacatgttatatgtgtaagttgattcattttatattatctcccatttatatttttcactatgtagagttacagttctttgaaagcatctagaaatatgctatttttggtagttgttaaatcttcgtcttaaatacagcagctctcaaccagggcaggtatcagaatctgggaatgctgtgtgatttgggaaaaaaaaatgttcagtattataatagtttatatttgggtaacaatattaaatgtaagcaggagatatttatgtttatcagaagagactatgagttggaaaagtaatggttaaacactgctttcagagctcaagagatgatatgctttctgggtttaattcaaaatccatatgtaagtaaaatgggtttacccattggagataaagtttggctacagtatagggtgatattataccatttgcttagttgtcgggattttaattttataaggatctgttgtttactgcttagaaatttatattaaaaatcagtgatagtttgtgtttgctgaaggtgataattaagtacagcagtggtacagctgagggttcagagagtagcaaactacattaataaaagaaatagttctggatggatgtttaagggttaccacttccccaccaaaagtgggaaaggacagtaagtattaaaaatgttcttatgttggtgccaacttccaggccgtagaacgcttttattctttactgtttgagattggtagaaaatgaagagagaaatattttgggtaaggcctgaatagttccaacagtagaattcgttgggaaaatatttttatgtgaaccaaaaaaataacctaagggaggaagaaaacatttgctataacttaaaatataattttgacatggatctaccattgtattttgaaactgtatagctatagtggctccttatgtatatttagatttacttacagcttgaaagtaatgaacaacttgcatgaattagttttttgtagcacacattttattgtttgtaggctactctccctgaaaaacaattatttcaggaatgtattcattgtggtacttttagaaatgattatttgtgaagttaatactcagattttttaccttattttatttttattctgaataaaataatatggagattcttaattttgcgcagttttgagtaacttttataaaacttctggtaatcaaaacattattttctaaaataaatgtgaagtgtttgcacaattgtatttatttatttatttatttatttatttatttatttatttatttattttgagacagagtctcactgtgttgcccaggcaacagagttgcagtggtgcaatcctgactctctgcagtctccgcctcctgggatcaagtgattctcctgcctcagccttccgagtagcgggaattaacaggcgtgtgccaccacacctggctaatttttttgtatttttagtagagatgaggttttaccatgttgtccaggctggtcttgaactgctgacctcaggtgatccacccaccttggcctcccaaagtgctgggattacaggcatgagccactgtgcccggcatgctcaattgtgtttaaagaattataaaatgtgcccaggtgtagtgtctcacacctttaatctcagtactttcggaggctgaggcaggaggatcacttgagcccaggagtttaaggccagcccgggcaacttggtgagactccatctacataaaataaaaaattagctaggagtggtggtgcgtgcctgtagtcccagctacacaggcagctgaggaggaaagatcactgtagtccaggaggtcgaggctgcagtgacccatgttgacccactgcactgcagcctgggtaacagagcaagactctgtctcaaaaaaaaaaaaaaaaaaaagaagaaatacctccaaattatacagaataatgtaaataacttgtatctattcaccacaactttattaagaaataggccgggcacagtggctcatgcctgtaatcccagcactttgggaggccgaggcagatggatcacctgaggtcaggagttcaagaccaccctggccaacatggtgaaactccgtctctactaaaaacacaaaaattagccaggcatggtggtgggcgcctgtaatcccaactactcgggagtctgaggcaagagaattgcttgaactgaggaggtggaggttgcagtgagcggagatcatgccattgcactccagcctgggcgacagagcgagactctgtctcaaaaaaaaaaaaaaaaagaaaatattagcaataaatctgaaatccctagatagtcctccacaaccatattttgctcctttctcccagagaggagctccagatccaaccatcatcttggataaactccaaatccaaccatcatcttagatttggagtttatcacatacatgtatttttcaaacatttattatatatatattaatctaaataaaattttgttttgcatacttataaatttttttctacttgaatagttttctgtgaattacttttttgctcaccattctttgtgaggttcattcagttcattttcaacagtgatcaatgttgatggacatctaggttgtatctagatctttgatgttaggaacaaagctgttctgatcatcgtatatatttccttgagtatatgctcaggaattcctctgaagcatatacctggaagcgctaatgttgcttggtagggaatgagcattttcaacttaatagctaataccagattactctcccaagtttactccgtcctcagcagatgagagttctctttgtttcatatctttgccaacacttgtggtgacttttaaattttttaccaatttgatggtaatggtatttcactgtggctttaattcacatttcctttattagtagcaaatggaggattttcatatctttgtgccccttggttttcctctcctgtgaattggatgttccttttgttggtacattttcctgttagattgtttgtctttttcttttgatttgtagaaattgtatatataatctggaattaattctttgtctgctgtatgcattccagatagcttctcccacattgtgacctgtcattccattgtgtttatggtatcttttgataaacaggggctcatcttaatttatcaaatttattaatttctctttatggagtactgtttttggttcttgtatatgagatattttgccttgaggccatgaaatactatcatggttatttcttaagttgtgaggtttgcctctctcatttagttatttaattcagctaaacttgatgtgacatatcagtttctacatttgtataaatatgtatctgggctaattcttttcctttgatttgcttcaatctcttgccagtattatactgtcttaatggctttaaaattaagttgtctacaacatgaatgaaccttgaaaacattatgttaaaagaccttatattataattcaatgaaatgtccaaagcagacaaatctctagaggtagaaagtagattgattagtgattgccttggaatgaagaggatgggagtattggaagctaagtgactatgggatttctttttgaggtgataaaaatattctaaaattgcttgtaggccgggagtggtggctcacgcctgtaatcccagtactttgagaggctgagacgggtggatctcctggggtcgggagtttgagaccagcctgaccaacatggagaaaccccatctctactaacaaaacaaaactagccgggcatggtggtgcatgcctgtaatcccagctatccgggaggctgaggcaggagaattgcttgaacccaggaggcagaggttgcagtcagttgagatcgtgtcattgcactccagcctgggcaataagagcaaaactccatctcaaaaaaaaaaaaaaaattgattgtagtggtggttacacaattccgtgaatatgataaaaaccattgaattgcacaggtcaaatgtgtgaattgtatggtgtatgaatttatatcttaataaaactgttttaaaaagtcatggtatgagactttttttttggcaatgtccatggtgaatccccttactcctgttctttttaaaaattgttttgactctatttggtcttttgtttttccatgtaaattttaataccatcttattaagctccacacaaaattacattgggatttttgttagaatttttttttttaccttttaaattttttttaattgatatcgtaattgtatatatttatggggtgcaatgtgatgctttggtgtatgtatacatcatggaatgtttacctgaagtggttaatatatattgtatttatagattcgtttggaggcagatgatacctttttgacacacgttgaaaatatgcacaagaaatatgacccatgaatgtgatatttcacttcattggtcttttcagaattttttggtgaactttgtgttttctccagaaagataattcacatcttttgttagacttatttattcctaagtatctttcagtttttattgctactgtagatggtattttaaattagactttctacttgttgctaggaaatgtagttgatttttatatagtggtcttatatctagcaacttagttgaattccttttttaatttgtatattatcttcaattttctgcctataaacatcacatttctctacttacactatcctaatgtattttaaaattttttatcttaattctccagctaggatcgctagtgtaatgttgaacagaagtagttatagttggtatcttgtcttgtttctaatttcaaaggggatactttgagcagtttgtcataaagtatgattattgatatacaacagggattgacatctggcccaaagcttgtttttgtaaataaagttttattggaacacagccatgctcattcatttacatatggcccatgcctgcttccatgatgcaacagcacatttgagtagttatgacagagactgtatggtccttaaagcctaaaatatttactgtctggttctttcagtaaaaatttgcctatccttcctctagagttttgatatcttaattataaattaaggaatttaccttctacttctatgtcattaaaattttttttaaatcataagtagatactgaattttataaatactttttgtgatcttcttatagttgataagcgttgatgattggatgttcacgcacatgtgtgagatgtgcctcctacaacttgatgttggcatattacctgtctgatgtgaaaggaaaaaaaaaacctttttgttcagctgttgagatgagcattttctcctttactctgtgtggtaaattacattataaaatcaattagtagtagacagtccttgtattcctgaaataaacatcattatagtggattaaatttgctaagaatttaagataattgcattgatgttcataaatgatattggcctgatgtatggctttttagttgcggaccatactttgtatataatgcttttatttttgtagactttaaatattctttatttttatcaaaaaaatttatttgacttatgtattacattaaagtttgtcttttgaatttccaaagtttttttcctttgtttgacagagtcttgctctgtctcccacgctggatggagtagagtggcccaatcttggctcactgcaacctccacctcctgggttcaagcaattcttgtgcctcagccttctgagtagctgggaccacaggcatgcaccatcatgcctggctaatttttttgtatttttagtagagacaggatttcaccatgttggccaagctggtctggaactcctgacctcaggtgatccgcccacctcggcctcctaaagtcctagaattataggcatgagccactgcgcctggcccccacaaagtttattttctcttaaatgctaactccgttgaattgtgatcagaacattctctgttactacttgttgagatttgctttgaagccaagtatatcgtcagtttttgtaaatattctatgtgaaagagttcctagaaattgtcaaaagaccaataactctatagaaaaataggcaaagactatgaagacttttcacggaaaatcaaataagcttaagcttatttaatgcttaagcacctcactcattataggagaaatgccacattagttcttcatgttgatactgctttttcacttttcagattggccaaaaagaaaaaaaaaattcaaaatgaaatgcttaaatagcatgctatttgaggatgatgggaaataagcagtctttatgcattcactgcagttagaagtgagatatatatgatgacagcttctatggaggatatctggcaacatttgtcaaaattacaaatatatatactacagcaattccacttctaggaattgatcctaacattttattttgtatgaaatcatgtttgttcaaaatagaaaaagaaaaatccagatgtcccagacttgttaaatggctcctacagtggaatactactgtagcgctgtaaaatgagcaaggatgctttctgtattgggaaaaaaatcacaaaagatattttgtttttgtttgtttgtttttgagacagagtcttgctctgtcgcccaggctggagtgtagtggcgcgatcttggctcactggaatgtccaccttccaggctcaagcaattcttatgcctcagcctcccgagtagctgggattacaggcgtgtacaccgtggccacttaatttttgtattttttgtagagatggggtttcaccatgttggccaggctggtttcaaattgctggcctcaagtgatatgcctatatcagcctcccaaagtgctgggattaaaggtgtgagccaccatgcccggctacaaattattaaatgaaaaaaatcaaggtggtaattgtgtattgcagtgtgctgctacttgtgcaaaagaaaaggcagggaatagttgtatttacttgtatctgctagttttggaataaagacacattaaaatatgcacaagaaactagtgattatgtattatgggggtgagggagctgagcagacatggaacaagggtgtgtgtatgtgttttaagttatttttgagctgtgtgatcatactaaagttttaaaactcccagtgtgatggtggatttgtcaattgcattttatagttatttggacatttgctttatgtacttaattaaggctgtgttatgagggacactcaagttcaaaatggttctgcagtgaaatgaatacttttgtcttgtagccactttaaaaaaaatcactgatgctctttttgttagtttgtgcttttcttctcattaatacgttatgttagatatattatgtttggtatatcttttcccatccctttaatttcagatattctgtgcatagtatataactggcattaaaaatccaatctaacatttgtctttttattgaagagtccattaatttacatatattgttatatatttgaacatttctgtcttattttgtcctttttgttctgctgttattcttttctctctttcagattgaatgaattattctgtttttttcccatctacttacctaaatgttatattatgtgtgtctataatttcatatttatgttcctttaatgattcctcttaattttttaatatgggtacttagaacttaaaattaatattttactctttttttaagcagtaaagtagactttaaaatactttaattggcaatatcctcttactctaattggtacaaaaacaatgaattttacaattgatggccccttagattagatgaaatgtagttcatctacccacagtagccctgtatattaggtacattatcagtcctcattttgcagatcagaaaattgagtaacagactagttgactgatgtatacaaactcacacagatagtaaacgtcagggccagattacaaatggatgttaatccagacgataatgacagtattttatttgggggtggggttaaaagatagcactaaaatattagacagcgattacataaaatgagagaagttgatcagagttaaacttgacatgccatcacttttaagacacagtttcaagagacgttaaaatatgtcttttaacagtaccagacacaagggaagtgttagctcttttattagacgtttatccttacagagaggatattatgtttgcttccattctggtggcattaagccagggagcacttgaagttagttattttgacttacagtttcttgtgccatgccagtagcgtgctgtcaaactcataacccattagttggcaggcatatagtaatgaattctcaggggagatccctcccctaatcaaaatccaagctgagggagctaagctatgaggacacaaggcataagaatgatgcagtgattagctaggtatggtggcatgtgcctctaatgctagctacctggtgggccgaggcaggaaaatcgcttgaacctgggaggaagaggttgcagtgagctgagattgtgccactccactgcagcctgggcaacagaacgagacttcccctcaagagaggggaaaaaaaagaatgatacaatggactttggggacttgggggaaagggtggaaggaggttgaggaacaaaagactacacatgaggccaggcgcagtggctcatgcctgtagccccagcaccttgggaggctgatgcaggcggatcacgaggtcaggagatcgagaccatcctggctaacacagtgaaaccccgtctctactaaaaatacaaaaaattagctgggtgtggtgccacacgcctgtagtcccagctactcaggagcctgaggcaggagaatcgcttgaacctgggaggtggaggttgcagtgagccaagatcgcacctctgcactccagcctgggcgacagctcaaagactacacatggggtacagtgtatactacttgggtgatgggtgcacctaaatctcagaaatcaccactaaagaactaattcatgtaaccagacaccacctgttccccaaaaacctattgaaatttaaaaaacattgacatattttgttaaaataaaagatgtaagtatgcaaaaaaagattccaaaatgcaatgacttgcttagaaaaaaaaactgcatgtgaactgcactgagtgctaaagaaaaataatacaaaatagaacctgattaaaaaatcatttcattaataaaggtacaaccagtgttccaggttgatcctaaagctggaatctctgcccttttcattatgccatgctacatttagagaaacctaagcaattcactgacttaggtaaagggcttacaactgtagcattttgggttaaaaaaagaatcaggctgagtgcagtggctcatgcctgtaatcccagcactttgggaggccgaggtgggcgtatcacatgaggtcaggagtttgagaccagcctggacaacatgatgaaaccctgtctctactaaaataaaaaattagctgggcgtgatggcgcgcccctgtaatcccagctactcaggaggctgaggcaggagaatcgcttgaacctggaatgcggaggttgcagtgagctgagatcgtaccactgcactccagcctggacgacagagactccgtctcaaaaaaaaaaaaaaaaagaaaagaaaaagctgagccagactttcaagggtaccagttttatttggaagtttcagttctaacatacttcttggtgagactgaaactatgtgtcctgttctgtgagaagcctttaaaatccaaggctgtctgttaatcttcagggcagatgtggccttggtgttactctgggttttcaacccgtgaagatgtccccaattttcttgccagcttaaccatgaattttaaagaaagtttgttatatttatgctaacttttgtaagaagagggctttttaggcagttgtctgctgtattttatattcttatattcttggaatatatatatatatacatgtatgtatatacatgtatatatgtatgtgtatatatatacgtgtatatatgtatgtgtgtatatatacgtgtacatatatgtatgtgtgtgtatatatatacacacacacatatattttatattttcggaatataaaattttggaaaaagaagcttttagtaatacctttaaaaatggtcatctctatggctttggggtttttttttttctttttgagacatagtcttgctctgttgcccaagcctgagtgcagtagcgcaatctcggctcactgcaacctccgcctcctgggttcaagtgattcttctgcctcagcctcctgagtagctgggactacaggcacacaccaccacacccggctaatttttgtatttttagtagagacggggtttcaccatgttggccaggctggtctggctttggtttttattgtttcatgatcatagattatattgaataatggcgttatgattatttttaactgtgagggctggatgaactacatgtgcttttaatccttacttaaattccagttcttgtctttgggcacacagcatttttgaagcctaccagtaggtagtttgaagtctcatgtcaactaggtttgacacttagaatattataattctaaaatgtaacttttgaatctagacttcagtgttgtattcctaactccaacattgaaaatatatgttggaaggttagaatgagatggctaaatttgacagaggtcgattgaatgaaaagagaacttccttgaaattcacttattcaaattgtttgcatcagttaagactgtagtaaaaacatcttttccattttcttgttttaggttgatgcaagaattttgtctagtaaaagcagattatgaataacacattttatgaattttgttctgatttaatagatcagatgaaaagaagaacatgaactggaagcaacttcccaaaaagccgtgcaaaaatctacttagcaccttaaagaaattgtatccccagctgtcttcaggtaatgtgagggaaaaggaatattattaatgaaggaatgtatacgagaaaattcttcttaaatttaacataataccattttctgtttttatttcctttgttagttcaccaaaaaactcaagaaggctcagcgattgacatgactccaattgaagcagatttctcctggcaaaagaagatgacacagcttgagatggaaattcaagaggcatttttgcgctttatggcgtctattttaaaaggatatagaacatatctcagaccaatcacagaggctccttcaaataaagccacagctgctgattcattgtttgaccgacagggtgagtagcattgaaagtacaattccttttattgaggtgaaaaatattttatatttgatgttgctgccaagaaatacttattgtataaattattacaaattcacattcaaatataatgaacctccatgtatttgtaacctagctttatgactagaatttcttgtaatttttatagcccatttttctcctgagaaatctgaaactagagatatttaattatgaaaagtcaaagatgttacctatatttacaatatcttgtagtcagttattttagtagaacataactggagatttgccttcaggtatttcctcaattttgcatagttccttggatttgtacacttttttttttttttttttttaatagagcagagtcttgctgtgttggccaggctggacttgaactcctggcctcaagtgatcctcctccctggctttccaaaatgctgggattacaggtgtgagccactgcacttggccagatgtgtacacttttggctttacaattagtttgtgcaatgagggcactacattttaaccatttttgactaatgtaactttgttccagggaaaaacgtatactcgttatttttagtatgttttgttttagggaattatagagatttttgttgttattcagctactgttatatatgtagtagcaatcttacatctatatcaatatttatgtgaaattattttacttctctgtgctttttacctagtgattactttaaaaaaaatctgtattttcccaataatccttttgtcctttatcttttctgctttagtgtaacttaccacttaaatatttagttactacttactggctagttattatgtaggaatataaagaagtataaaacctagctctatgggatcttaaatggaaaataattaagatattttaaaaatagaacaagtactcaagaaaacatattttacacagttttaatttggaagttttaagagttcagaaaaaaaagggatgttcttccaaatattccagtatttcaaaatgggtgttttggaagacttcgtggaagaagcatgacttggaagaatgggtagaatggagataaatggagaagaacagaaaaggctttctggaagtccataggcattaagagtcaaatctgagttagaatttctactttgttatttataaagtcttcctggagcttattaaagttttctctaatgggcgcagtggctcacgcctgtaatcccaacactttgggagactaaggcaggcagatcacctgaggttacgagttcgagaccagcctggccaacatggtgaaaccctgtctctacgaaaaatataaaaattagccaggtgtggtggtgtgtgcctgtaatcccagctattcgggaggctaagggaggagaatcacttgaactcgggagatggaggttgcagagagccaagatcatgccactgcactccagcctgggcgacaagagtgaaactccatctcaaaaaaattaaaaaataaaaataaataaataaataaagttttctcattaataaaatgggggtgatacctacttcatggttgtgaagattaaatgagaaaatatatgtgaagcaattgtgctagtacaagtactttaaaatattcatgataacagctattatcattcatggtaataacaaaatggaaatagcctcaagaggaaaagcacaaggtctgcggatttgtttgctggggctgccataacaaagtaccacagactaggtggcttaaacaacagaaattattttctcgtggttttggaggttaaactgagatcaaggtagttagcaggtttgatttcttctgaagcctcttcccttggcttgtagataggtattttctccatgtggtcttccttcagtgtttgttttatgtccaaatatcctcttcttacaaggctaccagtcttactgaactaggatctacccaataatcctcattttagcataattacctctttaaagaccctgtctccaaatagttacattccgaggtactaggggctaggaacttaatatataaattttgggccaggtgcagtggcttatgcctgtaatcccagcactttgggaggccaaggcaggctgatcacctgaggtcaggagtttgagaccagtctggccaacatggcaaaaccctgtctctactaaaaatacaaaaattagccaggcatggtggtgcatgcctgtaatcccagctactcaggaggctgaggcaggagaatcgcttcatcccgcgaggcagaagttgcggtgagccaagatcactgtactccagcctgggcaacaagagtgaaacttcatctcaaaaaaaaaaatatatgtatatatatacacgtatatacacatatatgtatatatatatatacacatttatatatgtatatatataaacatatgtataaacatatatagtatatataaacatttgtgtgtatatatatacacatatatacacacatatatatacatatatatacacatatatatatacttatatatacacacatatatatacacatacatatatatatacatatatatatacacacatatatatatacatatatatatacacacatatatatatacatatatatatataaattttgagggggacacagtttcactcatgacagcacatttgggaaaaaagattagatggtacaatttgaccagagtgatgagctttagaggtgctgtggaagataaggctgaaaataagattaggctcagattgtgggtaattataaatgccagatgaagaatatggattgtacggaagtgacatcactaaaggaatttgaaaagatacttactcagtttctaggccctaaagttttattgtaaacagtccagcatttggtctactaggggacacagacattagacaagaaaaaaatgtaatactaactatcttaataagtgtgtttcgaaggaaagtattggttacagtgagagtgctagttaggtcagagaaatattccttgaagaaataacaaggaatattagtgtcctaaggtatcctttagtgtgctacttttaagtttgggcccaaaaaaagcaataggaattaactagggattttgtatatgtgattttggcttaatttatccttatgttgttatttaccatttcttctgccacttgtattcctgtaaacttgtggtaggttcaagagctgcagtgtccggtagaaatataacgtaagccacatataaaattttaaattattttagtagccacaataaaaaagtaaaaaatagggggaaaatagtagcatttcagcatgtagtcagatttttaaaatcattgatgaaatcttttacttttttcacaaacatctttttttttttttaaagacagagtctttgctgtgttgcccaggtggaatgtagtggtgcagtcttggctcactgcaacctctgcctcccaggctcaagtgattctcccgcctcagcctccctaatagctgggattacaggcgcgcaccaccatgcctggctaatttttgtattttaagtggagatgaggtttagccatgttggccagactggtctcgaactcctgacctcaggtgatctgcctgcctcggccttccaaaatgctgggattacaggcgtgagccactgcgctcggcccacatctttgaattctggcatgtattttttagttagtgtgtcttaatttgggtcagttacatttcaagtgctaaattgccatatgaaggtagtggttactgaattaaacagtgcagatctaggggcttggttaaattcaggtttaattctcttggcaagaagtgccaaaatacgtggtgctcacttcttcctattgcatcatcttatgaggcacatacatgtctggctgtcctacttttagtgttcctaataggtttaaagtgttgttaccctcactcattcattgtagttcacccatcagcctttgacttacttggtctagcagcctttgctgatcattgcctggatccactagaaggaaagaaagcctttcattataacttgtggagaataatttatttctattttatttaagcttttctctactaattagtatctaaaagggatggcagtcaggaccacagcatcaaagaaagaaaggctgcagagaaaaccatgtttgaaatggtggcattaaccaggttatgcaggatcttttaggattagtgctggtttcagtttttatcctaagagtaattggaagcctgtaaaggatatttcattaggtaataggatcagatttgcattttttgaaaagtcactctttgaaatgttaaaaagaagaatctccttggcttccatacagagattgcactggagacattgaagcatggatctactaattaggaagttgtcacattggttctagggattattagaggtgacctggattaattgatgatagtgtgaatagaagagtgatttttttaggaattagattgagtagaacctggtgattgaatatggaatgtaaggtagagtgggagatatcaagagcacctttgaggtttttgcctttaacaaccaagtgaatggccatgccctttataagaagtaaaacaacagaaaaaagggaaggagcagatcgaaggtttttttttttgttttgttttgttttgtttttgtttttgttttttagatggaaaaaagagacttgagtatgctgatgagaaatagctaatagaggccagacgcagtggctcacgcctgtaatcccagcattttgggaggctgaggcaggtggatcacttgaggtcaggagtttgagatcagcctggcaaacatggcgaaaccctgtctctactaaaaatacaaaaattagcgcatgcctgtagtcccagctactcaggaggctgaggcaggagaatcactcgaacctgggaggtggaggttgtagtgagccgagatcacgccactgaacgccagcctgggtaatagagtgagactccatctcaaaaaaaaaaaaaaaaaaagagaaatagctaatagagagggagatttatcctgagaacactggaaggggctggaatcctgaagtcatgtgatggtttgtccttagataggaggagggacatatccactgtaaaaaggcagaaggaataaaggatagctgttaaagagtcataaattatgtagtgagatagtgtacatagtttctatttaatgatctgcattttcattgcactgaagtatgctcatttcggggtgcggagggggcacaaaaaacatgaagggagagcgcatacaaattggaaatagttgtgaaaacatgtgaagaggaaaattaaattgattccagaaatgtagtagggttgttggtgagggatgaaggtataagtgcttctgatctgcctagttgtggaactttttttccccttaacttgtgctcagccaccctaatgcagatccagagaaggcaagtagtacattcctccagagctgggttatgctaggtaggtttaaccaaaaagacaaaagagcagaggggttgagagtattgacaaaacagtaattgaaatgatggatatagcatggaatcagtattggacggagaaagaagtgaagatgggaggatgtacatagaagtaaaagggccagtggaggccaggcgcggtggctcaggcctgtaatccccgcactttcggaggccgaggtgggcggatcacgaggtcaggagatggagaccatcctggctaacacagtgaaaaattagccaggcgtggtggcgggcgcctgtagtcccagcttctcaggaggctgaggcaggagaatggcatgaacccgggaggcagagcttgcagtgagccaagattgactgcactccagcctgggcaatacagtgagacttcatctcaaaaaaaaaaaaaaaaaaaataagggggccagtggattggagatttccatgagccttccctctctgctccctgcacaaaaaacccaaaaaaccctaaaacacttagtagaaatacttaattaaggagaccagataggcagagctaatgggctgggagtgatgtgaaaaagagatttgagaggcaatgttgttttgaatgctggcaaggaaagtcaagggactgtgactgtgtgttgaagttggtgattgaggtaggatggagcataggatcactgaaaatcaaggaatgaaggctgggcatgatggctcatgcctgtaattctagcactttgggaggctgagatgggaggatcacttgaggccaggaattcgagaccagccttgtcaacatagcaagacacccatctcttaaaagaaaagaggctaggtgcagtggctcacgcctgtaatcccagaactttgggaggccaaggcgggctgatcacctgaggtccgttcaagaccagcctggccaacatggtgaaaccgtctctactaaaaatacaaaaattagccagtcgtggtgatgggcacctgtaatcccagctactcaggaggctgaggcaggagaatcacttaaacctgggaggcagaggttgcagtgagccaagatcacattactgcactccagcctgggcgacagagctagactctgtctggaaaaaaaaaaaaaaaggaatgaagaagaatctaaagtgttttcatggtttgtgcttctgggtgtggaagaatgatggtggtaggaattagaaaggaggagaccttgaatcagatgccttggtcttcagtgaatgaaggagtgtccctgaaatcaatagatgtctacgattaatagaggaaattgtggaatagtcagatgcttgaaactttaatgagcagaaattttaaaaacacaatacagaaataatggtcttgcaacattaaagaggaaggacattgactctttggaaattgaccatggactcaagagtatgcagagtatcagagaaatttctacttaaaagttgtagagctggaggttccttataggggatttagatttcagtgaagagtttgatagaagtatttttcgtggtttaattaggcagaaggagctatatatgcagttaccacaggttgagcttccctaatctaaaaatccaaaacctgagatgctgcagaatctgaaactttctgagggctgacattatgccacaagtggaaaattctacacgtaagtacttaacacacactttgtttcatgcacaagatcattgaaaatattgtataacattcccttcagactgtgtgtataatgtatatgtgaaacataaatgaatttcctgtttacttgggtctcatccccaagatatgtgattgtgcacatgcaaatatttcaaaatcttaaaaaaaaaaatccgaaatctgaaacacttttggtcccaagcatttcagataagagatactcaacctatagaagcttctttttaaatatggatatatatatgtatatataaagagaatgtaatatagataagtacaagtttaatgtttcctataatatcgaattccagtttaaaatttgaatttaattatattttgttttcctcaggatttttaaaaagtcgagatcgtgcctatgcaaaattctatacccttttatccaaaacacagatttttattcgtttcattgaagaatgcagttttgtaagtgataaagatactggattagcattttttgatgactgcatagaaaaggtaaaagtttgtacttatactagtgtttagaaaaaaaagtttgccttacctgtgtaattatcattgttattgttagtctagagtgatataaggaaaacagagtagggttgtgtatgtgtgtgtatgtgttaccgattctgggctgaatatatgaataaaattctttgtggtttcaagtttctaccacatatagccaatttttctattctttattcattgatccattgattgaaacagcatctcattctgttacccaggctagggtgcagtggcatgatcatagctcattgcaactttgaacttcttgcctgaagtgattttaccaccttagccttctgagtagctgggactacaggcatgtgctacgcccagctagtttttttaatttttggtagagatgaggtctcactgtattgcccaggctggtctcaaactcctgggctcaagtgatcctcccgccttggcctcccaaatccttgggattgcaggatgagccgccatgcccagccagtaaattttctctttaaatctcactttcgttttacaactattgagttgtaaaactaagaacattttcttgagccttgtgagtttatatttttttaatttaaatgaataagatttagtttaagatttaggttttttaattaaaaaatgtttagttttatgggtaatagaagttctatgttcttttgttttaatgtctttccagattcttttgcctaatatgtttcttttgttctaatggagggtggaaatacgttaaattttaaagctttacccacccatcctaaggaagttaaaattgattcttgacttagttataatttttcctaacttttaatataattcttatttttgctaagtagatcttggggccaattgtttatgcaaactgtatattatataacatttgagattgtatccaaaaaaagttgaatattatgacattaatttttatggccccctcatgattcatatgccttagaagatttaaataattttctcctatcagtgtgatccaaaattccagggatataattaaaactattcaacatttttgtttatttacaaaattgatattccagtatcttccagttatatgagaagtttaatgtcaatcactaataaaggggcttaataataatgaaattttttatttgagaagccagataaccttgtgattggtcatcttttgtcttaaggtttacaaaacaactaatcaaaatagttttctatcctaatagccacaagtaaaaaattatgctttagcctaagagtatgtattcagcctaaaaatatactgtgcatgttttgtatcagctggtactgaaaaggggtagtttttttctaaatcagaatgtaagataaaaatgtctattaaattcatagtggacattttcattaagaatctgttttctttttttctagttgtttcctgataaaggcacagagaaaacagataaggtatgtttttcttagattttaagggttgaaatttcagaattagatcttgtttgtatgcaaattaattggggaaaaataatgattttcaggttgattttgattcagcagaagataccagattgatagaactagatgattcacagaaaagtgagcatactgtatttataatgccgccagagccacctcctgatgatggaaaggacctgtcaccaaagtacaggtagtaggaagttttaaaagagcttaatggcacagcctatcagtttcttttaatttttattagtagatatgtatattagtcttttgtgaaactcattttcagtattagttcagtgaactaatgtagataaatattttatggaaatgccactaggtgttataatttaagaattggatggtattgtcagatgttgatcattgtttaccttagtgtttgtattttaatctttaaaagtttcaattctgaagaagaaaaatgatacttttatgaggctccctgctccctttgggagtttcattttgaaacaaagactgtgaaattcttatgaattagtaatttaccaagaaaacttaaggtagagggccaggaatttattctttattaagataaaggataggatttggatgtgactcttttaagaaattagaatggattttgtagtttttttattgctataaatttaataaacttagaaaatcaaaccaaaatggaaaactaatacatcattctagcaccaatacttgtgtctcttaacaattgtaggtatgtatgtatcatgtggatgtgtgtgtgtatgtattgcatgtatgagttcatcaggtagattctctttgtaatctatgtttgcctttagtggtctgaacattttcccatgccattaaatatttttgtgccttatcatttgtaatgaccacattgtatgcatttattatgatttatttaactagcctcatggatttgtttgtagttctttgctatctatatctttgttattttcttaggctgcatttctaaaagaatttctaaaatagaaagtaaagtaagtacatcccaaaatagagaattaatgtataatatcaagaggactggatcagaatgaggaatgtatctgggattgaatggcttgattaaatactattttgatttcatgttaactatagaattcttttctgctttggcttaactacaagaaattggaatccagatattgacaaacaagataaaatcaaatatggaaaggcgctatattctggaagaaaattggccaaaagaaataagtagacaatttccaagaaatccaaagtcaataatataaaaatatgttatggttttttgcattcaaagaaatgcaaaccaaaatgatgaatagaaacctttgagattgagaataggttatgctagtagttagaatgtatgtttaagtataatcttttttgaaataatttgatattaattataataattttaattcttttgataaacatggacctagcaaattctattattgggtatttgtcctatgaaattaagcaaaggtattcacaaagatatacatatgaaaatatttaattggagaaatatagaaacagccaacaacctaataatgtccagcagtgaaaaactgcttaaattgtggtacatccttaaaataaaaattttatggattttttttattttaaatacctatgcaaggtaattttatgaagaaaaacataaaattatgaagtatactaaaatttttttaaacataaattattgaatacatggattatcttgaaagagttatttctccctttaagtaagatatcagagttttctgtgttttagagattgattgaaaataacaaatagggtggggaagagacaaaattttcatgaaggtagtctctgtatgttatatcatttaaaaattttgaaaaagtattttttctatataagcatttaaaataatgttggatactatttgaagtttagaaatatttgcctaaacgctggaataatatgaagagttggtgtgttttaaatcagcagttctatttttttttttattttagttacaaatactttccaagactggaccttaagctttttgacagaccgcaggagttgaaactttgttttagtagacaccctactgggaatagcattacaaagagtccacctctcatggctaagagaactaaacaggtcagatattctttatctaatacatgttcatttaagatgtaaaatatgtatatgtgatatgcagctcatagtttagaatgatcacccacaacaaccatttgaagactcactttggttgttattgaatttaactagatttcttgcaagcctacttaaaatatcaagtctgggccaagcatggtggctcacgcctgtatcccagcactttcagaggctgaggtgagcagatcacttgaggtcaggagttagagaccagcctggccaacatggtgaaaccccatctccattaaaaatacaaaaattagctgggcgtggtgtcaggcgcctgtgatcccagctactcgggaggctaaggcaggagaatcgcttgaacctgggtgatgcaggttgcagtgagctgagattgtgccactgcactccagcctgggtgacaagagtgaaactccatctcaaaaaaagtctatatatgtgtctgtctgtctgtctgtctgtctgtctatctatctatctatctatctatctatctatctatctgtctatctatcaatcaaggctgaagtttttgaatgcttatatttatgctttaagataatctgtaggaattggccgggcgcagtggctcacccctgtaatcccagcactttgggaggccgaggcaggtggatcacctgaggtcaggagttcgagaccagcctgaccaacatggagaaaccccgtctctactaaaaatacaaaattagctgggtgtggtggttgcatgcctgtaatcccagctactggggaggctgagacaggagaattgcttgaacctgggaggcggaggttgtggtgagctaggattgagccattgcactccagcctgggcaacaagagcaaaattaagttttagaaaacttaattaaaatataattcatataccatacagcatacccacttaaagtgtatgatttagtggcttttagtatatttacaggtttgtgcaactaccaccacaattaattttagaatattttcatcaaccccaaaagaaagtttgcatcctttagccattaaccccaattctcaatccccagcagccctaggcaaccacaagtctgttttctgtctacaaatttgtctattctgagcatttcaagagtagaactgcataatatgtattcttttgtgactggcatctttcatttagtgtaacatttcaggattcatccacgtagcagcatatatcagtaataatttttattgctgaataatattccattgtgtggatataccatattttatttgtctattcatagacatgtggatacttcctacttcttggctattatgaatattgcaaatgaacatttgtgtataagtgttaatatggatgtatgtttttatttctttggggtatatatctaggagtaaattgctatgtcagatggttactctgtgttcaaccctttgaggcacttccaggctgttttccaaagtggctgctccactttacattcccaccagtagtgtatgagggttccagtttcacaacatatccttgtcaattcttgttattgtttgtctttttggttataaccatctagtgagtaagaagttgtattttaaatttgcatttccctaatggctaatgtaaatatactttattccaagtattacaatccaaagggagttaacttaggacaacctagacatcttgctttactactatatgtgatttaggtataaagaactaagctgtggttacgtatgagttaaaattaaacatcctttatacatacactgacattttggggatatttaaaatgtggaaaatttcacaatgaaaatcttagttcaggttttactaatttatgggatagtcccctaaatcctagagatatcctgaggtatttcctaatttcatacagttcatatttctttcaatgttgtctgaagagaatactaaagaatttttttttactgttaccagctaacaaaaggcaaatttctaaaacgagaaaattttgctaactcagcctctaaatctcatttatagcagaattttttttttcaggctaactggaaaagaaaagaaccataggatcttagaaaaacaagggcatgtatttttaaatatgtactgaagtgtcatggagatcgagctcaaaagtaaaattaatataccaagttggttttttttttttttttttttttttaagatggagtctcactctgtcatccaggctggagtgcagtggcacgatttcggctcactgcaacctctgcctcccaggttcaagcgattctcctgcctcagcctcctgaatagctgggattacaggcgcccaccaacacgcccaactaatttttgtatttttagtagagacagggctttaccatgttggccaggatgatctcgatctcttgaccttgtgatccacctgcctcggcctcccaaagtgctgggattatatacatgagctaccatgcccagccccaagatttttttatttagaacatagactagcaaggaatcttcagtgcagagcataaaatggcattctgatatatgtgataggttctgtagtttctgggaatatatatagtttggtaaagctcagcagatggctgggcacggcagctcacgtctataatcccagcactttgggaggctgaggtgggcagatcacctgaggtcaggagttctagaccagtctggccaacatggtgaaactctgtctctactaaaaatctgcacaaaaaaattagctgggcatggtggtgggtgcctgtaatcccagctactcaggaggctgaggcaggagaatcacttgaacccgggaggcagtggttgcggtgagctgagatcacgccattgcactccagccttggcgacaaaagcaagactctgtcttaaaaaaaaataacaaagaaaacaccaaaactcaccagatgattttgatacctaattttctcttctacctaaatctgaatgaaaaccagaactagaaaacatgactatcaaactattaggaaagtttatgttgactgcaaaggaataggtccttttttttttttttgagatggagtatcgctctgtcgccaggctggagtgcagtggcacaatctcagctcactgcaacttcccactccctggttcaagcaattctcctgcctcaaactcccgagtagctgggaccacaggcacatgccaccatgcgcggctaatttttgtatttttagtagagactgggtttcaccatgttggccaggctggtcttgatctcctgacctcgtgatccatctgccttggcctcccaaagtgctaggattacaggcataagccactgcacctggccagaaacaggtcttttttaaggagtctgtcagtgagggagttaacatagactgtagcttgggaagacagagtggaaatcttggcaggagatagcctagagcatcttaaactttagtgaagagaagagtgagaggaatatcactttttcacccatcaaaaatgagttccttctttgtaaaagacatgagccattctattacaaaaagatgaatgatctttgctcttaatttctactctgttaagagacacatgcttgctaacaaatagatttggtatagtatgaagtattactgtaaatgaatgttcaggggaaccattaacactgataagcaggaagccactcacaaaagtcaactttgaagtgcttgattttagggggtcaagttttacttaaattctcctctcccttttccttctcacttctcccctcaccctaatgaattttagtaaatatcataatattttattctctttctaggaaataaaaacagctcataaattggcgaagagatgttatacaaatccaccacagtgggccaagtgtctgtttagtcattgttacagtttatggtttatttgtcttccggcctatgttagagtttctcatcctaaagtcagagcacttcagcaggcatatgatgtacttattaagatgaggaaaacagatgtggatcccttagatgaggcaagtataacaaattgacattgtttctaaggtaaattttatttttgtacttctaataaaatttgggtgtaagttgctttaaagtgtgctcaagcattttcattaagcaggaaaggtaaaactattactgtttcatggagctggtgcatattacttgtttattttttattttaattattgatttgtttttgtgacagagtctcactctgtcacccaggctggagttcagcagtgcgtccttggctccctgcaacctctgcctcccgggttcagacagttcttgtgcctcccgagtagctggaattacaggcacatgttaccatacctggctaatttttttttttttttttttgtatttttaatagagatggggtctcaccgtgttggccaggctggtctcaaactcctggcctcaagtgatctgcctgcctcagctttcagtgctgggattacaggcatgagccatcacatccggccatgtttgtttatttttaaagagatggagtctcactcctctctcgcccaggctggagtgcggttgtgtgatcatggcacctggcatatggtttttctgtttttgattttttttttttttttttttaagggatggagtctcactttgtttcccaggctggtcttgaactcctggctcttgaacccccaccttggcctcccaaagtgcagggattacaggcatgagccactgtggctggcttcattttattcttaatataactttattggggagcagatagggaataggcttttagtaagtggctctccacttaggacctgtgtcctaaggtgagttatataatctatttaaaaatatattttttatttatatttaaatatatatatatactcgtgcccaagctggagtgcagtggcactgtcacagctcactgtagcctagaacttaagggctcaagtgattttcctgcctcagcctcctgagtagctgggactacaggtgcacaccaccacgtctaatttttttagttttattttttgtagagatggggtctcgatatgttacctgggctggtctcaaactcatggtgtcaagccatccttctacttggcctcccaaagtgccaagattataaatatgagccactgcacctggcctatggaacctatttgtgttttggattatctattagaaaatgtagctttgaacttctcaactttggcactattgatattttggcccacacaattgtttattttaggggcctgtcttgtacattgtgtaggatgtttagtagcatccctggcctctaccaactgtatgcctctctttccctgcacagatcatgacaatcaaaaatgttcccggagagcgaaattgctcctggagaaccactgaggtagataataatagttagcaccttcatcataaggttagtttgaaggttagttaaatcagttaatatacttaaagtgcctagttcatagtaagcactcagtgaatgatatactagacattttcatgcattttctctctcaagccttagaaaccatcctaagaagtagatactgatattatccagctaatggctgaggaaactgaggcacttatttagctttttccaatgctgtttttccctttaaaaattatttttggtgttaagataactataaatgatgttttgaactagattagaattaaaaatgaaaagtctttgctaataatgttacagtatatttaactgtcttctcattcttttaaagacaaatcctatttgttctgtaggcattttggagatactgtctttaattcctttggcattgaatggaaagcatagtgattggggagagagagacttcaattatacttgattttatttatatttatttatttattttttatttagagacagttttactcttttcctccaggctagcatgcagtggcgcagtcttggctcactacaatctccgactcccgggttccagcaattctactgcctcactctcccaaagtagctgggactacaagtgcgtgccaccacgcctggctaatttttgtatatatttttttgtagagatggagtttcactgtgttggccaggctgatctcgaactcctgacctcaggtgatctgcctgcctgggcctcccaaaattctgggattacaggcatgagctactgctcccggcctctatccttgattttagaaatgaattacctctcaaattatgaggagtaatagtctttctctttgtatagatttagttactcaaacaaatggaacatggacacatatgtcttatatgaaatggttaataatgatgatacttgcattaatgaataggtttgtttttgggtttttttttttttttcttttttttttgagacagagtctcactctgttgcccaggctggagtgcagtggcgtgatctgggctcattacaacctctacctcctggcttcaagcgattctcgtgcctcagcttcccaagtagctgggattacaggtatgcaccaccatgcccatctaatttttgtactgttagtagagatggggtttcaccatgttggccaggttggtctcgaactcctgacctcaggtgatccacccgtctcagcctccctaagtgctgtgaggcgtgagccactgtgcccagcctgaataggtcttaaaaataatttgctaagatgctcaaagcagaacaaaggagaaaatactgcttaataacttcatggaaagaattcagtaaaatctctacaattcacagatagattagtatactaattactgacactgattttttttttttgttaggtgtgctatcgagtagtgatgcagctttgtggactttggggtcatcctgttttagcagtgagagtcttatttgaaatgaaaactgctaggataaagcctaatgctattacttatggttattataataaggtaagtaggatcgacattaggcaagatgtggtgtttattaagaatgattattttgtatacctttagttattcatgaaactcctattaaaggaagttttgggatataattttttaataatttttataattattaaaaattgacaaaaagtatatatatttatcatgtacaatatgatgttttgagatatgtatattgtggaatggctcaatcgagctattaaataattaacatatgccttcattgttttgtggtgagaacacttctaatctcttagaaattttcaaaatacaatacattgttattaactgtagtccccatgttgttcaatagatttcttgaatttatttctcctactgaactgaagttttgtatcctttgaccaacatcttccagtgtcccctttccccttacctcccaaagcccctggtaaccatacttctagtctctgcttttatgggtttcactttcctggatctcatatatatgtgagatcttgcggtatttgtctttctgtgcctggcttatttcacttaccataatgtcctctgggttcattcatattgtcacaaattactgggtttccttttttatttcaggctgaatagtatctcgttgtgtatatataccacattttcttcatccattcatacattgataaacacttaggttgatttcatatgttggttattgtgaataatgctgcaataaacatgggagtacagatctctcttcaatatactgatttcatttcttttgcatatctatacccagtaataggattgctggatgatatggtagctctagttttaattttttgaggaaactctatactgtttgtgaggaatctttttaatggctgtactaatttgcatttccaccaagactgtgtaggggttcttttgtccacatccttaatcaacatcttttgttttttttgacaatattctaacaagtatgaggtgataagatatctcattgtagtcttaatttgcatttctctgatgtttagtaatgtttagcattttttaatatacctcttggccagtataactttttatatttgtgtatatatatatataaacatacacacacacatatatgtatgtatttttaaaatcagatattgctaatgaacattatttttacccttattttacctttaggtagtcttggagagcccgtggcctagcagtacccgcagtggtattttcttatggacgaaggtacggaatgtggtacgtggcttggcacagtttaggcagccgcttaaaaagactgtgcaaaggtcacaggtctcctcaatatcaggtaatacatgtgattagaaatataattccttactgaaccatgagctttataggcatatgaatttttagctatgtgaagtagaaaacttaaattccggtagacattttcacatacatttaaagacagattgtcttagtccaaaattatttttgtttttttccagaaatttagaaagtgttctgcaactataaatgaactgtgggtcaatcatgtttagtttaagagattatcaatgcatgagttattgaactgctattgtccttatctttagctcttcaaaatgtcacaggtggaagtgatggggacacggtgagccacggtagtgtggatagttctaatgatgctaacaatggggagcacacagtcttcgtcagagatttaatcaggcttgagtccattgataatcactctagcacaggtactaaaatccagattttactaacccttcacttactctcatgttaaatctttcctttttcaaaaagcttcttccattcttgagtttgtgtgatatgactactttaaaagtactgtatgcttacaagagaaacaatacgagtctgcagatgacttctgtttatttcctatagtacaaaattagtatgggagtgctgtgcacagtgctctagcatgatgcttctttgtatttgtttatcattagtttgtgaaagtgtatgctataattaggaatcatgagctaaggaacttgaaaattagtgacacaacttgcaaatctttttaaaaaattaaatagaaaatgtatcttaaaacttcaagagtatgaatattaaagagggaaggaaggaagtcacacaatgagaaaaagtattctctttaagttacattttttaagatctgagaagttattgaagctgcttttatgtacatagccatgggaataatccctctcctctgaagttagaaataagtgtaactaaagtagcacgttgtgcagatatatgtgtgttacatatccttcttcttgtgttgtttttttgttgtggttgtttttaatatctcaagccttcctttaaaaagaattctgggtctaattcctgtgcttcatctgatgaacttgtctcaatgactgaagtttccttttctctgctctttgttgctttgctttttgctctgtgctgtttcttggtgctgcatttgtccttggctgtcatggtgtggggtgcagacagacttatatgacgtgaagctatggatacacgtgtgcattaattctacccttgaatgttaaccacatcaggtaatttcccatttattaggttaaattttgctgacctgcaagggtgggggaaagacctttcattgtattttaagtttgttttgagtggtaaacagttttcattttcttgccttttctccttcagataaatgtaatcatatatagactcttgaaaatatccagctaactttttatggtcagtttgcaaagcatgtttgttatcttatttgaaaatatattatgccttgctaaaattcttattttgaggttggtttgtagcatcagtgtgacaaatagtgttataggcattgaagaattaattgtttcagctgttaaggtggtgtggccattgctttccaaaacttatctgctgaattcttgtgctaaaaacaaccttcacataattacaggagcatgtgtaaatttgaaagtcaacataaagctacaggttacaatcctgtttgtaattaacttcctcagtttgccatcatgtttgtatattatattaacaaataagaatttttatgaaacttttattttaaagccaccatattttatttcctctagtatttttttcatgatacttgtagaagaaatgggcttcatgtataaaaagcaaaaaaatatatttttttgtatgaaaacgtttaccaggaatagtaatagtaatacataaacacctttccccttattccttcagatttttaagtttacctcattatagaggcaatttactcctttaatggaaataccaatctcctagtaatgctgggtaattggtataaagacttcaatagttgggcacaaaccttcaggtcccccttatatatattttagctgcatttcaaatgaccgaatgccacatactgaatttgcagtgatggtgtgtctctgtagaacttctggcgatgccatttgatgcttttggagtcttcagcccaggtgcttaagttgctcatttcattaaggattatctcgtggaatctttccacttggtacctggtacagagtcacttagctgttaggggcatgtttggttttaattcacccaggtcccagcctagtgttcatttcatggcaccacattgctttaccagactttttgagggagctagtaaaaaagtgactgaagttagtcattctaagtagtagtatttaaagacatttaattcttttgttgtatggcaaacccagagtctgagtggcagtgtaataagtgatggaaaatggaggtactgcatatgttattttatgtgtcttttattgacatctttatactgttttctctagtacctgatcttagttttgattttaaagtatagaagtataaagtcaaaaaagacttttaaaatatttgaaataacttcaaacttacagaaaagttgcaagaataatacagaaaactctcatatcttttatctagattcccttgtttttagtttgccacatttcctttattattttcattctgcatgcatgcacataccatttctttttcctaagtcatgtgagcaggttacatacatcttgcccttttacctctttattatttcagtggcattttctcttgtatataaccacactttggttaccaaattcaggaaaacattgatataccactttataatttatattccaagtttgtcagttatcccagtgttccttgtggtactttaaccccctttctttagtcttccttaacctggcatagttctttagcctttaaaaaatcttttatgaccttggcctttttgaagaattcattttaattattttgtggaatgtttcttaacttaggtttgtctgttatttcctagtgtttaggttatgcatccatgggtgtgctacgtaaatgatgttgactccttctcaggttgtcacgtcctacaggcacacacagtctgaccttcatcggtgatattaatttggatcacctagtctcactattgtctggtttctctgtggatagttactataatatttttttcctctcagatgataagctatttttgaaagaacactctgagacaatgtgctaatatcctttctcatgacactttctcttttaaatttggcatccattgatgatgcttgcctgaaccagtcattactatgatggctacaaagtggtgattttgccaactctatcactgttttcatatttagaagatgatattgtagtatatagataattctccattctctatttttttcttatttattatcagtatggactgatgtactcctgttttattcattgaaatataattcattactgtccttatttggtcctcagattatccccgtgttggccagtgggagctcctttaagctagtttttatgtcctttagatattctcctattatgtttctgagcactacctttttggcacaacagaatgttctagctcaatcttgtaccttctctgtctgagctctggaatcagccatttcttcggggatcccaggttctttttcatggggaatagattttagaagccaagatttgggctcagtgttaacatagtgttactgcttctaaacttttttcctaagctagaaaatacgtgtactgtacataaaaaataatttcagaattgtcacacccatttctctgtcaaaaacaaacctactaagatgttcaggatttgtctgttactcccaggcttagggtagatactcaaaataatgtgttcaaagttacttggattagtcctcccctggccctttcagtgtgattatgttattcatgtgaaatacagttggcttcatttgtttccatttgcattcagttgcaccccttctatcttactgattttattttttttttaacatgcagaagtgtattctatctccaaagataaaagcaataccataagccatacatagagaagttttctccctctttattcattgtatcttatttccccccaaccctggtaggtaaccatctttactgttttctggtttattttgcctgcattactttttgcaaaagtaagcagatatatgtgtgttttattcttacagagaagttagcattctgtagacacggtctccaaaagagacttccaaacatcttgtctaaatctttttaatttacagatgaagaaattaagatgtagtgcttccaaatgtgtttagtctttgatgttcctgtttctactgttctttgcggcttatcattatttttaaaatgttctgtgttccttgtgtgctttcttgtcttccttttgtctaaccgtaattgtgtagatcagtggaattttcttgtgatttttatatatgaattataagtatatgaaaacatttatatgtaagtctgcattctttttaacaggtggtcagtctgaccaaggatacgggtctaaggatgaacttataaaggatgatgcagaaattcatgtgcctgaagaacaggcagcaagagaattgataactaaaacaaaaatgcaaacagaaggttaagtactgatatttacgaactttacttagaataatacctgtattattaataattaaaagtttatcttagttgatagctttgatgattattttcacaaatgtaaggtctggctcctaagatgctgtgtactgttacataaggtagattttggtagtctctgaagttttaaaatttaagagaactttctttctttctttttttttttttttttttgaggcagggtcttgctctctcgcccaggctgagtgcagtggcgagaacatgtattactgcagccctatctcctggcctcatatgatcctcctgcctcagtcccctgtcagctgggaccacaggcacgtgccaccacacccagctaatttttttatgttttgtagagacaaggtctcaccatgttgccccggctagtcttgacctactgagctcaagtgatcttcctgcctcagcctcccaaagtgctgggattacaggtgtgagccaccacacctggctgtaagatacctttagagactctgtaggtcagcccataattttccagggaagtgtgacccattgaggtatttgccaaaattacatagctacttttgacagaaccaggactaaactttgagttattaaaacttctattttagtgccctttttaattctaaaaggctctttcactagcagtccttcaaatatctaggtgcatagttttcattggtaggttaaaaatagtctatgtgggctgggcgtggtggctcacgcctgtattcccagcactttgggaggctgaggtgggcggatcacgtggtcaggcgtttgagaccagcctggccaacgtggcgaaaccccgtctctactaaaaatacaaaaattagccaggcatagtggcagcacctctgtaatcccaggtactggggaggctgaggcaggagagtcatttgaacctgggaagcgaaagttgcagtcagccaatattgtgccattgcactctagcctgggcgacaagagcaagactccatctcaaaaaaaaaaaaaaaaaaaaaaagtctatgtggtttttcccggtttttataggactcattaaggcagagataatttgttgtaatcattttatgaaaacatggaggaatattttggcttatggaataagacactcttcctgttctctatcacaaaagtgtactttctttaatgttatttattttatactccagagttatggagaaacaagcccctctccatttgccaagtgatgagaaggagaactgaaggccagagacttaattgattcactaaagaacatttatgttaggattattgaatgctaaaacaaagcatttatttcagttaatattggcagcatttatggcataaagtaaaccagacacagtctattttactttgtgtctaaagtaaaatagacacactgactgttggagaaaaatacatacaatatctaaaagtcaatatatggtttctgtttaatattggcaaaagtaggaatgataacatccaaatatttttttccagaggtgtgtgatgcctctgctattgtggcaaaacattcacaacctagtccagagcctcacagtcctactgaacctcctgcatggggcagcagtattgtgaaagttccgtctggtatatttgatgtcaacagcaggaaaagtagcactggtgagtctttacattttggttattaaatatttaaaatatacttttatagactcatatgtgtctttaatgacattaaatttttgacttaattgtaatgaacatgctaaagagccagaagggacttttgaattctctaaatcggctaaagaaattgaaaatattgttatttaaaggtgtttgatttttaaaaggagtatttagtgtgtttgttatttggaataccctttcctgttgtggtgcctgtccaccgtttggccactctttctcattatagataataagaaagtgtacttttagggcttcctgtatgcatcatgaacaggcagtgatgtgatcaaattccagagggcttatgagtggcaggctaattcctatcactgaagggaaatggaagaaaaagattcacgtcatttcccctctacacagatatgccagtggatctttgattttggccattgttataggtaccccaagccattttttatttgtgattaagtgtttgtactaaataactctgtgtgtatgactcccttgaatttgagttttctactttcattatatatataggtctcccaagactcttatggcacatatccaagtatatgattttaaaagacaatgaaattggcctgcatcctttgcccttcattagtggtggctgcagttgacttttctgaagttgactgtcttgtctgaaaatgtatctattgtatgactgtacagaaattaatttgttcagcttcttaaaccaatgtaaaagtactccttgttcttaaagtcttttctctttgtatttaccgtgactccgagtttcactcattacttgtttgggtagtgctcaagaggtggggctaaagattttttgagaaaataattgatatatacattgcagattccattttcctaacctcttgatagcagagatactggggaaaaggagggaagagttttcttcgtcagaggcttagaatcctctcaaaatattgaactggacatcgtctgtggactgttgtgtttccttcccttttaacttattttcatattaagaacgaagggcgaggataatggggcttttgtcagtatagcaaattttttttaaaaaacattgaataaaatgtgccgttaaattccttggaaatactatgagaaccaataatatttgcaaggatttgtttctcaaatattgggaccagctttcaaagcaggtacatattttgagttgtaaaataggttagtttaattcccgtgaaggcttaaaagaatatctctaaatgcttattctgattaattgatatgattatcagtactaacttgaaagattaaaaagaaccttgaaatcaatcttgaagtttaaaagaaagatcttatctaagacagcttttttccttgaagcacccagatattgttatgctttttaacaaaacaaatgatgtgactacagtaaaaagcaatggataaaaaagaaaacgaaggaaaagaaaaacacaaatgagaatcctaaatatgaataactcaggctgctatacagttccacagactaggtgacttataaacaacagaaatttatttctgccgggctcagtggctcatgcctgtaatcccagcaatttggcaggctggagggaaagatcgcttgaggccaggagattgaggctgtagtgagccatgattgcaccactgtactctccaccctaggtgacagagcaagaccctaactttgtttgtttgtttttgagacagactctcactctgtcgcctaggctggagtgtagtggcacagtcatggctcactgcagcctcaacttcctgggctcaggcaattgaggattctcccgcctcagacccccaagtagctgggactacaggcgaatgccaccacatctggctaatttttgtatttttttgcggagacagggtttctccatgttgcccaggctggtctcgagctcctgagctcaggtgatccgcctgcctcagcctcccaaagtgctgggattacaggtgtgagccaccatgcccggcataaccctaacttaaaaaaaaataaaagaaagaaatttatttcttatagttctaggggctggaaagtccagggttagggtgttagcatggtgagttctgcagagggccctcttccaggttgcagagtgctaacttattgtatcctcgtacagcagagaaggagagagctctcctttaagggctctaatcccattcatcagggttccactttcatgatcaaattatctttcaaaggccctgcctcctaatactgtcacactgagggttaggattttagcatgtggattttggcggacacaaacattcagtccataacaggtagacttaagttctaataatgattcaaataggaaataacagcttttggtcttggagtgaaacaaattgcatggtagccaagagtaaaagactgctttctttttccaaagctgggggaagctgctatggccattagcatattttttctctacctgatcaaataagactgacttctgtgaaggctaggattatgtctgttttatttgcctttatattcctagcacctcatatagtggctactagtagacgtttagtatttgttgaagaaatggatatatctgaataattttttaaccactcagattttatcagccttcttagaatttgccagtgctaagcattccattccggattattttactttacagcagtaagactttgagtatagcaaatatacaattcctataagattacaaatttgctttttgcagagtagattactggcaagtatttgttgaattggatacaaaactaagatggaagagattctttctttttctgtattttagtgaagaacacaggtatatccatctatcatatgttgcatgatttgtttttttaaatgggtgtttatataaatataggatgaaagacaggttatacattaaaatgtccctgggaggcaagttttaaatagcttttccagtgcacttttttttatactttctttatggcctctaaattttctggatcttttattctgagtatatgtcacattcataatcaggaaaacaataaatattttaataaaagttaacttggaaaataggttcattgttaatattttactttcccttttaggtagtatatcaaatgtgctgttttctactcaagatccagttgaagatgcagtctttggcgaagctactaatctcaagaagaatggtgatagaggagaaaaaagacaaaagcattttcctgagaggagttgtagttttagttctgaaagtcgagcaggaatgttgcttaagaagagtagtttggattcgaattcaagtgaaatggctatcatgatgggagcagatgccaagattctcacagcagcattgacatgtcctaagacttctctacttcatattgcaagaacccatagctttgagaatgttagctgtcacctacctgatagtaggacttgtatgtctgaaagcacttggaatcctgagcacagatcatctccggtgccagagatgcttgaggaaagccaagaactccttgagcctgtggttgatgacgtacctaaaactactgcaacagtagatacatatgagagtctactaagtgatagtaacagtaatcagtccagagacttgaaaacagtatccaaagatctgaggaataagagaagtagtttatatggtattgctaaggtggttcagagggaagatgttgaaactggactagatcctttgtctcttttagccactgaatgtacaggaggaaaaactcctgattctgaagataagttgttttctccagttattgcacgtaatctggctgatgaaatagaaagctatatgaacctaaaaagtcccctaggtagtaaatcttctagtatggaattacacagagaggaaaacagagagtctggcatgactactgcatttattcatgctctagagaggagatcaagcctacctttagatcatggttcaccagcacaggaaaatcctgaaagtgaaaagagctcacctgcagtgtccaggtctaaaacttttactgggcgtttcaagcagcaaaccccctctcgaactcataaagaacgttcaacttctttgtcagcactggtgcgttcttcgccacatggctcgttgggttctgtagtaaattctttgtcagggctaaagctggataatatactctcagggcccaagatagatgtcctgaaatctggtatgaaacaagcagcgacagtagccagtaagatgtgggtagctgttgcgtctgcctacagctactcagatgatgaggtaagaaagctttatgtgtgtagtctgtctgctattggagtgtttatagtatctttctagaaatatatgtattcttgttcagagatttctgtgcccaggctggagtacagtggcatgattttggctgtctgcaacctctgcctcccggctttgagcgattctcttgcctgagtagttgggtctataggggtgtgccaccatgcccagctaatttttgtatttttagtagagatgaggtttcaccatgttggccaggctggtcttgaactcctcacctcaggtgatccaactgcatcagcctcccaaagtgctgggattacaggcatgagccaccatgcctggctgatttctggtaactttggtttttatattttgcatagtctatctaatatagaatagtctatctgtagtctattttgtgtagtctatctgatatggaatgtttgtatatctttttaaaaatatgtgaaggattattaagacagttctggtaactttggttttcatatttaaaaactatgcatatttggtttctttcttgaagtaacttgaaccgtatatgtaaggaagttaataatgtagaaatagaatattgggaccattttataattccatacactagtctaaactaaaacattatttatttctttgaaagctctaatgattagtgtttgaagttaataaaaatgccatgttatatttgtgtagcattcacttttaaaataatttttacctatgtaatctccttaatacatatgaagtcaagctgcagcttaatccatggatttcataccacatggcaaaaataattgtctttaaaaaaacgttatacatagagttaatcattagatcttttggtaaaaacaaaagtgggtaagttttgcttgttttacagaaaaaaattgaaatttcaccttgtatgaaattgtatagtatttgagtactttagtagataaggcagatatgtataatgtttgctctcgttatttaacagtatgtcctaggtactgttataagctatatgtctggttttatatatgaatatatacaaacataggtatttgtttaattttcacagcaaccccatgagggtggtactgttgttatcctgattttgtagatgatatttgaaactcagagaggctaattagcttctcaagatgatacaactagggaatagtagaactatgatttgaagtcagagagattggctctagagtccatgctcttaccttagaagcgatatctcaggagaagataccaaagagcaatatatgaaaagaggttcaggttgggggctatccagaaaaaaagcaaagcaggtgatatctaatttaggatttgaaggataaatttgacatttggggttaaagctgtaagaagagtgtcagaagagtatatctgaaagaataatgtgaaatggcttggaagcttaaagcatcatgtactttcaaggtaatataatcaatttcagatcgtaaaaggtctaaattggaattagagacgtgggaaaaaaaattagacgtataagacttttataccatttgaaggaatactttatagacaaaataataattgaattaaaagtatagtattgaacattataaattaactattttgtatttaaagagcttacgaggtcagtcaagggaaggcgaaataaaatagcttccaaactgtcttaatctggcattatgataaaaaagaaaaaaaaaagtgtatcattttattttattttttgagacaggcacttgctctgttacccaagctggaatacagtggcacagggatggctcactgtagccttgaccccctgggctcaagcaatcctcctgcctcagcctcctgattgctaggactccaggcgtgccccaccatgactgctaatattttattttttgtagagatagggtcttgctatgttgcccaagctggtcttggactcctgggctcaagtgttcctaggtctcccaaagtgctgggattacagccatgagccactgcacccggcctttgttttatttttgaaattttattgaggttggttatgaggactcatgcctgtaatcccagcactttcagaggttgaagtgggcatttgcttgagcccaggagtttgagcctagcatgggcaacatggtgaaaccccatctatacaaaaaaatacaaaaattagctgggcgtgatgtcatgtacctgtagtctcagctactccagaaggtgaggtgggaggatagcttgagcccaggaggcagaggtcgcagtgagccgagatcacaccactgcactccagcctgggtgatagagaccctttctcccttgcctccccaaaaattatctgttaaaaacagaagtacattacacagggatatgtggacttggaatatgtgacactgtaaattccaagtcactgtggatcttgtcttgtcttttcattgttacatccctggcaccagtaagcagtacctggcaaaaggcaaataggagatacctaataaatatttacacatgaaggaatgaatgaaaagtctataaaatgtttttaactttcatcccgagtttaaggaattaattagaggtatatgtaaaaatagaggaatttaccaatgtaatttatataagattgaagcattttgaatgtttaagcaacaggggagttagtaaatacataatagtatatcagtaaaacagattagttcacaggtgtttaaataattagaagaaaatttaatgacattaaaataattacataagaagtacaggtgaaaaacaatattctaatttgtaaagatttatatgattttatatgtatgttttaaatgactagaaagatgtatatcaagattttgattatattctctgactgttgatatcataagcatttttcattccttgttttgcttatctgtatttaattttttaaaatcatgtaacatggttttataacaaggaagacacaaatctttcatttttaaagcaaaaaaacctgattgttgaaatgttttctacctaaagcttcaacaatcacctatgtagttaagaactacagtgtttgaaactttattcatgtttcttggctctaatattgatatttgttattctgaacattcagattcccagccgaaattatcacagcagctttatttgaaacaactcatattatccatattttcagattacataattaaaagttaaagaagtttagtaatttctgtaagtttacatatctaataaatggtggagaacaaggtcacaatctggctgtctgattcaaaaacccctactctacttgtactgggattcctgattccattggagacagtgggctccctagaattctgttattttataagattcaatattgagagacacccagacctcccacatacacctgaggcacaccacgatctttcttaaagtattgttgcttatggcttgaatgtcttagagtgtggaagtgaaataatagtgaggagatttcatggttttgaaaaatgtggggatgatgatttgtttaaggattatagagtttaattttgaaaagggtagagtgggtataatcccactggagaaggtattatttatgtatgtggaatttttttttttcaattaaaggaagaaactaatagagactacagcttcccagctggcctagaagaccatattttgggggagaatatatcgcctaacacaagtatctcagggttggtccccagtgaacttacccagagcaacacaagtcttggcagtagcagcagtagtggagatgtaggaaaactgcattatccaacaggtatggggaaggattatcctttcttcatttgctttataatagtttttgctttttttttttaatttaagagacggggttttgtcttgttgcccaggctggtctcgaactcctgggctcaagcaatctgcctgcctcggcctcccaaagtgctgggattacaagcgtgagccacagcgcctggcctgtctttgcttattttaatttagatgcctgtaactccccgctcaataagccccatttgttgaaatgattgagagatttttaatactagccgccttatgatctattctgatcttgtatgatttataactactgtggtcacctactgcctttgtttttagttgtatatattcacggattatatcattagttctcaaactttggcatgcatcagaataatctgggaaatttgtttcaaaataaatgcaaatgtccaagcctaacgctaaaacttctgagactgaatttgtgagatggggccttgggaatgtgtatttttaagcagttctctgggtgaatccgatgtataccagagttggagaatcactaggatgtgtcattgaagtttcttactccatgttactttttaaaattataattcggttctttttctctgactttttactgtaaaaatttaaaatgtccaaaccggacacagtggctcatgcctgtaatcctagcacttcgggaggcaaggcgggtggattgcctgagctcaggagttcaagaccagcctgggcaacacagtgaaaccgtctctactaaaatacaaaaaaaattagccaggcgtggcagcgtgcgcctgtaatcccagctacctgggaggcggaggcaggagaatcacttgaacctgggaggcagaggttgcagtgagccgagattgtaccactgcactctagcctgggcaacagagcgagactccatctaaaaaaaaaaaaaagaaaagaaaaaaaaatttcaaatgtcctgaaagttgaaagaatcgtataatgaacaatcatgtattttccacctagatttaattaactattgttaactttatctctttctatgtatgcatacatttttatactgagccacttgaaaaacagttgcagactttattctgtgtcccccctaaatactttggcatgcattttcaaaaaacaaggacattccttacttaaggtattacgatgtatattcctttgtaggtgaagttccatttccaagaggcatgaaagggcaagactttgaaaaatcagatcatggttcttctcaaaataccagcatgtctagcatctatcagaattgtgcaatggaggtaaaagttctatattcagttcatgataaagtagctgtaagcatatttttatttcagaatggcatttaacaggattctaagatacccttgtggacagtataataaaataagtcattttgttgaatttgcttgatgtcttatgtaagtaagacattgaactggtagtttacctgtgaaataaaagaactgttattaataattccaaatttgatcagtagaataaaaaaaatcccattatctcaagagaattcctgttaagattaatttttattaaacgttctcagtgtctgcatttttctgtttttaggttttgatgtccagttgttcacagtgtagagcttgtggagctttagtttatgatgaagaaattatggctggatggacagcagatgactcaaatttgaatacagcttgtccattctgtaaaagcaacttcttgcctcttctcaatatagaattcaaagatttgagaggttctgcaaggttagtcttataaaagctctctcaagaagtaagtaccctcaaaaaacacgacttctgggagaagagtgaaatattcctggtatgctccaggtctgccttcctgtctgtccttcaccttcagtatttgagtagcaaatactagtaatgtgggagtctacttttccattttatttaaagtaagattatcagccgggctccgtggctcatgctgtaatctcaacactttgcgaggcccaggtgggaggattgcttgaggtcaggagttcaagaccagcctgggcaacatggcaagaccctgtctctacaaaagattttttaaaattagctgggcatggtagtgtgcacctgtggtagcagttactaggaaggctgacataggaggatcgcgtgagcccaggagtttgaagctgcagtgagtatatattttagaagaaacaaaggggaaaaaaaggcttcaactcttctcttgtcacttgcacgtcctagtagtattctgtgcagtgaaatgaccaaattctaggcaatagatataagactagctgatctataattatacataaaataattgagagtttggtgactctgtgctgacctagggaattatacttaatattccattcattttatggaacaaattgaactttttatttcctgcctttagctgctttaaaaaaaatacactgccaggtgtggtggctcacaccttaatcctagcactttgggaggcccagacaggtggattgcctgagctcaggagttcgagaccagcctgggcaacacagtgaaaccctgtctctactaaaatacaaaagattagccaggtgtggcggcgtgcgcctgtagtcccaggcacccgggaggctgaggcaggagaattgcttgaacctgggaggtggaggttgcagtgagctgagattgcaccactgcactccagtctgggtgacagagagagactctgtctctgaaaaaacaacaaaaacatttaggctgggcatgatggctcatgcctgtaatcccagtactttgggaggccgaggcaggcagatcacttgaggtcaggagttcgagaccagcctgggcaacatggcaaaaccccatctctacaaaaaaatacaaaaaaggttagcccgacaccatggcacatgcctgtagtcccagcaaccaggaggctgaggcaggaaaatggtttgaacccaggaggcgaaggttgcagtgagctgaaatcacaccatttaattgtagaggtgtttcttctctgttttttcttttagcttcaagggtggagctaagtcaaatcatactctttaattcctgacacactatcatctttggactgtgcaagggccctctcgtgtttatcctcctttcctcattcccaccctcattcccctattctacgaagacactgactctgctaagtgtgatatatatctaaatttacttctttttattgctctattttaaatctgggttactatatgtacatctagtttattccttttcttctacaggaagttaatatacctttctacttatccattattctagtgttgggtacttcagttactttcagttctctgttactacaaacaccacggtagtaatgcagtgcactgcaaaatacatgtccccttttggacttgtgaagtagtttctctaagaaaacgataatccttggagtaagatcattttcatacatgattttagtaaacacaaaatattgcttcctagacggctgcactcccacaagtagtacccaagaattctcatttctatatagccttaccagcatttggtattatcactttttaaattttggcattgtttgaatttctcttgatactgacaaatttgagtgtctcttcattacttgttattctagcctttttttttttttttttttttggagacagagtttcactcttgtcgcccaggctggagtccaatggcacaatcttggcctacaacgtctgcctcccaggttgaagcgattctcctgccttagcctcccgagtagctgggagtgcccaccaccatgcccagctaatttttgtaatttttgtagagatggggtttcgccatgttagccaggctggtctcgaactcctgatctcagatgatccacccaccttggcctcccaaagtgctgggattacaggcgtgagccactgcacctggcctgctctagcattttctatgaattggttgcttatgttcattgcctattttttttttcttttttggctgtttgtttttttttttgagatggagtcttgctctgtcacccaggctggagtacagtggcgcaatcttggctcactgcaagccccacctcccaggttcatgccatcctcctgcctcagcctcccaagtagctgggactacaggcacccaccaccacgcccggctaatttttttgtatttttggtagagacagggtttcaccatgttagccaggatggtctcgatctcatgaccttgtgatccgcccaccttggtctcccaaagtgccgggattacaggcgtcagccaccatgcctggccattcattgcctatttttctattgatctttctttttcttgttgatctgacttgaatattattgatattaattacttgaaagcattaattttgatgtcatccattaattttttaccttgcaatttgtgcttttggaatcttgtttttaaagttgttccctatccctaggacctgaaatttttatccttgaacgtttttgcttatattttacttttgatgtttaggtctttaatatatctttattctactttttatatatgatggtagagatccagctttcatttttcctccatgtaacaatccagttatcccaatattatccactaaataacctatcctttgcttactgctatatggtgtcacctttatcatatttcagttcccatgtatacctcacttggttctgcattttcttgctgtttttcttaatgccatgttgttttcatcacttggtccttgtgttgtatctctggttagtagggtgagttcccactcttggattgtattgttattattttttgtatgcttgctctttcctgtgaattcttagaataagtttgaggtcctcaaaaaaaatccaactagagttttctttgagatttatagattaatgtgaggaaaattgacttttctattattattatcttatctgtgagcctggtatatctctgtattttttttcagatcttcttttatgtcctttaacacaggtttaaattattctccataagtcctatactttttgagttaattgtgtttttaagctatcgtgacaagcattttattttatatttttcaaattgggtataaaggagcattattaagtctgtcccctgaatatgttgttatagaaaatttcaagcttacaacaaattttaaaggttttttttcaatgagcacgcaaatatctacccctgcgtccttcaatttacactttactatacttagtctatcacctatctgtctctccaccaatctatcttaaatttttattcatttgaaggtgagatagagatattaatacatttctcccccaaagactttgatatgcatatcattagagttcagtatttattgacaatttttttattttgagataaattgatatacagcaaaatgtacaaatcttaaacataccatttgaagaataaatgcatgtatttgtgcaaattaaacccttagaaaacattaccattacctcagaaaattctctaaatgttccttgcaaggcccttccctcctcaagtcccacccaaagagagaaggagagagataagatgtaaataaaacaatgaacagagaagaaatgattagaaacaagatggagatttataagtgataaaagacattataagtaattataggttaatatatcttaaagtgctgctactgcagctctttatttttttttttaactcaggaaattaataaaatattttgctttccctcttccctcacagttttctttagtggttctcaaaaattggaatatcatttattggaccatttccaaccttgtatttgaaaagtttaggataggaggggaagagaaaatgagagcaggaatgtgtgtgtgtgtgtgagagagagagagagagagagagagagagtgagagtgtattggaaataggccgtgttttccttctggattatatataattttattaatgactgctttagcaataaaatgattctaaatatgatagaattttagaaaacttgaggatttttaaaggctctttttccccccttttccttatgtagctttttcctgaaaccaagtacctctggtgacagtttacaaagtggaagcattccattggcaaatgaatccttggagcacaaacctgtatccagtttagcagaacctgacttgatcaactttatggacttcccaaaacataaccagatcataactgaagaaacaggctctgcagttgaaccaaggtatcaaagggtacagagacctctttatgtagtaataaatggggtacccttgtaaaaattctgtctctaaagacaacctgactcatataggcataagttctggcatttaagagtacatcttaacttattaccacatagtgtttaacgagctaatgaatgaatctgatgataaaccatttttgaactaagtttaatattttacagttgtcttttacaaaatgaacttctcaacagtaaaatatttcccttttaatatagtcattgccagtttccagaggcgaaatgttctctttctgtgaaatgtacacttggcccttaaatactaattgaatcaaacatttattgagactctattgtatgctaaatattatgctaagctctaaaaataaaaaagtaaatatgactgggtctctctccttaggtggatcgtggcctagtagagattaaatacttgtcagtgtctttattgtacttatttgcatatagcatacttctaggtaattttgtttaataaagatgaaataatatttgagtaaagcaactgaatgggtactttgtctttttaaaataatacctgtatatctacaatatgtcatcttcccacccctcaccagaaccatctactccatcctgtttttctgaccagttttacaaaaatggttgaaggaaatgcaattcttacaaggtggtgctgattcttcttagatatatttagtagactcaaggtccattgtagaaaatactctagctctacagatttagactgtttttcaacatgaacatagcatttcttctatatttatttttaagtgatgaaataaagagagccagtggagatgtccaaactatgaaaatttcatctgtgcctaatagtttatcaaagcgaaatgtgtctttgactcgaagtcacagtgttggaggcccattgcagaatattgactttacccagcgaccgtttcatggcatctcaacagttagtcttccaaatagtctgcaggaagttgtggtatgtaacaacaacaacattgtaattatactgcatacacacctaagtatatagtagaacattataaattcttctgtagtggacttattttaattacatgaaaagtgatagagtttttccataaacaaataactttttattgtggagaatttcaaatatgtacaaaaagaaacagtataatgagtcccccatcatctagcttcagttattttcagtttatggcattcttcttttatgtatattctcattcagttctctctttttttgagattattttgaagcaaatttcaaacatcacatattctgttagtaaatatttcagtatgtatccctgaatgatgaggactttagaaaaatataatcacactgcttttatcatacaaaaaaaaccccaaataatagtatcaagttatttagtctgttcaaatttctgattgtctcaaaaatgtcaaatgcatatgtgtgcttgtgtatgtgtgggttgtagtttgaggaatcaggatcaaataaagtcagtgtattgcacttggttgatatagtttttagtctttttgaatctgtagactcttttcctcttgcaatttatttgttgataaaactggttagagtacagttttccataatccagattttgctgattgcaacgataaaagttggaatttgtgtccggaaccttgatcagatttggggtttttgtgttagtgttcatttgcttgtttatttttgtaagacgatttcatcagtggtggtatgttcctcccagcaggagacataaacattagtagctattaatgccttaatgcctagataaagtaattcattaggagctataaaatgataatggtctcattctgtcatttcttccttataataaggaatacataaacagaaatttccctatgtctctgttagattttcaaaagataaaatttatagtggaaaggcaggttaaatgcttgattttttccttttatttagagttttcaaaatagcgagttgagtccctgtcattctccaaggtcatcaattaatttggaggaatagggtatcattatgagctcattgatttcaacatttatgtttaattaagtaattaatttttagagatggggatcttgctttgttgcccaggctattcctaaactcctgagctcaagtgatcctcctgcttcagcctccctaataactggaaccacaggcacacactaccatgccttaaacatttatctttatatctattgctgtttttatcgttgttcatgcttatattattctctttggtcagctagaagcctctagaagttagctcattagtccttttgacacaactctagtagcatttttgtaatttttaaaaagctttcttgctttcttatatgacaagatgttttatgcttatgttatatactttcttacccagacctagaatcagctgtttctctaagaaactgtgggtccctttagagggaaatggttttggagaccacagtctaggcaccagggggactcactgttgatgagagagtcttaaacattttatcctgattataatatgcataactcacaaagtctaggttgggtcttttttcatttcttattttatttgaattataaaaatgctatttctttaattccttcagtttttgttgcaatcagttgtaaaagtgagttaagtcaacaaagaatattaatgcaaaagattgccccatcagtttagagttgtaggaggaagataatgtcacacagtttttacacacatacattactataaagcatctgaaatgcaaatatttcttataaaaattgaaaaaaacctaatacattcaggccattgctctcagtgtgatagagaacatgttttaaagagtctgttgattaattttcttttgtaatgatttaacttaacagtatttaagtattttcttttttaggttttcattcattagcatattctcttgcatgtagcaatggtcctaaaataactgatttaaaaaggatagagaggcattatctcattgagaagtgctcttgagcatacagatttaaacagataatattaatttctttttgtattttttttaaggatcctttaggaaaaagacccaatcctccccctgtttctgtgccctacttgagtcctctagtactccgtaaagaacttgaatctttgctagaaaatgaaggtgatcaggtgattcatacatcttctttcatcaatcaacatccaatcattttctggaacctcgtttggtatttcagacgtttggaccttcctagtaacttgccaggacttatcctcacatctgaacattgtaatgaaggtgtacaggtagggtgccaacttttatacttacattagtattcagtaggatgaggcttaacttcaaggtcctgaaagtatacaacagtagcagcttaacaagacagatttatttctctctcacttaaaagtttggataagcagtcctggaatggtaaagtgttaggaacctaagatccttttatatttttgtttagctatgcatatcctccatttccaagttctgcttttggtccaggatggctgattacctccaagctgtcacatctactttctatccagcagttaggagaaaaatggatggagaggagagtatgtcttttttcttaagggatagctcctggagttgtagataatatttctacatatattttcttggcctgaactcagttattaggtcatatctgtctgcaagggtagctagaaaatgttgcccaggctggagtgcaatggcgtgatctcggctcattgcagcctcctttttctgggttcaagtgattctcctgcctcagcctcccgagtagctgggattacaggcacccaccaccacatccagttaatttttgtatttttggtagagatgggattttaccaggctggtttgaattcctgacctaaggcaatccacctgcctcggcctcccaactgctgggattacaggcgtgagcgactgtgcccggctggtagctattattcttaactgttctgttcccagctgcaattctcacaaccaccttatttgaaaggacccatattatccatatttttcagatgttataattaaaagttagagaaatttagtaatttctgtaaggtgacatacctaataagtgatggagacccaaggtcacattctggctgtctgacttaaaagccccaactctacttatactgggatcctgattccattagagacagtgagctcctagagtgctttattttataggattaatattgatagacactcaggccctaaacatatacatggggcaaaataaaatctttccttaaagtactataaactctagtttgattaggtaggtgaaacaaaattatttggtaaggtagtagaacctcttgcactttgaccttaaaatttgctgtaatggtaattaatctttctacaaccatcatgccagttagctaattgtcatcccatttcttaaaagtcacactgagaaaccttgacctcagaaaataataataacatttgtcatcagacattaataaaaattaaaattttgattctgaattttaggtccagaattttaaaaggactcatctgttttatataatcaagcttcactagatctactggtaattgttattctcgggatactaatactttcttttgatttcttttagcttcctctgtcatctctgtcccaggatagcaaacttgtgtatattcagctgttatgggataatatcaaccttcatcaggaaccaagagaacctctgtatgtctcatggaggaattttagtaagtaaaatagaattaaagacataacagccaggtgcagtggctcgcacctgtaatgccagcactttgggaggcctaggctggcggaccacttgaggtcaggagttggagaccaggctggccaacatggtgaaatcctgtctctattaaaaatacaaaacttagccaggtgtggtagcaggtgcctgtagtcccagctactcaggaggctgaggcttgaaaatcgcttgaacctgggcagcaaaggttgcaatgagctgagatcatgccactgcactccagcctgggtgtcagagcaagattgtatctcaaacaaaacaaaacaaaacaaagagttaaagacataaaagactcaaaatgggaacaactcaaatacgcatccataggtgactggataagcaaattgtggcacattccatccatactgtaggatattgttctgcaataaagaatggactgctgggaagaaaaaaaagaaacagaattaaactaaattcccctagagttaaatatagaaaagcaaattattttgctttatttttaaatttttaattaattcaaagtgatttgctgttaaaaaaaaaagtacacacacacacacacaaatgaaaaagtggtttgctgttttactgacctgttttttaattgtgacgggtctcaactgagttgagtaatttttttggtgatttttctatcaagtaaaaatttggttggctattttgagagtaaattctatatagcagaagagtaatttagatgtgttggtataggatcataagttcagctgtattaatggttactgactggtcttaagggttctggcttcatttttaatcttttagagtatatttttacaaggtgtttaaagagttattattcatgtattcaaaagccttgtgaatcagtaagaaaaatacaattcagtagagaaatgaccaaatgatattaataggtaattcatattaaaaacattaagcagctttcaaactgtattagtttgctagggctgccataataaaataccacagactgggtggctttaacaacagaaatttattttctcacagttctggaggctggaagtctaaaatctagaaagggatcagcaggtttggtttcttctgaggcctctctttggcctgtagatggctgccctcttgctgtaccctcacataaccttttctctgtgtgtgtgcatgcacatgcacacattcctggtgtctccttttcttataaagacatcagctgtattaggttagggccccacttggccaggcgcagtggctcatgcctgtaatcccagcactttgggaggccgagggcgggtggatcacgaggtcaggagttcaagaccagcatggccaagatggtcttggtcatctctactaaaaatacaaaattcagctgggcgtggtggtgggcacctgtagttccagctgctcgggaggctaaggcagacaattgcttgaacccgggaggcggaggttgcagtgagccaagatcactccagcctgggcgacagagtgagactccatctcaaaaaaaaaattaaaaaaacattagtgccccactcttatgtcctcatgtaaccttaattatttatttaaaggccttatctccaaatagagtcacattggcaattagggcctcaacatatgaatttgggggtgacacaattcagtctgtaatataaacatattttaaaagctcaatcatactagtattaagtgaaatataactttatattttaaaaaaggaaaatgtaggcctggcacggtggctcatgcctgtaatcccagcactttgggagatcgaggcaggtggatcacttgaggtcaggagttcaagaccagcctagccaatatggtgaaactctgtctctactaaaaatataaaaaaaattagccaggcttggtgatgcacgcctgtaatcccagctactcaggaggctgaggcaggagaattgcttggacccgggaagcagaggttgcaatgagccgagattgcgccgttgcactccagcctgggcatcgcagcaagactccatctcataaaagaaaaaaaggataatgtggctggcgtggtggcttacgcccgtaaccacaacactttgggagtccaaggcaggagaatcccttgagcccaggagttctaggcagcagttagctatgattgcaccagtgtactccagcctgggtgacaaagtgagacctccccgccttcctgtctgttaagaaaaaaaaaaaggaaaacataaacttgtaactgtcaggttggcaaaaaacgttaaagatgaagattgtttaaaaaaatttaaagattgttgaagatgtttggggaacactttcatatacttttagatgtgtaaaatgatacatttctggagaacaatatggcagacatgtagatttcatatgtggataccctttaaactcaggaattgcagttcgagaactctgttctatagaaatacagtacacagctaactgtttacacaaggatacttactgtaagatttttttttcttttgagacagggtcatgtctctatctagcaccctgctcataaagcaggaatgtcactctaaaagaagggccactgttcccagccccagctccagagcagtggcttagaaattttgcccaggggctgggcacgatggctcacgcctgtaatcccagcattctgggaggccaaggcgggtggatcacctgaggtcaggagtttgaaaccagcctggccaacatgataaaaccccgcctctactaaaaatacaaaaaaatttgccaggtgtggtggtgggcacttgtaatcccagctagttgggaggctgagacaggagaatcagggaggcctgggaggcggaagttgcagtgagccgagatcgtgccactgcactccagcctgggcgacagagtgagactgtctcaaaaaacaaaaagaaaacgaaaaaaaaagaaattttgcccagggggagaggcaggtcataagaatagagagctctgaaattttccctaaaggaaattattttatttggaacagagtgtggagaagtttaagcctgagagcactctcaaaaacagtggagattttggtcagaaggccattattaccctgatacaaagaccaatgacatcataagaaaattaaaaatcagtatcatttagtaatatagacataaaaatcgtgaataaaatactagcagatcaaatccagcaatatataaaaatgattttacaccatgacaaagtgggatttatctcaagcatgcaattgtggtttaacatttgaaaatcaattgtgtaatatactatcaatagagtaaaggacaaaattcacgtgatcatctcaggaggcacagccaaatcatttggcaaaatccatcaccctttgtttaaaacactcatcaagctgggaatagagaagatcttcctccgcctggtaatgggcatctatgaaaatctacagttgataccatactcttaacatactttctcactaagtacaagtgtaagacaaggatgcccacttttgccatttttatttaccattctaccagaggttctagctagagtaattagtcaagaaaagaaaaggcatccaaactggaaaggaaaaaagtaagtgtatctatatttgcagattatatgataaatgatatttattttttctatatatataatatatagaaaattctaaggaatagacacacacctaacatattattatacacacacaccatattagaactgcataagttcagcaaggttccaggctataagatcagtatagagaaatcaactatttctatatctttgaacaaataattcaaaatgaaactaagaaaacaattttatttatttataatagcattagaacaaaatacttatggataaattgaaccaaagaaatgcaaaacttacactccaaaaacttaaataattgttgaaagaaattaaagaataagtaaatggaaagaatccaatgtttatggtctggaaaagttaatattattaagatggaagtagtcctaaattgatttacagattgaatgcagtccctatcagaatttcaggtagcttctttacgtaaattgacaagtgaatcttgaaattcatatggatgttcaagggacttagaatcacgaaaacaatcttgaaaaagaacagtgttataggactcacagttcttcaatttgaaaacttactgcaaagctacagtaatcaagaaagtaaaatactggtgtaaaaagagacataggttgatggaatatagctgaagttccagaaataaaccctcacatgtatgtatggtcagttgcctttcagtgtgaagaccatttaagatagtcttttcggccgggtgcagtggctcacgcctgtaatcccagcactttgggaggccgaggcgggcggatcacgaggtcaggagatcgagaccatcctggctaacacggtgaaaccccatctctactaaaaaaatacaaaaaaattagccaggcgtggtggcgggtacctgtagtcccagctagtcgggaggctgaggcaggagaatggcgtgaacccaggaggcggagcttgcagtgagccaagattgcgccactgcactccagcctgggcaacagagtgactctgtctcaaaaaaaagaatagtcttttcaacacgtgctgggacaacaggctagcaataataaaaagaatgaaattggatacttcctcaaatcatacatagaaatgaactaaaaatgggtcataaacctaaatgtaagagctaaaactataaagcacttagaagaaaacataggagtaaatcttcatgactccgtgttagttaggcaaggccttcaaaaaaagcaacaaaagcacaatcaacaaaagaaaaagtagataagttggatttagtcaaaagaaagaacttctgaaatttaaaccatcaaaaaagtgaaaggtcaatcgacagattgggaggagatatttgcaaatcatatcttaaaaaggatttgtacccagactatgtaaagtactcttacaactcagtaataaaaaggcaacccatttttaaaatgagcaaaggctgtaaatcagtagttcttcaaataaaatgttcaaatggccaaaagctcatgaaaaatgctcaacagcactagctgtcaaggatatgcaaatcaaaaccacaaggaaataacacttcatacttactaggatggctataataaaaaaaaataataacgagttagtgaagatgtggagaaagtggaaccctcagacactgtcagttagaatataaaattgtgcagctcctttggaaaacagtttcacagctcctcaaaatggcaaaccatatgagttaccatatgatacagcagttgcactcacgtatatacctaagagaaatgatgtccacatgaaaacttgcacatgaatgttcataatagcatttgcataatagccaaaaatacggaaacaaatgtctatcagtctatgaattgagggctgagcgcagtggcgcacgcctgtaatcccagcactttgggaggctgaggccggcagatcacttgaggtcaggagttcgagaccaacctggccaacatggggaaaccccgtctctactaaaagaaatacaaaaattagctgggcgtggtggcacatgcctgtagtcccagctacttgggaggatgaggcaggagaatcacttgaacccagggaggcagaggttgcagtgagctgagattctgctgctgcactccagcctgggcaacagagcgagactccatctcaaaaacaagaaaaaaaaattatgaattgataaataaagtatggtatatccatacaatggaatttcatttggcaacagaaaacaatgaagtactgatatatgtacaacacagttgaatcttgaaaccactctagaagagaaaccagttgtgaaggagcatagattgtattattccatttatatgaaatatccagaataagaaaatgtatagagacagaaagtagattagtggttgcctagggctaaggggttgagatggggtttctttttgggatatgaacatgttctaaaattgatagtgatgatggttgcacaacttcatgaatatactaaaaaccattgaattgtgtatttaaattggtgtaatgtttggtttgagacttatctcaataattgtgaaattatagcatagtgtgaagattaacactattcaaagtctatcatttagcaggtggaagacctaggatgaaaactcatagcagccagtatttcctgttatcataacagaggactttgctatttttttttttttttttttcggtttaacacaaatgaactattaccagttgtctttatttaggggcggtgttacacaatacaatataattaaatgtataatgaaaaagacaatccgcctgcctcagcctcccaacgtgctgggattacagccatgagccactacacccggccgaattacgttccttctaattagcactagactctgctatatttaacagaaaataacagaggctgaaacaggtaaagattattctctcatatgaagttattaggctaggcaaatcaggctagcacttttggaggccaaggtgggaggatcacttgggaccaggagtttgagactaggctgggcaacatagtgggagcccatctctacaaaaaataaaaataaaaaattagctagatgtggtggcatgcccctgtagcctcagctactcgaggctgaagcaggaggattgcttgagcccaggaggtcaaggctgcagtgagctgtgattgcacgacttcactccagcctgggtgacggagtgaaaaactgtctaaaaagttatgaattacatcatgttgtacaccataagtaaatacaatttttacttattgattaaaaataaggctagacatggttggctcatgcttgtaattccagtgatttgggaggctgaggcaggaggactgcttgaggctgagttcaagactagtctgggcaacatagcaagaccctatctctacaaaaataaaataaattagccaactgtgatggtgcatgcctgtagtcctagctatttgggaggctgagcagggaggactgcttgagcccaggagttgaaggttacaatgatcagccactgcactccagccttggcaacagaatgcgatcctgtctccaaaaattaagtaaatacatttttaaaaaagaaaaaaagttatgtactagacagtctagtactgctagacaactcctctgtcatcagggatccaggttccttctgttgtacctgcttttatggctgctggagtacaagctatcacattccagcctcaggcagtaagccaccatatattagaagagaaaggcagagtgacaggtctgcctgtttgaagggagcaagcaggaaaaatattttttagttgggcacactgccacataattttactagtagtggggaagtgctattggttaagcaaggagaaaatgcgacaactctggagaaaaaactttttaaataattgggactgggactgggcacagtggctcatgcctgtaaccccagcactttgggaggcagattgcttgagcccaggagtttgagaccaacctgggcaacctggtgagaccctatctctacaaaaaatacaaaaattagctgggcatggtggcatacatctgtagtcccagctatttgggagattgaggtgggaggatcacttgagcctgggagacgaaggttgcagtgagccatgatcacatcactgcactccagcctgggtaacagagtgagatgttgtctcaaaaaaaaaaaaataataataataataatagtaataattgaaaaaaaacttactgtgttcttattgttagattctgaaaagaaatcatctctcctgtcagaggaacaacaagaaacaagcactttagtagaaaccatcaggcagagtattcagcacaataatgttcttaaacccatcaacctactttcacagcaaatgaagccaggcatgaaaagacaaaggtaataatccagtattttttgcttgccaccactcagtcatttcatgtttttaaaaaaatatcttacttttaaaaatatctctagttgtcgaagaaacacatactcattgcaaaacatctattgttttaagtgctacacagatatatacattcctacttgaacacaaacacataataaaagtgtctgggggcttggcacggtggctcacacctgtaatcccagcactttgggtggccaaagcaggaggattgcttgcttgagctcaggagtttgagactggactgagcaacatagcaagaccccatctctacaaaaaataatttgtcaggggtggtatgtgcctgtgacctcagctacttgagagggtaagacaggaggatttcttgagcccaggaggtccaggttacagtcagctgtgatcacaccgctgcactgccacctgggtgacaacagcaaaaccctgtctcaaaaaaaaaaaaagagtggaaatagattccattttaagaagatcattcattgatctaaagtgtactgtcttttggaaacattactgctgtttgctggaaacctataattatatttattaacattgataaacttacgtaccacttattcagggcctgtgatacccacacatcttttcttttgttggacataagagaatatgggaataggagcagaaacaatgtagcaaagagatagacgcagtgaactacaaaggatatggagttattgtgctcctgtcactattgtctgctaatatgctcagattagtactcatcccctcctcaacataagtgaattttgcagtagaagcttcagaatagtgtgcgtaatcgcgtatatcaaacattcctaatgtttccatggtccccttcaagttttttaggtcatggcatctttgaagataatctcagaagtgacagggcaagaattgataatgaaaatggatggatccatttttactatcagtagttgaggtagagatgaccttcttcacagtctgtaatatgagtagcttgcttcaagcatctgtagtttaaggacaggaatgtaatattagaaatgtcatattatggcttctgaagcttctaaagaaagtgataccaagtgtcactagaatcagccttacgtcttttttttctctgtacatcagtgcatttcttaagttttcctgtcatctttaacaactgagtcatgaagctcacttttagtgtttcatttgtaacattttaatgctcacaaaccaaataaaggtgaactgtcctttgctattgggttaaatagtaaagagaccacaccaccttttacattgtttgtgtcaagggttttagacccctaacttacttagaaattaatctgttactttgtcaagtgacaaaagatgagagaagactctgcttttgtaaattttatttagaaattagagttaaaacagttatgtattgttgaaatgtaataaagttaagccatttttgttactagtgtgaagctttatgcccattaactatgttttaactttaatttggaatagaaacctgcaggaagttacaaaaatagtacagaattcaatgtagccttcacacagcttcctccaaatgtgacacctcatataactaactgtaatgtaatattaaaaccaggacattgacatagttatattactattaactagatgacagaacttaatgtcttcaccattaaaaaaaatgcatctgtgtttttatgctatttgcccattgacttttaaaacatatttgttttataggagtttatacagagaaatcctcttcttatcattagtgtctctaggaagagagaatattgatattggtaagttggttaataaaagattatgaaaggaagttttacattttattttcaaaagtaatttttaaaaatgtagctggtatgtataaaagatttaaaagatttctacttctaaatatatagttcaaatacatataatttgactcaataccaatttgaaatgaacggctgttgtctttcttaacaaattacaacttcatttttgaaaatttctttcagaggcatttgacaatgaatatggaattgcatacaatagtctgtcttcagagattcttgaaaggttgcagaaaattgatgctccaccaagtgccagtgtcgagtggtgcaggaagtgttttggagcgcctctcatttaaatagagattcactagaatgttgacacacaaggcttggggattagatttcatctggaaacattcaagtttttttttccaaatcgtaagaactggtgaatacggaattgaagtaactcttggggacaatatataatgaattatgattcatattgcattaccttgaaatatgaagtgccatttgaatgtcccagggcttattaatattgaagattttcaacccctgaactgcttttctgcctctgtggaaaactactttgggattcttcagtatttgtagtagtttgatagaaataatgaggaaccatattcattctaggcattgtttatatttgaagttactgagtttgaggaatggcaaattaaatttgcctaacccccaaaacaaatgaaatatctcaattataaaagcaacatggccgggcacggtggctcaggcctgtaatcccagcactttgggaggctgagcaaggtgggtggatcacttgaggccaggagttcgagaccagcctggccaacacggtgagaccctgtctttactaaaaatacaaaaattagccaggcgcaccactgtagtcccagctactcaggctgaggcaggagaatcgcttgaactgaggcagaggctacagtgagtggagatcacgccactgcaactccagcttgggtgacagagtgagaccgtctcaaaaaaaaaaaaaaaaaaaaaagagagcaacatatttgtgtaagtttgtatatgtgtagggctgtgtaggtatgtgtatatacagccatattctaagtgtatatttattaaaatagattgcatgttgcaatacggttttctgaaaggggtctcattgactattaaataaatgactactactaaacttgtctgtagtcattaatcttaaaattacctgaaaatctgatgacagctgccttccctaactttaatgtattaggttggcacaaaattaattgtagtttttgccactattaatggcaaaaaccgcaattatttttgtaccaacataatacacctttcatattatgtattatcttgcttaatgggttttatcttgattatccagttacttccatcctcttcccaatgttaatttgcaatagttttaaaatgggaacaaatgaatcaatcatcagatagttaaaatgaaattaaatcagctgcctaataatttatggaattcattggaatgtgcttaaaatgctaaagtgtatgtcattgaacatgaaatcttttttcaggcacatacattgttggtattgatgactttttaaaacctgtgggataaacttgcactgcacacggaagttttattcttgtatatttagatttgtatgcttgtgagtaaaaatgtgcatttgtaaatactgtgtttttaggttgaatcaattaagtcttaaaactgtaaatttattaagcttgttgccagtaggtttaagaaaatcatgatctcacatgcctcactttgacatttatcatgccttttattaaaaatatcccttaggaacagtaagtttgccttaactctctgcatggtttaaaaagccattggttttgtgtgtgtttacagtaattatgcagatgactaaatgagttgacacagtaaaattacttccatatggtacagtaacaacctaactcccttctacctgatgtaaccatttacaaattatagttattgtaccagtctttcaacatttcagggttaatctgacctatgcagaattctagtgtgaatttattgtgaaaatgctaaatgaaacaatttgtcagaaattatgtacaattttcattaccttcaaaatggatcttttgcactgtctgagagtatatatttttgcaactcaagacttggtactagttttaatacttaacacttactgacccaacagaagtttggaattaccttgcatataaaaattgaggttgaataaaatgaaaaattgttgttttctgttacattaagcctcttgaaatctgtaatctttagaatcccaatattttgttttttccattccttcactcgtaacttgaactcaagttttcacttactgacgcgcttcccattaaaaaaaatctgtaaagatctctaccttgaaaactttagtctgctgctgccatttagatattgggactgatttcttgttataaatttttaaaggctttttccaatacccaccacagagagggtaccactaaaaatttacaagacaaaaacattattatggaaagatttagaagtacctggaatgacttgtagcactgtatgcaactttaatcctgataacttctaaaagcaatctttcaaattagtccagattactcagcagtaccttatattggtttggggttcgatagcgatttttttttcttccaacgaacgaattgtacaggttgatcacaacctgcatagttaacgacatgtcagaatgacttgcgtgtgtgtggagaactgggtatggtggctcacgcctgtagtaatctcaacactttgggatgccaaggcaggcggatcacttgagcccaggagttcaagagtagcctgggtaacatagcaaaactctacaaaaagcacaaaaactagccgcagtgcacacctgtagttcccaggcggtcaaggctgcagtgagccataccactgctcgccatccggggcgtaggagtgaaaccctgtgtcaaagaaaaaaaaaaatctaaggaaaaacagactgtccttattttgtggctgcactcaattttcagaaagcagggcggttctcatgttttgtgcatcataaacaagaactggttaatataaaactttggaccataacactggactcaccttgtggcttttaagttcctctctctgcttgtgctaaatttttttttttttttttttttgagatgggagtcttgctctgtcgcccaggctggagtacaacagtgtaatcttggctcactgaaacctcaacctccctggttcaagcgattctcctgcctcagcctcccgagtagctgggactacaggcatgcgctaattttcgtatttttagtaggaacggggtttcaccatgttggccaggctggtcttgaactcctgacctcaggtgatccacctgccttggcctccccacctggccatcccctttgccttttaagttctgcatattattattgattgccaactaagattcttttcatgttatgtagctttttaacaccatgtagtaagaggaatagttaagaatcttagtaggcatcgagggactggcactaccggcctaacacctgggagctttttagtaatgtaaaaatgtgggtccccactcctctatcaatcactatctgcgccttaaccagacccctaggtgattcacatgtacatttaacatttagaactctgctttgtaaagctattattacagtaatgccaacaaagagcttgcattacttcaaccttaaagcctaatgtgccaccttctaaagatcctgatattgtcacaataggctagtcagcatagaactgttagaaaaaagtacatactttgtgcatttttcactgatccaagaatgtttttagtcatttccttttcagtgtgtgaacagcctaacaattcactggagttgaaaagctttgttaaaacaaatttgaaatggcttaaaaaccatttagtggatggtatccactaaaactaggtatccactaaaactatgccttaaaagttaccttttaaaaaagacatgttcatcttcacaaggtcaattttcatgtattaaattgtgtatagtgctttaaagagctatattcctcaaaaataaactatataaaaaagattaatagtcctcatcatttcccctaagttccatgccattctgaagaggcaggtgtcttatgctcagaatcccttcctgtgccacccatcccctgaaaggaacccctgtacactgaccttgtcttccactaccacacacaataggtctgactttatccaccattggaataccatatatacatatccccattttctatgacctaactttccctctcttcatttatgtagttttctatcagcaatgaaaagtcaacagagatcagagtctgatcttatttatttgttactcaaaaaatcttatttctgactggattcagacttagaagtagaagctcgcagagaggaaagtctgcgtctcttcgcaatttgttcctggcgcttctccttagcctcctaaacaaaacaaaacagcaaacagttaaggcctttctgggttaaagacgcaaatccaaagccaggtcgaactcctcccaccccctcaaatcatcttagactaaccttcattctcttggccaaaagtttagcatattctgcagcctcttctttatttttcttggtacgctgcttcttcagagcaatacgccgccgtttgtgctgcaggacacgtggagtaacaagacgctgaatcttgggtgctttggtcctaggtttcttacctaaaaattcaaaggactcaatcatttcaatatttgttttgttagaatccacatctactttaaaaacatcagaaataaacgtaagcttaacagcatctatgaaaacctataatgaggcctttaaaatcaaatcagaactattctaaaatgctttttgcccctccacagaaatctagaagattggttaaatattataaaaatataagggaaaccaagtcctgaaaaataaccaggctaacttttactaccttccagttttactaaaatacagtggcattatgttaatatataactgtgcatagttaatttgtctgtgaaaaccacttaacacattatctacataatcatcctgccatacttttaaatttgatgtaagcttgcatctctatttcctttgacaattcctgccaattcaggggtaacgttaactattaacatcagattaggtggcatgttgttaaagtatcttcattaatctgatctgtactccaaaactgctcatggattacagatctgcattggagcataggccttttcagatgtatttgtttcatggacactttgtaggagttaactgccttaggctaaatgctcagatgttcagattctgctaaaatgttaagcctcctactatagacataagaaccatctaaaaatacccatcaaccagaccacgcttgtattatacggattatttccagggctatgattatgggcaactgccacctatttgtcaattgcttttttttttttttttgcaacatcagcttcataagggtaggaatttgtctatactgtattctcagcaccttgaacagtacctgtgctcaagtaagtgtaattactgacttaacagacgtatactatctatgccatgtatgttaagtcacaccagtcctgaaaaccaaaatccagagaaattctttcaaattttgtcaggaaaacccaaccttgactgacatgctgtttatttaacataaatatccccaaatttcaccacagaaatattgctatttgaggtcctcactggtgagtatgttgtctactatatggacaaaagttcttaaaaggtaaagctccaaaatccctaacacctgctccctagtattctgagtaaggtctctaacttctaattctcacaactcttaactattgttatccatatcctacagatgaaacagaagtttaaagcaacttcttttgtaagccaaaaaataattttgggctgggtgtggtggctcacgcccataatcccagcactttgggaagccaaagtgggagcatcacttgagctcaagggttcaagaccagcctgggcaacagtgtgacctcatctcttaaaaaatattaataatttagaacatctgatataaaattacaaagtgtgtggtgctaatagtcccagaattctcaaacatgtgactcctaaaccagatagcaatgaccttaaagtcaggttatttttggataatgtatacatcaaagattcacaagcagattttcaacgaaattactgcactctacaaggcactggatataataagcaaggattaacaccaactgggtatgctggccacccccaaatattttctgtaaaaactccaagtgaatagtgctaaggccttccaaaggcacatatttatcttctgatatgcacacaaaatgatagacaaattaccaaaattaagcaagccctaattgcataatccctcctaccttctttatttaagggctttcttacaacatactggcggacatcatcttctttagagagattgaaaagtttgcggattctgctagctcttttggggcccaggcggcgaggcactgtagtatcagtcagtccaggaatatccttctctccttagaagaaacagttgaagagattttaattcaacaacttccttaagaatcctaaatcagaatgtttaatgttgaattgatggtagagaaacaaatccattggtctgtaagtctggatactgcaaatgaataagcatttggacaactggctttaaatcaatttcaacgaaaattgaacacaagtaaccctcacctttttttacaataaccaagttgagaacgctcagatttgcatccacaatgcaaccacgaactgattttctctttctttctccagttctccttggtctgtaacaggaatgccccttactcagtagcaggcggacacggccatgggtcaagacaccctgcttcatggggaaaccttgtttgtcgttcccaccactgattcggaccacataaccctgcaagagcatacaatgaatgacacatttactatttctattccaaaattatacagtacaggattgtgacctctgtgaacacacctatatgagaaagtataattatgaaaaccaatttgaacttaagcacgttttctctgttcagtgagttttgtctatattcccaacttgtcaagttcaattatcaaatgtctttcaagtcgcatttctaaccgatgttttattagagataacagcactaagaagataaaatatcaaacagcaacaaacaaatcagatacaaccctttttggcactttggggattatgaggacagctatgtgacatattgccaaatgcatgatgcagggcaagaattatgttgatgtaaactttacgtatattttatggcttactctacgtccccccctccaaggtaatacctctaactttataaagtggcattcggaagcaacttaccaaaggtcagaagccagaacccggagtctgaaccccattccaaataccagttaccaatggcgtttaccgtctctgacttaaatacctgcaacaatttgtcaacttttaccttccattcttcacccagagcgtcagcagcaacttctgtggccatacgcttctcatagaaagtacgaagtttgcgttcatcgtccacttcaatgagtttctggcagccagtggctgggaaggagatgttcagctaaggattaaaaggggggaaatagtttacgaaactatctatacaggtaattgtagagccatctacaaagttaattccactgcaaaaagcctttcatgttgcctccacacaagcaggaaatataagatgccgactgtactcactaaaagcacgtgaaagcagagtagcagtcaagaagcgccgcactcagcaggacgttttcccctcaagccccgcggaatgactctgggggcgagggcactccgcagccgttcaccctcccgaagcaagaaagccggggtcaagagccgcaccacaggcctgccgcaaactgggcaacacgccgcatccgtcccggctgggcgcggggacgccaccatggcgctcccggcccgccgcggctccagccgcaatcgcctgccatccgttcggccaaaaagctccatgccccagaaaggcgagccttctcctacttgagacccttctccacctaaagccaggatcctggagtgctggaactgaggcaatgccgcgttctgggactcgattcacgttccccaaacccagtctaacactcgccaccatcacctaccttcatcttgaagcagctgaacgcctccgaggcgccacggaaaagagggccaacttccgcttagcgcaggtcacataggcgctttcagttctcgcgagatgagcagaagtacgggatagcggaagtgagcatgggtgggcggtacttccgggcgagattaatcagggcctgggaggtaaagtcggttgggtgtgggtctgaggttgtgccagtggtggtagtctggtaaggcaaacccgcgtgtaattctgagggctaaccccttccctgtctagtcttttccacgctgcctgggttttggagctgggcgccagcggagccccacttctgtcccaggcactttgcatctgacggtaccaaaataggagggcaaggccgggcgcggtggctcacgcctgtaatcccagcactttgggaggccgaggcgggcggatcatcttaggtcaggagttcgagaccagcctggccaacatggcgaaactccgtctctaataaaaataggtaaaatagccaaaaataggtaaaatagccaggcgtggtggggggcgactgtagtcccagttactagggaggctgaggcacgacaatcgcttgagcccaagaggcggaggttgcaatgagtccagatcgcaccactgcactgcagcccaggcgacagagagagactccgcctcaaaaaagttcgagttcgagaccaagtaaacaagaataatttttactatctaaaactatcacataccatctccccactttagtgtcacaaaggtttgagtttaggactgttttacattcgaagttgaacgattctactgaatcctctttgatcatctcacattaattcatggaatcttggtgaaatgatgctttttaaaatctgagtactgtgtgtcatttttttgttgaggtgaaattgacataactagtcattttaaagtgaacaattcagtggcatttagtacattcacaatgctgtacaaccaccatctctatcgatacagttccaaaacattttcatcatcctaaaagaaaaccctgtaccctgttaaagcagttgctgccccttccccatttcgaccaggcctggcaaccaccaatctgtgttctgtctcagtggatgtacctacttcataaaaatggaatcatacaatattgaccttttgtatctgtcttctaatcttttgagtcgtagcatgtatcagtacttcactgcttttatggctcaatattctagtgtagatatagactgcagtttgtttatccattcctccataaatagacatttgggttgtttctgccttttaactactgtaaatagttcttctatgtttgagtacttgttttaaattattttaggtatatacctaagagtgaaattgctgggtcatatagtagttctattctcaactcagggagaaactgaaactgtattccaaagcagctgaaccattttacattcccaccggcaatgtatgaggaccgcactttatcaaaatcatggccaacacttgttatttttttaattttttaaaaatttattgtagggacagggtctcgctttgttgctcaaagtgagatcctgttggtctggaactcttggcctccagcatcctcctgtctcagcctctggagtagctgagactcattgtggttttgatttgcatttccctaatgactaatgatgttgagcatgttttaatgtgtttgttggccatttgtatatcttctttagagaaaagtctgtacaagctcttagctccccctgttatttttattgaagtagtgggagtaaattaatgtgaggcaaagagaaagtctagaactatgggctagttttttttgtttgtttttccttttaaaaatattttagggtggccaaatgcagtggctcacaccagtaatccagacgctttaggacgctgagatgggaggatctcttgaggccaggagtttgagatcagcctgggcaaacatagtgtcaccctgtctcatttaaaaaaaaattttaatgcgtttttaattgtgggtaaaaaacatataacacaaaatgtatcatcttaaccattttgaagtgtacacttctgtaatgttaaatatattaacattgttgtaaaatagatctccagaactttttcatcttgcgaaatgggaacttcatactcattaaacaactcctttccccctacccacggcttttggtaaccattctactttctgtctctatgattttcactaagcatctcatataaatggaatcaaacagtagtagttgtctttttgtgactggcttatgtcatttaacataatgttctcaaggttcatccatgttatagcatgtgacaggatttccttctcttttaaggctgaataatactctgttgcatgtatatactacattttgtttaaccattcgtctgtcaatggacattttggttgtttccacctcttggctgttgtaaataatgctgatatgaacatgggtgtgcaaatatctcttagagacagaccctgttttcaattcttttggctatctatccagaagtgggactgctggatcacgttagttctattttgaattttttgaggaacctctatactgttttacatatggctgtaccaatttacagtcccaccaacagtacacaagggttctttgccttttttttttttttttttttttgagatggagtcttgctctgtcgcccaggctggagtgcaatggcacgatctcggctcgctgcaacctctgcctcccgggttcaagcgattctcccgccacagcctcctgagtagctgggattacaggtgcgtgccaccatgcctggctaatttttgtatttttagtagagatggggtttcaccatgttggccaggatggtctcaaactcctgacctcaaatgatccttctgccttgcctcccaaagtgctgggattacaggtgtgagccactgcacctggcccacactcttaatataacagaatatttaattacatcagtttcccatcaacctaccaaagtcatttaataattatattggccatttccactgattggcaggagtctctcccatggtttccactgcatcatttttcttgccagacttagttcatttttagcctgcagaatcgcctcttctatttgaccaccttgaagttggtcttctgattttttatttttatttaattaattaattaattaatttttgagacagagtctcactctgttgcccaggctgaagtgcagtagcatgatctcggctcactgcaacctccacctcctgggttcaagcgattctcctgcctcagcctcccaagtagccaggactacaggcatgcaccaccatgcccggctaatttttgtatttttagtagagacagggtttcggcatgttggccaggctggtctcaaactcctgacctcaggtgatccgcctgccttggcctcccaatgtgctgggattacaggagtgagccactgcgcccggctggtcttctaattttttaacatctggttctgctttaaccatagccagtgtctcatttgtaatctgttctgtatactttctatatgctacatttttagggatttgctcaagaacataaaaaaatctttgtatacaatattcttagcctctcctgtggactctcgcatacagccaatcccacaaggccagtggtctctcttcagcacacccgtcatgactctggctaattgagaaaaaaaaaaaaagatttgtgtgtgtgtgtgtgtgtgtgtgtgtgtgtgtgtgtgtgcgtgcgcgtgtgtgtgtagagataagggctccatatgttgcccaggctggtcttgaattcctggccttgagtgatcctcctgcctcagcctcccaaagcatttgtccattttaaaatcgggttttttaatatatattcaggagactaaactcttattagatacgtgatgtgcaaatattttctcccattctgtagacttttcgctttcttaataatgttacagtttttaattttaaagcccaatttatataatttaaaaattgttgtagatcatgcttttggtttcatttaaaaatacgttgccaaatccagtgtcataaagtttacccctatgttttaaaatctaatcttaaagacttaccctatgttatggtcttagtttttatatttaggttattgatccgttttgagtttattcttaaataattgtgtgaggttgggactccagcttaattattttgcagatagatgtccagttgttccagcactatttgttgaagagactattcatccctcatcgaatggtcttgacactcttgttgaaaattaattgccataaatttataggtttatttctggactgtcacttctatttccatggtccatgtgcctatccttatgccagtgctatagctttgtagcaagcatcaaaataaggaagtaagagtactccaactttgttttttttcaagatgggtttagttcttaaggatccttttcaattgcacatgaattttagcatcagcttgttcatttatgcaaaacatgccattggaattttgatggggattgcatttaatctgtagctcaatttatggagtactaccatctttataatattaagtcttccaacttatcaacacaagatgtcttctcatttagttatgtgctgcataacaaattttggtcaattacagaccacacatacagcattggtcccatatgatagggaactggaaaattcccatcacctagtgacaccttgatgatcctgaccccatctaggcctagattaatgtttgtgtgtcttagtttttgacaaaaatgttttttttttgtttttttgttttttttttttgagacggagtttcactctgtcacccaggctggagtgcagtggcacgatcttggctcactgcaacctccaccttccgggttcaaatgattctccttcctcagcctcctgagtagctgggactacaggcgcctgccactgcgcccggctaattttttgtatttttagtagagacgggttttggccatgttcgtcaggttggtttcaaactcctgacctcaggtgatccgctcacctcggcctcccaaagtgccgggattacaggcgtgagccaccgcgccgggccgggtatatagatttgaaagctcagtgttggcacagtgaaaaaggtgggctctgagtaagggcctgtgttagtttgcaagggttgccataacaactggcaaccgacagaaccataacaactggcaaccacagattgggtgggttaaccaacagaaatttatttatttatttatttttgagatggcgtctcactctgtcacccaggctggaatgcattggcgcaatctcggctcactgcaacctccgcctcttgggttcaagcaattctcctggttcagcttcccaagtagctgggactacaggcatgtaccaccatgcccatctaatttttgtattttttagtagagacggagtttcaccttcaccatgttggccaggctgctcttgaactcctgacctcaagtgatctgcccccctcagcctcccaaagtgctgggattacagacgtgagccccctcgcccggccagaaattaattttcttaaaattctggaggccagaagtctgaggtcaagatgtcagcaggattgctttcttctgaggttctctccttggtttataggctgccatctgctctctgtgtctttcctctgtgtctgtcctaatctcttcttataaggacaccagtcattggattagtgcccaacctgatgacctccttttaacttaattacttcttttaaaaccctatctccaaatacagtcacattctgaggtactgagggttaggacttcatcatatgcatttttagggggacacagttcagcccataacagggcctgaaggcggagtctttcagccacgaagatactgactaaacagaattacatctctgtattcaatagtattaaattagtgatcccaggccgggcaccatggctcatgcctgtaatccctttgggatgctgaggtgagatgattgcttgaggccaggggttcaagaccagcctaggcaacaaagcaagacctcatctctgcaaaaaattttttaaacaaattagccgggcgtggtggtgctcacttatcatctcagctgcttgggtcccagcttcttgaaaggctgaggtgggaggatcgtgtgagcccaggaggttgagactgcagtgagccatgatcacaccactacactccagcctgggccacacaatgagaccctgtctcacaaaataaaaatagagtaatcctaagagcaatcagtataggtaaatttacccctaactcattatatgagtttttcaagtgttttggggaacaggaatgttttccaaagggaggtagaaatacagaaactaagagtagtatgggaggaagtaagttcgtgcattttagtaagctgtctcctttctggcccaaatcaaggaaacaggaagaataaaaaaggtcattttagacacaaaaaactaaatttcaacaacaattcctacttgtaaggaagaaactaattttgaaacatgccaagctgtgtttgggaaaggaagttaaatcaaagacctgaatctaggaaaattccttggcattatgtctgcaactatatccagtagcaagaattacaatagattactcaccccttgggtcagggacgaaggaatgtttttgcaaagttgcagaaaataaaatctggcatatatttattaaagacttggtagataggaagaagaggggaggtcagaaaaagtgcaagagtaaacctattttttttttgtcagatcaagtctctgtatcaaggcactatatatattcttttggtctcatgtatttgtatttcttcatagttatatgatgttgggcaacttattcctgtcttagtttccccatctgtaagatgaagataataccttattcatagacttcttgtcaggaattaactaatacattataaaagttaaacagttcttggtacatagtagactctcaataaatgttaactatcctcatcatcacaaccaccaccatcctcatcatcgtcattatgccagcacctctgactttgatcatgtggttttcgctgtgagcagtgccttcctttctgtgctccatctgcctggttttagtcgtactgcttctggcagtttttcctgagaattccaacacaagttgcagaaccttgctgcaagatggaagcctgaacttggtgctgaggtgttctggattcattcaaatggtggacagccatggggagagccctcaacaacattgttgaacaaatatatgctgagcactgctttatgtcagcaccaggctagcagcaggagatagagatgaggagtgatggcccttgcttccaaggaattatttatctaatggaaaaagaaacatataaatagataaagagatataacagaggtatttaaaaggcactgtagtacagcaaaaggcagaaataatctaaatgtctgaatcatcctccatcagcctaaaaatatgctggactattttctttctttctttctttcttttttttttttgatggagtctcagtatgtcgcccaggctggactgcagtggcatgatcttagctcactgcaacctccgcctcccaagtagctgggattataggcacccgccaccacaccctgctgatttttgtatttttagtagagacggagtttcaccatgctggccaggctggtctcaaactcctgacctcaagtgacctgcctgcctcagcctcgcaaagtattggaattacaggcatgagccaccatgcccagcctgcatttgtaattttgataaatactgctacattgctctccataggattgttccaatgtacacccctactaacaatgtatgagagtgcctgataccctaaagtcttactaagtgctgccaaactttggaattttgtcagtcggaggaaatacatgttatttcaatgtagttttagtttatagttttgttactgtgaattaagcatcttgtcatgtatttttctgttcctgtttttcactcattttttttctgttggattgttagcactctgtatgtaagacaaattagccctgcataaaaattccacattttccccaatatgtcccttccttccttcataattgtattaaaatataattcacggccgggcgtggtggctcacacctgtaatcccagcactttgggaggccgaggtgggcggatcacttgaggtcaggagtttgaaaccagcctggccaatatggtgaaaccagggagtcggatgttacagtgagccgagatcatgccactgcactccagcctggtggcagagtgagactccatctcaaaaacaaaacaaaaaacctaagtgaaaaaagacaatcaatagatgccaatatgagccatcacgttccccaacttcaaactatactacagggctacagtaaccaaaagaacctggtactattggcacaaaaacagacacatagaccaatggaacagaggagagagcacaaaaataaggctgcacacatacaaccatctgatctttgacaaacctgacaaaaacaatcagtggggaaaggacaccgtgttcaataaatggtgctgagataactggctagccatatgccgatgactgaaactggaccccttccttacactatatataaaaatcaactcaagatggattaaaggcttaaatgtaaaacccaaaactataaaaatcctggaagacaacctaggccataccattctggacataggaatgggcaaagatttcacgacaaagatgccaaaaggaatcacaacaaaagcaaatattgacaaatgggatttaattaaactaaagagcttttgcacagtataagaaactatcaacagagtaaacaacctacagaatgggagaaaattcttgcaagcaatgcatctgacaaaggtctaatatccagcatctataaagaacttaattttacaagaaaaccacattaaaaagtgggcaaaggacattaacacttttcaaaagaagacatacacgcggccaacaagcatatgagaaaaaagcttaatatcactgatgattagagaaatccaaatccaaatcacagcgagataccatctcacaccagtcagaatggctattattaaaaagtgaaaaaacaataaaagttgctggcaagattgcacaggaaaaggaatgcttatacactgttggtgggggtgtaaattagttcaaccactgtagaaaacagtgtggcgattcctcaaagacttaaaaacagaactaccattcaacccagcaatcccattattgggtatgtacccaaaggaatataaatcatctgtcataaagacacatgcacacgtatgttcactgcagcactgttcacaatagcaaagacattgaatcaacctaaaggcccatcaatggtagactggataaagaaaatgtagtacatatacaccatggaatactatgcagccataaaaaagaatgagaccatgtcctttgcaggaatatgaatggagctggaatatgaatatccttatcaaacaaacacagaaacagaaaaccaaataccgcatgttcccacttataagagggagccgaacgatgagaacacatggacacataagaggggaacaacacacactgggaccagttgggaggtggaggttgggaggaaggagaggatcaggaaaagtaactaatgggtatgagtcttaatacctgggtgatgaaataatctgtacaacaaactcccatgacacaagtttacctatgtaacaaatatgcgtatgtattcttgaacctaaaataaaagttaaaaaaaagaaaacaaaaatcaacaaacacttgaaaactaaaccacatacttctacatgatctatgcatcaaaaaggaagtttcaaaggacatttaaaaatcagttgaactgaatgaaaataaaaataaaatcaaaatttgtgggacgcagctaaagcagcactgaaagggaaacttataacactaaatgcatatattagaggaggcaaaaacctcaaatcaataagctaacctcccacctcaagaacctagaaaaagaagagtaaaataaaccaaaaccaagaagatggaaggagataataaggttaaaagcagaatagaatgaaatggaaaatatcatagaaaaaaatcaataaaataaagagctgattctctgaaaagatcaataaacttcacaaacaactagcaagactgaaaaaaaagatgcaaattgtcaatatcaacaatgaaacaaaataaccattacaggtcctgcagacatcaaagggattgtaaaggaacactacaaactctacacacataaatgatgtgtgtagatgggtatatagccatggaaatggatgaattccttgaaaactgcaaatgaccacaacctcacccaatataaaataggtaatttgaatagccttataactattaaggaaatgtaattcataagttaaaagctgtccgaaatcttcaggcccagatggttttcctggatagttataccaaatatttgaagaggaattaagagcaattccgtacactctctttcagaaaatagaagaggaaggaacactcaatgaacacataaaactaattttatgaagctagtattattatcttgatgtcaaagccagataaaaccagtacaaaaaagaaaactataggctaatacgcttcataaatatagacacagaaatctttaacaaaacattagaatatataattcagcaatgtatataaagaattatataccatgaccacgtgggttttattccagggatgcaagtctttcttaatattaaaatctcaatcaatgtaatctgccacatgaacatagtaaagaagaaaaatcatatcatatcactaaatgtacaaaaagcatttcacaaaattcaatatccactcatgataaaaactttcaggaaatagggaaagaaaaaaaatcctcaacctgatgaggagtatctacaaaaaaacccacagttgatattatacgtaatgataaaagactgaatgctttccacctaagctcaggaacaaggtgaagatgtcttttgtcaccactcatggttatctactaaggaaattccaaggaatctacaaattcttataagtaataagtgagttcaggaagatcacaaaatacaagctaaaatacaaaaatcaatcatatttgtaagcactagctatgaacatgtgagcactaattaaaaatgcaatacaatcagtcaaggaaatgaaatctaataaaacatgtacattatttaaatgatgaaaagtacacaatgttaatgaaagacatcaaaagatctaaattaatgaagagacaaactgtactcatggagtggaagtttcaacacagtaaagatataaattcttttcaaactgatatatatgtttaatgcaattcccatcaaaatctcaggaaaattctttatagatgtagacaagattattctaaaatgtatatggaaaggcaaaggaactaaaatagctaaaaacaatgttcaaaaagaaagtggaaggaaacagtcaacctgattttaagacttattatagctgcagtataataagtctataataataatatataataattattatatatataataataatatatattataatattatatatataataatatataatattattatatataataatatatataataatattatatatataataatatataatatataataataagactatatgttactggtagtgggacaaatacatagatacatgaataaaacagagaacccagaagtagatcctcacaaatatgtccacctgattttttgacatacttgaaaaaacagttcaatggaggacagataatctttcaacaaatgatgctgaagcaatgggacagccatagggaaaaaaatgaaccttgacctaagtctcacacattatacaaagattaaaccaaaatggattacacacttaactgtaaaatgtaaaactataaaactttttattttatttttttttattttttttattttattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttttgtatttttagtagagacggggtttcaccgttttagccgggatggtctcgatctcctgacctcgtgatccgcccgcctcggcctcccaaagtgctgggattacaggcgtgagccaccgcgcccggcctatttttatttttttgatatagggtttcactctgtcacccaggctggggtgcagtggcacgatctcagctcactgcaacctccgccttctgggttcaagcgattctcctgcctcaacctcccaagtagcttggactacaggtgcgtgccaccacacctggctaattttttgtatttttagtagagacgaggtttcaccatgttaggatggtcttgatctcctgacctcgtgatttgactgccttggccttccagagtgctgggattacaggcgtgagtgaccacgcccagccttaaaacttttttttttaaataggagaagatcttctagatctaggggtaagcaaagaattcttatttatttatttatttgagacagagtttcactcttgtttcctaggctggaatgcaatggtgcgatcttggctcactgcaacctccgcctcctgggttcaagcgattctcctgcctcagcctcccaagtagctgggaatacaagcactcaccaccacgcctggctaatttttgtatttttagtagagaccaggtttcactatattggccaaaacttaagtcataaaaaaaggagaaactggtaagtcagacttcatcaaaattaacaaatttctttctttcttttttttttttgcttttggatacagggtctcactctgtcatccaggctgaatacagtggcaggatcatggctcactgcagccctgacctcccaggttcaagtgatcctcccactttagcctcctgagtagcctgggactactgatgcgcaccaccacacccagctgattttttttttttgttttggtagataatggagtctcactacgttgcccaggctggtcacaaactcctggatgcaaacaatcctcctgcctcaacctcccagggtgctggaattacaagtgtgaactaccatgcccagccaacttttactcttaaaatatcctgttaagagaatgcaaagacaaactacagagtggaagaaattatttgcaaagcacatatctgacaagggctagtatctagaatatacaaaaaaaaacctcataaaactcaacagtaaccttacttggtaagaagcatatcaaacttttcttcagaaagtatgcaaacaagaaaagaatattctaaaatatttaaagtgttgaaagaaaaacctaccagcctaaaattctgtatctagcaaaattatcattcaaaagtgaaggagaaataggccgggcaaggtggctcacgcctgtaatcccaacactttgggaggccgaggcaggtggatcacctgaggtcaggagtttgagaccagcctggtcaatatggtgaaaccctgtctgtactaaaaatataaaaattagccaggcgtgatggtgtgccggtactcccagctactcgggaggttgagacagaagaatcccttgaagtggggagacggaggttgcagtgagccgagatctcaccactgcactccagcctgggtggcagagtgagaccctgtctcaaaaaaaaaaaaaaaaaaaaaaaaaaagccagctcagtagctcacacctgtaataccatgtaatcccagcactttgggaggccgaggcaggcggatcacgaggtcaggagatggagaccatcctggctaacatggtgaaaccccgtctctacttaaaaaaagaatacaaaaaattacccgggcgtcgtggcgggcgcctgtagtcccaggtactcaggaggctgaggcaggagaatggcatgaacctgggaggcggagcttgcaagtgagccgagatcgcgccactgcactccagcctgggcgacagagtgagactccgtctcaaaaaaaaaaaaaaaaaaaaaaaaaaaaaagtgaaggagaaatgaaaactttctatgcattaaaaaatggagtatacttgccttgcaagagatgttaaaagaagttcttcagagagaaggaaaattatataggtcagaaactcatatctaaataaagaaagagtgctacagaaggaataaatgaagccaaaataaaacaaacaatccaattagaacatgagcaaaagatatgcagagaatttcactgaaggagttatgcagaaggctactaagcacgtgcaaagatattcaacatcattacctattggggaaacgtatattaaaaccacaatgagatattattacacaactatcagaatggctgagataaaaaacagtgacaacaccaaatgtggggatgtggataaactaggaaatcatacgttgctggtgggaatgtaaaatgggatattcactctggaaaacagtttgtcagtatcctaaaacaataaacatggaattaccatgaaacccagcaatttcacacctggacatttaccttagggaaatgatgagttgtatttacaccaaaacctataatgaatgttgatatgagctactatttgtaatagcaaaatgtgagaaaaagaaaaaaaacccagatgtcgtttaatgggtgatgatggttaaacaaattggtatatccacaccatggaattctgctcagcgataaacagcaagagctattgatatatgcagtgaataaatatccacagaattatgcttagtgaaaaaaaaagccaatttgcaaggttacattccatttgattcccttaatatagaattttcaaaatgacaacattatagacacccagatcatgcaaatggactgattcccttaggagaacgaagaccgtatctacctagagactggaagaagacccttctgggcctgacaagagcagataacaattctggcaacaattgaccctggggtttcagcaggtccacaggtggaagttgagagtgggatttaatctggttgagttcatcttctggtaggaaaccacacagaacccaggagcaccaccaagatggcagggggagctgtgtggctcagagacactagggccccatcctcttcctgttcctcattgactggctggaaaggtggacactaaaaattcatgactcgtttgtacttagttgaagtatggaaggagataacatattatttagactctctccctccttctccttccttccttccttccttccttccttccttccttccttccttccttccttcctctctctctctctttcttctttctttctttctgatagtcttgctcttctcatccaggctggagtgcaatggcgcaatctcagctcactgcaaccccctgccttccgggttcaagcgattctcctgcttcagcctccttagtagccgggattacaggtgcacaccaccatgcccggctaatttttgtatttttagtagagacagggtttcatcatgttgacaaagctggtctcgaactcttgacctcaggtaatctgcccgcctcggcctcccaaagtgctgggaatacaggtgtgagccaccgcacccgactacacatattattttctaaaaatgtcactaatcctgtgaaagactcatttgaaatgcttgccctaaaacacattaataacttttttgatgtgatgagagatctaagtacttgtgttgtgttcattttgagaaccatcaaatatttctaagatgaaatttctttgaattttcacacttcagaggagggtcaagtgtctcctaactactgtatcatttgttccccaagctgcattttttttttttttgagatggagtcttgctctgtcgcccaggctggagtgcagtggcacaatctcggcttactgcaagctccgcctcctgggttcacaccattctcctgcctcagcctcccaagtagctgggacgacaggcgcccgccactgcgcccggctaattttttgtatttttagtagaggcggagttttaccatgttagccaggatggtctcgaactcctgtcgtgatctgcccgcctcggcctcccaaagtgctgggattacaggtgtgagccactgcgcccgatgagaaagattaaagatctttttcatggcttcttggtggctggcctgcaactttcctggcaatgactgcccctattgaacatacgacatttcagatccttacctttatgtgttatgattagagaatgaagggtgagctcactggtccttatcttttccactgcctttaaggccctgacatacttaaccccctccttttcagtagacaatattttctcccacttctttcagaaatatgaactgctttatcttctctcatcctcaaaacgtgtcaaggtattcatatctatcactctctacattcccctctttcttagcacagggttctgttaggacatttgattttaagtcacataaacccaactccaactagcttaaacaaaaatgtgactttactataaagtttccagggtatcttgggaaactttgtatgtggttggatcctgggcatatagctggagctagggactccttaccacctctttctatacagccttctttgggacagcatcattattctctctactgttaactagttctgcttgcccagccatctggtggcataggccaccaatagtgcccaggtttatatctccatttcgtcagtcaaccatgtggaactggaagagctcgattctgatttgaaattcccacaaatgcattctgattagccagcttagatcacgactcactcctggaccaatgaacgttagccacagagtcaggtcacagtgtataccatggttgttcttatggtagccatctgaacggagttgggggttgggggaaggtgggaggtgggctgtcctcattgaataagaagaagcagaaggtcttggaaaaggaagagatgccaggagagacagaacaatacttggctactccatgccatcccttctcttcaggcaaaatgaaagatcttgaactttcaattctatctcttctcatcttcttcaggatttagtttaattaattacccttttatattttttgtttttttttaacactagattatactgcaataagttacgcttttttctttttacattttgaatatttctactcaagctccttttctttaggcttacatttgctcaagaatctcttataccaaaggagcatcccataacctgtcttcaagctccggcccaatctatgtacctttttttttctgccatgtaaatgtcatctgccccatatcacactttgccccaacctggccttctccctcttcatttccttcttcaatgccacctccattttcccagagtgttttttggtttctgaaaggctgaacacaggcagagtgagggaaggatgaagtctacaggccattgtgatgcagcccttccagcaggtgtgacaggtagtctctgatgtgccactgcccactccctcagagcccggccccaagaggccccttagattgtagagcataacactgaccagtctctgacctttctagcttcctggttccaaagagtctgtggccacagtatcacctgcaccacacccacacagctgataatcagcttatttaccaaagtttccctgggaacaaggaccttctcatgaagagagagggtgggtgccctcttggagaggttgtttgctatttgctccctcacaggggtaacctcccattgccagtcctgtgccctctggaatgaagaggaaaggtaacaaccacaggctgggccagaactgctttatttttttgagacagagtcttgctctctcacccaggctggagtgcagtggtgcgatctcagctcgctgcaacctctgcctcccaggttcaagcaattctcctgcttcagcctccccagtagctggaactacaggcacgtgccaccaagcctggctaatttttgtatttttagtagagaggggctttcatcatgttggccaggctggtcttgaactcctgacgtcaagtgatccacccacctcagcctcccaaagtatttagattacaggtgtaagccaccatgcccggccagaactgctttcttaagggtacccataggtaaaggccaagccctcgccctcactcgccaacttgtgttctcgcagctctcggctatgttggtgcttgtggggacaatcacgtgaagccctttgcttctttggtttaaaaaaaaaaaaatctcttgtttttttgagatgcagttttgctcttgttgcccaggctagagtacaatggtgtgatctcggctcaccacaacctctgcctcccgggttcaagcgattctcctgcctcagcctcctgagtagctgagattacagacttgtgccaccacacccagctaatttttgtatttttaatagacggggtttctccctgttggtcaggctggtctcaaactcccaacctcaggtgatctgcccgcctcggcctcccaaagtgctgggattacaggtgtgagctaccatgcccggccaaaataaaactcttttattatgaaaattttaaaacaggtacagagtagagagactagtttaatgtgtttaccacccacttttcacaattatccatttgaggccaatgttgctctgtctatacccccatagtgacactctcctcctttatttcaaagcaaatcctagatcatatactttatgggtaaatatttcagtatgtatctctaaacaacaactttccttttttgtttctctccttttttgtttctttttggctttgctcaagtttattattgaggtatgatttacatgctgtaagttgccctttttaggttaattttgaggttttataaactcattcagccataaaaccatcacaatcaggatatagaacagttctgtcacctccccaaattcccctatatccctttgagtgaattcccccccaacccccatgcaactacacaactgttttctagtcctatagttttctatttttcagaatgtcataaaaatagaacatcctacagtctgtagtcctttgaaatgtcacttttaaaaacataaccattatactgtgatcacttcacccccaatcaataattctctaatatcagatatcacatttccacaactgtcctaagaagtatttttttacaaactgatttaagacctacatctacacattgcaattggttgttttgtctctcaagtctcttttaatctataggtttcctctccatcttttgttttgttttgtttaagaaattgggctgtcacagtttctcataatctggatttttatcaactgcatctgcatgttgtcatttcttctgttctctatagtcttgctattaaaatatggtccatggaccagcagcatctgcatcacctgagagtttgttagaaatgcataatcttggaccccactcaagacctattgaatcagaatctgcatttttaacattcaacaagatctatggctgggcatggtggctcatgcctggaatcccagcactttgggaggccgaggcgggttcacctgaggtcaggagtttgagaccagcctggcccacatggggaaaccccatctctactaaaaacacaaaaattagctgagtgtggtgcatgcctgtaatcccagctactcaggaggctgaggcaggagaatcctttgaacctggggggcagaggttgcagtgagccaagattgtgccattgcactccagcctgggtgacagaacaagactctgtctcaaaaaaaaaaaaagatctccacctgattctgtccctgtaaaatggcactgagacctagtgtgttgatctggtttaggttggttggtttgtgggttttttttggcaagcctatatgggtggcattgcaccccttatttctcagcccttcccacctggtcctctctaggtctctctgactgctcctgctccttgtcagccaggacctgtgtctcctcataactcaggcttctgtaaatgtaagtgtgtccaaggagatacattccacatactacccccagacctccattctctttgtctagtatggctttcaggtatctcgtctaacctcctgatttacaaatctcctctctaatcctgacctgtccatggtctcctaacttgccttttcagttgccaagagaatatctcttcccagatattcttgctgctaatactaattctcactagcctgcacctttaactcaacaagtcaaaacataaatcactgctttcccttctattttcccttttggattagtaaattattttctgatcactcagcctagactatttgaagctgtcttctattttttccgctctttcatgtctgatctctaatcagtagtttagttttattaatcctcctgtatttgtcagccctcattacattatgctggggtaagagaaaatccctccaaatctcagtggtttgcagcacaaagttgtttttttttttgttttttttttttgagacggagtctcactctgtcgcccaggctggagggcagtggtgggatttcggctcactgcaagctctgcctcctgggttcacacaattctcctgcctcagcctcccgagtagctgggactaaaggcacccaccaccatgcccggctaattttttgtatttttagtagagacggggtttcactgtgttagccaggatgggctcaatctcctgaccttgtgatccacccgcctcagcctcccaaagtgctgggattacaggcatgagccaccacgcccagccaacaatgcaaagttttattttttgttaaagttatatgttggctgtaggttgactgaaggtctggtctttttcattccaggatctaggctgaagagcagccccaatttgggatacagcagagggaataaaaaggaatggtaaaactaggaatagctttcaaagttcagtcatggtgtaaatcagttccatggctgatctggtttgggtgtctccccacccaaatctcatcttgaattcccatgtgttgtgggagggacctggtgggaggtaattgaatcattggggcaggtcttttccatgctgctcttgtgatagtaagtctcacgagatctgatggttattataagttggagttttcctgcacaagctccctttttgcctgctgccatccatgtaagatgtgacttgctgctccttgccttctgccatgattgtgaggcctcaccagccatgtggaactgtgggtccaataaacctttttcttctgtaaattgcccagtctcagatatgtctttatcagcagtgtgaaaatggacgaatacaatgatcatagcaaatgacaaagccaagtctcatattcattgactgagaaagtatgttcaaatatctggaatcaatagtataatctatcacaattgccattttgtatttcaattgcatcccttatttcaattctctttacccctgccttaaacttcacttctctcagcttcctcaaggaagccttctctgatgccctcagactaggccacatctactgctattggctgttgtggaatttatacttctccttcatgacacacgtgagacaactgcaattatttatgcacttatttaatttctgacagcccctagactgaaagctctgtgagggcagagacagtgtctgttttgctcattatttaacccttggcagctagaaaagtatctggcatagagcagcatgtaaaggaatgaatgattgccttagtcatgcccatatcatccttcacctggtttactgaaaggccttaccagtagttttggaaatctaatttatttttctgccatcaggattttctttcttaaagacttactcttggctgggcgtggtggctcacacatgtaatctcagaactttgggaggctgaggtgggcagatcatttgagatcgggagttgcagaccagcctagccaacatggtgaaacctcatctctactaaaagtacaaaaattagctgggtgtggtggtatgtacctgtaatcccagctacctacttgggaggctaagggggaggatcgcttgaaccctccagcctgggtgacagtgagaatccatctcaaaaacaaaacaaaacaaaacaaaaagacttactctttatatcatctattggttttctaggtcaggttgtgctgaagtttcctgaatgtgtatgctttctcagacctctatccttttgcatgggctgttccttctgtaggattccctccctccccccagtgctctgcctggtaaaatcctgttcatcttttaacttcagttccgaggctacctcctctgcaaaacgtcccatgactctcagtgcagacttgggcccctgcccttctgcttccacatatgcacctccattttagcaattatcatgtttcattctaaacccaacattgtggttttctagcgcagattagaaaaaggagagtgttgtgggaagtgagggaccccgaatagagggactggctggagccacggcagaggaaacataaattgtgaagattttatggacatttatcacttccctaataatactcttataattttttatgcttgtcttactttaatctcttaatcctgttatcttcataagctgaggatgtacgtcatctcaggaccctgtgatgattgcgttaactgtacaatttgattataaaatgtgtgtttgaacaatatgaaatcagtgcaccttgaaaatgaacagaataacagtgattttagggaacaagggaagacaaccataaggtctgactgcctgtggggttgggcaaaaagccatatttttcttcttccagagagcctataaacagacatgcaagtaggagagatagcagtaaattctttttctagcaaggaatattaagaccctaggaaaagaattgcattcctttggggaggcctataaacggccgctctgggagtgtctgtcttatgtggttgagataaggactgaaatacgccctgatctcctgcagtaccctcaggcttattagggtggggaaaaaactgctccctggtaaatttgaggtcagactggttctctgctctggagccctgttttctgttgtttaagatgtttatcaagacaatacgtgcacagctgaacagagacctttatcaggagtttttgattttgccctttgccttgtgatctttattggcctcagaagcatgtgatctttgttctcctttttgtgctttgaaacatgtggtctttgtgacctactccctgttcgtacaccccctccccttttgaaatccttaataaaagttgctggttttgcggctcaggtgggcatcacggacctactgatatgtgatgtcacccccggtggcccagctgtaaaattcctctctttgtagtctttctctttatttctcagaccagccgacacttagggaaaatagaaagaacctatgttgaaatattgggggtgggttcccctgataggatagaggttaacattgtggttttccagtgcaggttagaaaaaggagagagggaacagcagagtggtgcagtggaagcatacctatgggcccataacccagaggttgatggatggaaaccatcctctgctagctttgtgatcttggctgggtgtggctgctcacacctgtaatcccagcactttgggatgccaaggtgggaggctcacttgagactagcctgggcaacatagcaagacaccgtctccataaaaaggaaaacaaaaacaaacaaacacacacacacacaagagaggcatttctaaatagaggcctgctgacaacagcagaatttaccactgatggcctgtcagtaaaggagcggtgcctgtcccagctaacacaagcaccttctgcagtggctgcagcagtgtttccctagtgaggacctacttcctacaactctcatctacaagtctgagcctgaaaacgacctcagattttagcaaaacaagcacagtcttgctggcttcttctgttttcctctgagttgaaggggtccagggcagactcagagcccctggtttcctcatcatgagcctgagcatgagtcagaatcacctgagggcttatgaagccaaaggttgctgggctctatccagagtttctgatccaatagttctagggtggggactggaactcacattcgtaaaagattcccaggggatgctgctgctgctgggctggccttaaccactggcttaacaatgggccacaagcaggaccacagtgaaaaactctagtcaaacaggaagatacagaaaacttcatccttgatcaggcacttcttgcttcatttacacaggtgcctgcattttttacccaagggaagactttgtgacttgataatttccacttgtggaaccagttgaactggatatttactatcagatatttacttataccaaataaacattgttatacactatgtaaaaatagaaggtgctgtcattctgaattccttgcaagggctgttccttcaaacttgctcccttgtggatctgtatcactgagtcatgtaggccaaaagcatcgtaagccaaatagttggaactcagtagttctgttccttgctgtcactgcatccttccctcaacaaacttagtttagagtagacatcagaattttgtattcaaccactagcagtagtttctaaggcatcatgcaattaatataaatcaattttaaaatttataacctcctgataggccctcttgttaaattaccaatgttgtatttattttaaaaatgttggctggatgcaatggctcactcctataatcctagcactttgggaggctcaagggatcacttgaacctgggagtttgagaccagcctgggcaacatgatgaaaccttgtctctacaaaacatacaacatttagctgggcattgtggtgcacccttgtggtcctagctactcatgaggctgaggtgggagggtcgcttgagtctggggtgggggggtcaaggttgcagtgagctgaaattgcaccattgcacaccaaccagggtaacagagggttaccctgtctcaaaaaaaaaaaaaaaagttaacaatgttaacaatggggagagctatgaaaacaaaattttagagacagtgtgactcaagtacggtttctgtgcagttgtaattagaaggaaccaatgtggctgactgattttgaactacaattgtcactgacaataagagttactgtggaggatgaaaaactcccatcattcccttagcaagacttggaaagaaggatgaattacattcagcaaatttaatatttcactggtgctaaaactcacattgttttgcgttgttaaatctctgaaatcctgatgcattttaccaagaatggcattttatgattatggttggctaggtcatggttgtgatgtggtgtcactgcctgcatatgtacagacttggtggttattcctggtgggatgacttggcaactgtaatctccatgtttctctcaacagattatataaggaccatctggaaaagaaacatgctgcctgttgtctggaaaccttccactgacaccttcaggtaagatcaggagagtcccagcatcaaaatttgtaaaacaggtgtcagtagtttgcaagaaaacagtagtggaatagttttaagaaatgctgcattattagcacatagtaattaaggacacagaggacatttctatatgaatgacacagacatcaatgactataagctgaaaaatgactcagaagaacagagattctgaatgtaaagaaattacaggaattctttaatgaatttatttttgcttataccttccttcttaggtatgcacaagagatgtatgataacaatgtaagtctaagtctgtgcttgttcactaaaaattctaaatgataaaaaagtattacaaatagtttaattggaaatatttcttttttttttttttttttttgagatggagtctcgctctgttgcccaagctggagtgcagcggcgcgatcttggctcactgcaacctctgccccctgggttcaagcgattcttctgcctcagcctcccgcatagctggaggtgcccaccatcatgccctgctaatttttgtattttaatagagacggggttttgccaagttcaccaggctggtcccgaactccagacctcagaagagctgcctgctttggcctcccaaagtgctgggattacaggcatgagccactgcatccggccaggaacatctttttaacagcaactttcaatctttttagtctgaggacccctttacactcttaaaaaatattgagaacaccagagaacttgtggtttatatggtaacatcaatagttaccgcattagaaatttaaacagacttttaataccaaagaatcacaagcacatattccattagctgtcggagagataatgacatcacacatcatgtatcctctgggaagttccaatgtacactggtaagagaatgaaaatgaaaagaaagggaggaaccacactttgagaatctctggcatataaaataatggttttttaaaaataccattatattttgatgaatatggatatatttccaagtaaactgttgttggaagaagtaaaatattgactacagggaaaattctattgctgaacagttggtgtagcattttgagacacagaaattaactgatgtatctttcttctgtggctgtgggaaacatccaccccaaccgcccttcgtttttgagatggaatctcgctctgtcacccaggctggagtgcagtggcgcgatctcggctcactgcaagctccgcttcccgggttcacgcaattctcctgcctcagcctcctgcgtagctgggactacaggcgcccgccacgacgcccgggtaattttttgtattctttttttaagtagagacggggtttcaccatgttagccaggatggtctccatctcctgacctcgtgatccgcctgcctcggcctcccaaagtgctgggattacaggcatgagccaccgcgcccggccctcaaccgcctttcttaggtggccagctcactccgggtatcctgtaggtctgggtaaatcaaccctaggggaaggtaagagtgtatcttctacttgggttctggagggcagtggaattgcccgtaaagcaggaggaagggatagaggttgggacaaagatgaaaggaggagtgtggtttggcccctgggggacaaacctggattttctagagactaggagaggcggcggggcttgcagtttttgtcagtgatggagatctctggggacttgcacatggctgtgtgggtactggtgggcagacaaacacttggtgcagaggacactgaagcaccacccagggtcctgctgggcagtcaggcccagagagagggcagaccctggggagttgctggcctttaggataccctgcgggtccgagcaagacgtcctaatgacagtcaccaatgggctgctgcccagggcctcttctgccgctgtcctgacctagaatcctacaacctttcaaggaaggagaacgggagccaccacatacacacagagggtggctttcctctagggatcctgggaaccagattggctttcatttacaaaccgcagaacagttacagaagcaaaagaaggtagttatgactggatctgaggacatcttgcctgaattgaatttccagctctgtcacttgctaatagaagcccctcacagggtctctgctgggcacactaaatgagtgatacatggaaactcttcagacagcacctggcatgtgtatgttatctatcacctcttgaacctcgatatcttggagatgtcataactgccacactacatcctctgcagtttgggatggctgacgtttgaccctttgcctaagtccccatatcgaaggctagattaagccttaacgctggagccaaggggagggagggcaggaacgtactctaaatagaagtgctcccccggggactgggcggcccaacctgctccagcagccgggaaggtcttcctgccacagtgaccgcagcgagtggcgtccggcctcggagggactgagggcacttctctggtgtaagcactggcgtccaacgccggacgcagcaaaatcgctgcaaactctgggtccagagaggtccaggtcctcccgggtttctttttattttaaatttttttccagggagagttctggcgctccttcaatcgggggaggctgcgagtctgagccaggagatgggcgtgggcaggcgtgggtagcaccatcgaggccctggccacctgccgggtgctgggtagtctggaagagtctggagcccggtctccgcctccaggcgccccaccctggacccctcctccacgcgggtcccgccccacggtgggcgtggcttccagggggaggggccggggagggtctgcgaacgagtaacctcccgcaggcgaggcgaggcggggcggagcgcgggaggccagttgggaggcgcacatccggcggttacccggtgcttcataaagccgctttcgccgctggctgtcgccgcgttttgcctccgcagcagctctgggctcttctcagctgcgcgagcagctgctccaatgccccggagtggccatgggcgccccgcactggtgggaccagctgcaggctggtagctcggaggtggactggtgcgaggacaactacaccatcgtgcctgctatcgccgagttctacaacacggtgcggggcgcgggagcggggaaggcaggcgggccagcgggagggggctgttcccgcgccgcagcgtctggaagctggacgtgggtctctgcgcgcatctgggggcattctctccaggggctgagtcagtccacaccccctcctcggcgcgctcctttcagttctccatctgtcctcctctcctgtccccattcccgacagctgggctcatcttcctcctgctgtcatttgttttgtgatggtcctattgtcttgtttggcccccacgcgtccaggaaccaggggtctgtgtcagcccattctccttgtttgggtcagctgggggcggtgaacctgccgggacaagtctcttcctcccctgggatctctgtggcgtgacgcacttgggtcgcattgtgcttttttgccctgaatacctgctctcggagtgctgggaagagcacgccccccgcaggtccccgcggctggggtcactcccaccaggcagacttgccccacccccaagaacatgcctataatggtcgagttatttttggtcagaatcaagttaattactacttgtttttttttcttgcctttagtgtcctgtcttgtgcaagccgctaattcaactcccccaggactgtgctttctccagttctgaagtctgagggatgaaaggaaagtttgggagtgataatgtgcgggttttggatttgcctaggtccctagataagggtgagcagaaacttccccattgcagaatcctgtgtgattttagttcttgtggtagggaagggttgcagctgggagaggaaatgcctcttattttgtgtatgtccatggctcagaatcctggtacagaatgtgagactttgcgtggtcatttctgtggcttatcttttcaccgcccaaacaagggaaacaggaactcctggtttgggtcattgtgaatttgaggttgttgtttaggacttttccttttggatttgctagagagaatgtcttcagcaggagtcaggtgcttactgcctgcaggaatctcagatgatctagtccctgtccttttattcatctgatgagaaaactgggctcttgaggagggagctgtcatgctcacatttctggcatggctggggccacaatccagaagtctgggcccttccttccctcagtgctgaaatccatggctggcttccacacaaacactcctgctcctttttttatgattaggttggttccttaagaaaacctaaggctgggcgttgtggctcacacctgtattcctagcactttgggaggccaaggcaggtggatcgcttgaatccaggagttcgagaccaacctgggcaacatggcgaaacctcatctctacaaaaaaatacaaaaattagctggacatgtggcacacacttgtcgtcccagctacttgggaagctgaggtgggaggatcacctgagcctgggagttgaaggctgcaatgaactgagatcgcgccactccactccagcctgggcaacagggtctcaaagaaaacctggccctctgctgaccacagatactgtgaaagacagtggaagtggccatgacttatgtattgcataacctcccagagcatgctgtcaggggtaaatagttgcacacagaggatgggctggagtagttctgggtactttcaataaggagaaacaccagtggtaacacaagctgtccttttgtaaataaagaatatagtgaaagagtaaggatttcaccagagttcaagaagaaaagacagcttgatgacaggttctcacacacttagcaagattattctctgtgcagcctggggtctacagagagggtcaaccttggttattttggccaaaaaagctagtgtatggcttctctgagtctgtcttgaaaagtgtcatagggctggatgaaagggagagtttgtctttacttttaatctagtcccattggagccgttactctatgtagtgagtgctaaagtctttttcagaaactaactgttgatcttcagctgcattgtctggctgatgagcccagctggcccatctgacaaactttattccttggaatactcataaaccacaaaatttgctctggcaaagcagagagcgtaaggtgtcagagaataaggtcattgcctaactttgttgagtgtaggtccaaagaatttagcaaaaaacgtttcttcccctctgttgctatttaaaaaaatttttttttgagatgatcatgctctgttccaggcttgagtgctgtggtgcgatcttggctcactgcgacctccacctccaggttcaagcgatcctcccaaagtgctgggattacaggcgtgagtcaccatgcccggccttcttcccctgtgttcttacgtactacttatattttgatgcttatcacaggacattcccatgcttatcttactcctgtgttgagaaagacagtagactgttatgtggtgataaatatcgtcttaaatcctcataataaggcaacaggtctaattacccagtttataggaaactcataatcattaccagttttgagaaaaagttggaggaattgacaatgttaaatcaggagaagaccgggagagggatctagaaccttcttaatgggtcttaggggtagcacatcactactacaccttcagatactactgtctaccattacttaattgctatgtgttgaagctctgctgggtactgtatactcattctagacaatgggtgctatttattatatccatttgataaagatggaaattggggcctagagagtttatgtaacttgctgtggtcaagagcatagcacagctgaagtcagaacttggtccatttgactctaccaagagagttatcttgaagctataagtgccactgtaactaacttagatttatctatttggcatagaatagatatttattatttagtcattccataacttaaaactcctgtcttgggatcattttatctctaggataaaactcatactttttgataggaaaaaagtttatttaaagtagtttgtaaaattactgtttattgtaaaagtaatatgatcatggtaaaaaatttagagtatgtaagttgtagagtgaaaaataaccttctgtatctttctagatattttctaggcatataaaaagcacatgtatctgtgtgcatataaaatacgcatgtataaggctgggggcagtggctcatgcctgtaatctcagcactttgggaggctgaggcaggcagatcatttgaggtcaggagtttgagaccaacctggccaacatggtgaaacctcatctctactaaaaatacaaaaatttagctggttgtggtggtgcgtgcctgtaagtccccgctactcaggaggctgaggcagaagaatagcttgaacctgggaggtgaaggttgcagtaagctgagatcgcgccactgcacactctagcctgggcaacagagcaagattctgtctcaaaaaaaaaaaaaaaaaaaccagcatgtatggcgtaatcacgaatacttgaagtttttttccaagatggtactgtgtaaactcttatgtaccttgtgtttttcacttaatatgtcttggagatatttccatatcagctcatatagtgctctcttcctgtttataatgtttatacagtactccctttaatggattgatcataatttatttatctaatcaatccttattgatggacatttcatatagtttctctctgttttattgttttcattttggtttttgaacagtgattcagtgaatatcctcattcatgcatctggatgtactttcgcaagcactaatcttagatggggattgctgtgtcaaggaggatattcagtttaaatgctgataattattgtgaaatggcacactaaagagagtgcactgatttgacttccactgacaatgtttgggcatacaaaacattttgctttggcctctgcaaatttctgttgcctcaaattgtatcatcctttgcttcagccaagcctaatatctcttccatgaacatgtaatttcctttcacagccttttacttgtgcacattttatactgtttcttctatatacaaattttattaattgagttcctttttatgttttaagatttaagaccccctggctgggcgcggtggctcacgcctgtaatcccagcactttgggaggctgaagtgggaggatcacttgaggtcaggagtttgagaccagcctggccaacacggcgaaaccccatctttaccaaaaatacaaaaaactagccaagtgtggtggtgtgtgcctgtagtcccagctactagggaggctgaggcaggagaattgcttgaacctgggaggtggaggttgcagtgagccaagatgaggccactgcattccagcctgggtgacagagcaagattccatcttaaggaaaaaaaaaaaaaaaagaaaatatttaaggccccagtcacatagacctagccactttggagaaaagccgggtctgccttttacctgagcttggcctttggggactctgttgctcagcagggacttgaggacagaagaaagtcaactgatcgctgaaaagaatcttgaagcaaaatacatgcataaaatcagctcatgatctgtcacttcctgctctgtccccagtcatcaagataaatagagctctcgttatatgccaagtcctaagtcccgctctcttcaggctgaatctatcggtcgatccatcaatctgagcatttgctgggcaacaactgtgtgcttattccagagaccagctctgtaaatagtcatatgggtggtgagggctatgatagaggtgtgtacaagccgctgagggtgtttttagtactgtgcatgggattgatgtactgtgaggatagggtggtggttttgcaagaaggcttctgaatagagtgaccaaacttgtcctgggtttttgcctgagacttttctgattttaaaactgaacgtcccatgccttgggaagccccctcagtcccaagcaaaccacgacagttggtcatcccaggggcagaagtaaaacaatggaatgggtagttaggaatcagcacacaattaagatggacagacaatccactcagccagggtaaaagtcctcagctgtttatgaacctgctgtccagaatatgtacagcctgttgttttgtctttatttaccctctgtctggaaagtgcacattcagatgcatcaggatgagactgcagtatgttcatgagattattttgtagcaaatgttatgtggaaattcatagaatgaagaactttctaaggaaataatacattttaaaaattgtgggctaggcgcagtggctcacacctctaatcctagtactttaggaggctgaggctggcagatcacttgagcccaggctgaggctggcagatcacttgagaccagcctgagccacatggcaaaaccctaccctgtctctacaaaaaatgtgaaaattagctggacatgatggcacatgcctgtggtcccagttactcaggaggctgagatcaaggctgcagtgagctgtgagcatgctataatctaacaataggctttaaaatgtactccttgagaggcggagcatgcagtgagccaagatcgcgccactgcactccaacctggctgacagagcgagactccgcctcaaaaaaaaaaaaaaaaattgtagcccttgagtgcactattctacaatttcagcgaccaatacaattttgagggatacatctcagtagagatggatccatgagtccatttttaaaccatgactgatttgcttttttgtatttcttttggtgttccttcatctttttctcttggggaaagtctcccactaatttgttcttttcctttccatatgttgacgtctttaaaaggtacagtgggggccagccagccttggtagatgggctaggcagaagaataatgtaatttcagtattatttgaagcatatggcaaaatagtgcttctaaatggtgcttctaatatgcacatttaaagaaactgtttgggccaggtgtggtggcttatgcctgtaatcccagcactttgggaggctgaggtgggctgatcacttgaggtcaggagttcaagaccagcctggccaacatggtgaaacctcgtctctactgaaaatacaaaaaattagatgggcatgatggcacttacctgtagtcccagctacttgaggagaggctgaatcaggagaatcgcttgaacctgggaggcggaggttgcagttagccaagatttcgccactgtactctagcctgggtgacagagtgagactccatctcaataaataaataaataaataaataaacaaataaataaataaaaattaaaaattaaaaaaaagttttacatatcataattttgctgtaggtgtgataaatgacttcatgcctttgcaaataatatataaatacatttaaaagtgattagtgtgtccattgctggtggaaatataacccaagaaagccattgcgggacagcttgggagtagatagttgcacttagcagaagcaaggtagattgagaggacttgaggcactaaagatcttctggggtagaaatcgcaatgcattatatttctcaacattataagtgggactgtaaattggtgctccttccactggaaaatggctaaactgctcccatctgcctcacttacagcaagtgagctaaatctttattatctaggatgaaaaggtttgcagtgcatattgttgaaggagaaaaggaagctgcacgatgggaatgttaacaatatgtgacatatacgtacctattcatgtaaatgtgaagaaaatgaggacagtggttatctctggggaagaggctagaaaggaaactttattccttttttttttttttacaagaacacattcatgtatatgaagggagaaagatcaggttttaagttacctatggtataacaattccatttttcttctcctctttcttcactcccttgatccgccttcatctgctccttctccccattcatctccttttcttccttttattgctagtttaacaagaggaaagccatgtttacatcaaagccaagaaactggtcatatgtgcacagtgtgtgatgcacagtgggtgatgtgattcacaatttttagatgctagtggaggagttaagccaaggaggtcagaatgtggttgaatgagttggggttgaaaatcagctgggagcagtggaaggagccgggctctgtgcagattggctctctgacttgagccagccctggagcctttcagggccctcagctatatccctttgtaaaacaagggatggtttttatttatttttattttttattttattatattttatttttttgagactcttgtcgcccaggctggagtgcaatggtgtgatctcggcttactgcaacctccgcctcccgggtccaagtgattctcctgccttagcctcccgagtaggtgggattacaggcgcccgccaccatgcccagctaattttttttttttgtacttttagtagagacagggttttgccatgttggccaggctggtctcaaactcctgacttcaggtgatccacctgcctcagcctcccaaaatgctgggattacaggcgtgagccacccgtgccccgcctaagggatggtttttaagatccttcttaaaataatccttttttaaaagaccctcttaagggtctttgattcttaaatgattccactgaaagttaagtcaaattatctctgtttgcagatgacatgattgtatgtttagaaaatcccatcctctcagcccaaaaactccttaagctgataagcatctccagcaaagtctcaggatacaaaatcattgtgtaaaaatcacaagcattcctatacaccaataatagacagagaggcaaatcacaagtgaactcccattcacaattgctacaaagagaataaaatacctaggaatacaacttacaaaggatatgaaggacctcttcaaggagaactacaaaccactgctcaaggaaataatagaggacacaaacaaatggaagaatattccatgctcatggaaaggaagaatcaaaatcatgaaaatggccatactgcccaaggtaatttatagattcagtgctatccccatcaagctaccattaactttttttcacagaattagaaacaactactttaaatttcatatggaaacaaaaagcccacattgccaaggcattcctaagccaaaagaacaaagctggaggcatcacgctacctgacttcatactacaaggctatggtaaccaaaacagcatggtacttgtaccaaaatagatatatagaccaatggaacagaacagaggcctcagaaataatgtcacacatctacaaccatctgatctttgacaaacctgacaaaaacaagcaatggggaaaggattccctattaataaatggtgttaggaaaactagctagccataatcagaaaactgaaacttccttacaccttatacaaaaattaactcaagatgaattaaagacttaaacataagacctaaaaccatgaaaaccctagaaggaaacctaggctataccattcaggacatatgcatgggcaaagacttcatgactaaaacaccaagagcaatgggaacaaaagccaaaattgacaaatgagctctaattaaactaaagagcttctgcacagcaaaagaaactatcatcaggttgaacagttaacctacagaataggagaaaatttttgctatctatccatctgacaaagggctaaatctacaaggaacttaaacaaatttacaagaaaaaaaacaaccccatcaaaaagtgggcaaaggatatgaacagacacttctcaaaagaagacatttatgtggcctacaaacatatgaaaaaagctcatcatcactggtcattagagaaatgcaaatcaaaaccacaatgagataccatctcatgccagttagaatggcgatcattaaaaagtcaggaaacaacagatgctagagaggatgtggagaaataggaacacttttacactgttggtgggagtgtaaattagttcaaccattgtggaagacagtgtggcgattcctcaacaatctggaactagaaataccatttgacccagcaatgccattactaggtatatacccaaaggattataaatcattctactataaagacacatgcacaagtatgtttattgcagcactgttcacaatagcaaagacttggaaccaacccaaatgcccatcagtgatagactggataaagaaaatgtggcacatacacaccatggaatagtatgcagccacaaaaaaggatgagttcatgtcctttgcagggacatggatgaagctggaaaccattattctcagcaaactaacacaggaacagaaaaccaaacactgtatgttctcactcataagtgggagtggaacgagaacacatggacacagggagggaaacatcacacaccggggccttttgaggggtagagggctaggggagggatagcattaggagaaatacctaatgtagatgatgggttgatgggtgcagtaaaccaccatggcacgtgtatagctatgtaacaaacctgcacgttctgcacatatatcccagaacttaaagtgtaattaaaaaaagaagaaagaaagttaagggctttgatcataacaatgaataaaagcctactgctggccgggtgcggtggcctgtgcctgtaatcccagcactttgggaggccgaggagggtggatcacctgaggtcagcagttccagaccagcctgaccaacatggtgaaaccccatctctactataaaaatagaaaaaaattagctgggcatggtggctcatgcctgtaatcccagctacttggaaggctgaggcaggagaattgcttgaacccaggaggcggaggttgcagtgagccgagatcgcaccattgtacttcagcctgggcaacaagagcaaaactccatctcaaaaacaaaacaaaacaaaacctactgcatatacagtatagtacttagatccttgtcctgattcctccatgcctgcttcttggtaaatgaaaattgaccacatttcttttctttttctttttttcttttcattgatctaagaaaaattggccacatttctcagactggtgactgtataccacctgggacgtctcagacaacttgtccatattcttacccaaggtcactagtcgcacatagcactcctatgtgggaaggagagaaagatccgcaacaaagtgaaccaactaaaggctgagcatgggagctcacacctgtaatcctggcactgttaaagattgaggcaggcggatcacttgaggtcaggagttgaagaccagcctggccaacgtgatgaaactctgtctctactaaaaatacaaaaattagccaggagtggcaggcgcctgtaatcccagctactctggaggctgaggcaggagaattgcttgaagccaggaggcggacattacagtaaggtgagatcgtgccgttgcactccagcctggactagtgacagagtgagactccatctcaaaacaaagcaaaacaaaaacaaagtgaaccaactagaaaaaggtacccctttctccataatgatacagccccacttaggtatttcagacctggattttaaccaaaggtaacagctctgctcccattctgcccctgaccaaggatctttttctcctcctttgacttgcatttctctcccacccatctttctcccgtttctaaaaagtgtcatgcttacccgctctcctccccagatggtggcagaggcaggcattggtccttgaagctgccagtcctcacttgccctatgcctcaagttctggggtttgctgaagcattctatttagttgtgtaccagtgtggtttcttaggtctggtaaagctctttggccctgctcacttcagttctgttcaggtgcccaccatcatggttctttgagacgtcctctaagtgaccattgtgtattgtccaacatgagtaaccgctcttttcttctgaaagccctgtgcccttggctttgcacagttcatcaaccctattcacctatttttgaatgtgatttttgtttgtgtttagtccaggacccctcccaccccatcccgatgggtgttactcatgtagacttagctgtcatcttcacattcgacatacttcttctctgtgctcagtcctgtacaaggagcccctcactccacaattagagatgagacttaaaagctgaatgttcctaccgcttcatatcttctaaaatagcttaatttaaaaacaaaagaatataacaagtgttggcaaggatgtgagaaattggaacactgtacattgctgatgggaatataaaaatgctgctgtgggaaaatgtttggtggttccttaaaaagttaaaaatggaattagtacaccagctagtgccttagtccgttcatgctgctataacaaaagatcttagactgggtaatttataataacagaaattcatttcttacagttctagaggctggaaggtccaagatcaaggtggcagcaggttgggggtctggcaagggctccctgcttcaaagacggagtatatgctacaccctcacatggtgggaagggtgaatacctccctcagacctctgttagaagagcgctaatccaatttaacacctccaaaggcctcacctcttagtacagttgtgtgatggggatacgttctgagaaatgtattgtcaggagattttgtcattctataacattatagaccatacttacacaaatctagatggtatagctttgtacacacccaggccatatggtatggcctattgctcataggctataaacctgtacaacctgttactgtactggacactgtaggcaactgtaacacaacagtaaatatttgtgtatttaagcatatctaaacctggaaaagtatcaggaaaaatgtggcataaaagctccattataatatgggtccactgtcatatgtgtggctcattgttgactgaaatgtcattttgttgcaaataatgatactatcacattgatgattaagttttaacatatgaattttgtgtgtgggggtgacacattcagaccatagtacccagcaacaattaatgtatgaatagacaaaataaatgtagtatatcctttcaatggaatgttatccaaccataaaaaagaataagttactggtatatgctgtaatatggatgaaccttaaaaacattatgctaaatgaaaaaataagctagatacaaaaggacatatattgtatgattccatttatgttatgtgaaatatttagaatagataaaatcataaagacaaaaggcagattggtgaatgccaggggctgagggagggagaaatgaggagtgactgcttaatgagaatagtgtttctttttggggtgatgaaaacattttggaactagatagaggtgatggttgcccattatgaaatgtactaaatgccactgaattgtacactttaaaatggttagttttatggtatgtgaattttacctcaattttttaaagttcagaaaaaaaaagctttgagtctgtgaaacaaacaaaccccaaaatcaaccaaacaaaaagtaagttaaaaaaattagggatgagtttccaatatgacagtcactggccacatttagttggctgttgagcacaggaaatgtgcctagcccaaactgaggcttgttgtgagtgtgaaatttacactgatcttcaaggctttggtatgaacaaaataatgtaaactaggctggacgcggtgactcatgcctataatcccagcattttgggaggctgaggcaggaggattgcttgaggccagcagtgtgagatcagcctgggcaacatagtgagaccaccatctctaccaaaaaaaaaaaaaaattataataataaataaagccaggcatggtggtgcatgcctgtaatcctagctattcaagaggctgaggcaggaggctcccttaagcctggaagtaggaggctgcagcaagctggtcccaccactacactctagcctggttgacagagtaataccctgtctctaagaaaaaaaaaaagtaaactatctcattaatgatatttaatagtgattacatgttcaaatgacaatattttgaatacattgcattaaataagatagattattaaaatttttaaaaagttgaatgcccatggagacataacagagaggcttaaatccataccaaaatctgcaagataaaataatatcattttaaagctgggaagaaactttcaaatataatctttacttaaaaataggttttggttaggatgggaaagctgacaaagggcaacgaagggggaaactagaaagagtcctcgctttgtgtaggcacaggggaaaaggctggcttggctggggaggattattgggagctggacaatgtccagtcttttttacgccttcattaaacttttttttttttttaaccattatttaatacagaccttatctttaaaaacacaaaagcaggcgggcgcagtggctcatgcctataatcccagaactttgggaggcctgagacgagtggatcacctgaggtcaggagtttgagaccagcctggccaacatggtgaaaccccgtctctactaaaaatacaaaaattagctgggtgtggtggtgagcgcctgtaatcccaactactcgggaggctgaggcaggagaatcgcttgaacctgggaggcagaagttgcagtgagctgagactgcaccaaagaactccagcctgggctgtaagaaagaaactctgtctcaaaaaaaaaaaaaaaaaaagtaaatggagccaggcatggtggcatgtacctagtcccagctacttgggaggctgtggtgggaggatcacttcagtccagcctggaaaacatagctagaccatgtctcttaaaaaaggattgtgaaaaaaataagtgcaagtaaattagaatgattcataattaaccttgcaataagaattactggttaattcttatttaattcttagttaataagaataagagaggagcttgggcagcatccatagactgcagtgtttttatagctactcctatgatcaaagaagcagcagggagcctcttaaatggtcatttaaaaagctttaagttctcctgattgtatatctgtagtcaaaagaagtgtcagaggctgggtgtggtggcttatgcctgcaatcccagcacgttgggaggctgaagcaggcagatcacctgaggttgggagttccgagaccagcccggccaacatggtgaaacctcatcttactaaaaatacaaagatgagccaggtatggtggtgggtgcctgtaatcccagctactcaggaggctgaggcaggggaattgcttgaactcgggaggtagaggttgcagtgagccaagatcgtaccactgcatttcagccttccagcctgggtgacagagtgagactccatctcaaagagaaaagaaaaagaaaaagtgcaagagcttaaacgagatgtgtgaccacatttatcccagtttgcaaggacatacttggaagaggccactttattttttgccctttttacttaatactcatctttctgttttacatttttttcctgcagatcagcaatgtcttatttttcattttaccgcccatctgcatgtgcttgtttcgtcagtatgcaacatgcttcaacagtggcatctacttaatctggactcttttggttgtagtgggtaagtggagtcatttgggaacacggacttaatggggtggtgggatgggggtagaaggaattccacacacttcctctcccctttgaacataatgttttgtaaactgaagtcactctgaggtcttagcaaacttttttttcccacttgcttgaatgcaggcttgataacaaagttggcattactgtcacttgcgtgcatttgagacttcatttgtgtagtagctattagggctatgccagtgcaattttctgaacgtctgaagaaagtcaggtgaaacaactgaactctggggaggctggtttctaatggactaaaattaaagaaaaaaatgtagatgtttgatccctcattgttttgtgaaatacttgtgtcatttccatttcctcccacaggcagcctgggaattcttaacagtgaaggaatgttgacttttatttactgcctcttcccagaaaggctcagtggatgaagacagaatgcgtttaactgtggaattgttaaagttctgatgtgctgatatttgggccctagttgaaatcttctttctagactggaggcatgcatgcttgggtggtgtgagtttctttcttcagtttcttttttcagagagagagtgatctggtgactgtgttaaccattggtgaaaggactatccttaagcagtgtattgaatttgtgtctcttctgtggtgacctttttttattggttgtaattgattctaggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggtaagcttgcactaaacattattgcatttaccactaggtgcagtacccaatataacaatgtatatatgaagaaaaatagcacatgattgaactcagcctagtgatgagcttatcatatacttgttcaatatctactgattgtttttatgatctgacaatataagtaaactgacagattaaagagagaattttaataatgcagagtgcatcacctctctgtacccaaagtacatcacctctctgtacccagtggtttaagaattagcaagagtggaaagaccttcagtgggggtgacattactgaatgcttattcaatactctttgattttctgctacaacatttccttgagactaatccaactccaccagttttatacatatgaagtagaatccagactgatgaactggttcttggagctacagatactgtagttttcaagttgcctttttttttgcttcagatgagagctgtgcacctgcgtgcgtgcgcgtgcacacacacacatacacactcatatactgtatatatgttcaaactggaaacccagaatttcaggaagggatgcattttaatagccattgtgttagggttatacaggtattcatccagcaaatatttttgaacacttatattttactgtgcattttgctaggcactggaatatcacagtaaacaaaacagcagtcttcctctaatgagcttacactgaagttggggagattacaaatcaacaaacaagtaaataatataatattaggatatgttaggtactgtgatgaaaagtgaagctgataagggtatagtggtgacttagggtgctgatttagagtttggtcagagaaagtctttctgaggagctgtgtgaggtttgttactatctagaggcacagaggagattcagcccaatgaagatgagaaacgctcctggaacacattacccacattttctgtaggacactgttttgtcaaaatatacatatatggctaaatagtctgaaactatggattcagtgaagcaaacggtatgtgcccatggaagagttataccaggaaaagaaaataattcattacagttttactggcactctgaaaaggaacaggagctgtgaagctgctgaggactaaggctgctgctatctgtggactcaaatggagaagcgtctatgaaaaatgctggctgcaaggggcacattatataattctatgtgtgatatcctaattttagaatgaatgaactaaactctttctgagtatgtttttgtattagcacaaaaatgcctgggaggtgaggacacctaactacagccattggctgttcttgggcattgccagcagagaggaacagccgcttttacctttcatctgaactggttgactttttttttaaaaaaaaaaaaacaaaattaacacattaatctctttctttctttctctttctttctttctttttctgtctttctttctctttctttctttctttttctttctttctgtctttgtctttctccctctctttctctctctctctctctctctctctctctctctcctcctttcccttcccctcctttcccctcccttccccttcccctcctgtcttgaaagatacccaccagtcaccatgatgctttctctaaacctggtgtacgttagattgagagctgaggaatcgcttttctcagatatcttatttttcaagtctgagtaagaaattgaagaaatgggaataaacgttttgtgtatttgtttgtgacattcttgaggcctgggttgaaattccaagggacagtttttaatgtattccttatagaaaaccttttttttcttttcttttcttgattcttggaggtagggggaaagttgtttgagcaggaaagaagaaaatggggtgatgacattggtagttaaagcttaccaactttaataatgaaaacagagccagttggggtggtgcacgcctgtagtcccagccactcaaaaagctgaggcaggaagatctcttgagcccagcgtgggcaacacagtgaaaccccattaaaaaaatagaaaaaaaataatgaaagcatattgtgaggcagagttgtctgtgactattgggactttttcatcaccagcagcctgcagcatttctctggggaagatgtgaagatatagccactctgtcctcctttggaggcactgggtaccatatgtgtatatatccctggctttggaagcaatctgggtttgaatcctagctttacaacttgcagactgtatgacttgtcttgactctttctatttccctatctgtaaaattaggtaaacaatagtgttcatctttgagacgatcctgtagggcacttagcataatactaagcaacatggagagggctcagtcaaagttagctctcctgactgcctggggcatggagaggagagttctgcctagcatttctgagatatgcatacaaatcgatggagataatgtacattgacaattttaatgagcaaagaaataaaaggtacatgttaagggaaaagtaaaaaaggatttcaagtctatttgcacatcttcaattttccagtgaccagggagggcaagaaggccaagcccctttgcttgtacttcactccccatgacacgggacaggtggcagctctgcagtggaagtggcagaccagaccaaaaaattcatgtcaaaaccaggatttctgtagatcagggatttccggtttttctgcctgaacttaccaaatagtaaacgtttatctccttttctttctttctcccttccctccctccccccctcctttcttttctcttctcttctcttctcttctcttttctttcttttctctgagacggactgtctctctgttgcccaggctggagtgctgtggcacaatctggtctcactgcaagctccacttcctatgttcacgccattctcctgcctcagcctcccgagtagctgggactacaggcgcccgccaccacgcctggctaattttttgtatttttagtagagatggggtttcaccatgttagccaggatggtctcgatctcctgcccttgtgatctgcccacattggcctcccaaagtgctgggattacaggtgtgagccatcatgcccttcctttcctttcctttttcctttttcctttcctttcctttttcctttttcctttcctttcctttcctttcctttcctttcctttcctttcctttcctttcctttcctttcctttccttctctctctctctctctttctttctctttcttttcttttctttttttcttgatctagactttgctggaatattcttttttgtttcattttgttttttctttttttgagacagagtttcactcttattgcccgggctggagtgcaatagtacgatctcggctcactgcaacctctgcctcccaggttcaagtgattctcctgcctcagcctcccgagtcgctgggattccaggtgcatgtcaccacatgtggctaatttttgtatttttagtagagacggggttttgccatgttggccaggctggtctcgaactcctcacctcaggtgatctgcctgccttggcctcccaaagtactgggattacaggtatgagccaccatatctggcctttgctggaatattctaaacacacattaaaaacagttttaatgtgagatttttggagaagagacaggagagtgtggtggctaagtaagtttggatcagacaacatggctttgaataacaattaacctaaaaaaaaaaggctctgggaccctgttttgcttgtctataaattggagatgacaaaagtatcttcctgatgggatcagaaatacatgggaaaattacgtaaggcctatagtacaatggctcacacagagtaaagactcagtaagttctggtggttattatgaatggcttatggacaagtgggtttttttttttttttttttttttttttttttgagatgaagtcttgctctgtcacccaggctagagagcggtggtgcgatcttggctgactacaacctctgcctcctgggttcaaatgattctcctgcctcagcctcccaagtagctagaattacaggcacttgccaccatgcccagctaatttttgtatttttagtagagacagggtttcaccaggttggccaggctggtctcgaactcctgacctcatgatccgctcgcctcggcctcccaaagtgctgggattacaggcatgagccactgtgcctggcctgaattttttattgatatgtaatagttgtacatattttatgtagggaaattattaatgttcattatgtcaataggatataaatgttgggtttatagaaaaaaactttctttcatcttgcctaaaatgtcctgagactctttaggacatatactgaattgctgatggttattaataatttttagagtttttattttaagaaaaaaatgagaacaaggaactattataggctaattgtatctactttttttgttttgttttttggagacaggatctcactctgttgcccaggctggagtgcagtggcacagtcatggctcactgcaacctctgcttcctgcgctcaagtgatcctcctacctcagccttccaagtggctgggaccacagctgcctgtcactgcacctggctaatttttgtattttttgtagagacaaggttttaccatgttgcccaggctggtctcaaactcctgggctcaagagatactcccaccttggcctcccaaagttctgggataacaggcatgagccactgtgcccaaccttgtatccacttcttaaataatttattctgctatagtttttatgattttatctttagataaaatccactttattttttgaatcttgaatagcaagggagcagtctgggatctgcccgccctgctagcattcttcctggatgagttgaggctggaatcttaaactctctgggccttagtgctttagttataaaataacagggttgaagtagctctctgaggtccgtttcatgaccaaatgctatattgctgtaactatcaagggctggctgttctaaatagattatgttttggtagcttatagcagtggatcttaaccagggacatttccagttcttatgagacatttataaagcttgtggacatgtttttggtggtcattacgatgggaggttttatcatctataaatttcatttcatttcagaaatgaaatgaaattatcactgctttaaagagtagccaatgatagtggttttcaagcctataccctgtgtccctttttactgtgtaaaaaagccaatgatagtggttttcaagtctgaaaacaaagctttactttggttaaaagggacacaggctataggcttgaaaaccactactttaaagggtagtaaatgataacagtaacagctttactataaaaatattttgatgatggtactgggttgttagattttggattagagaatacaggaagcagtgatgctaagggtttcctgaccttgtgtttcagtgtgagaccctaatgggctggaaagttgaaaacaggaccagaggctgtcatcaatcacagtttagaaaaacaccctgttggggcctcttactcctggatatttctagctctcttgtacccagggcctctgttgactctggggtctgctgggctggctgactggttttctgctggccacatagcctctgtttacttctcccggctgcttgtgttcacaggatgtccttgttggccagcacattcctgtacaccttctggacttgacgtggggaggcatctgcagatggcctccctaaagaaagcatgttttgcagctgggtgcagtagctcatgcctgtaatctcagcactttgggaggctgaggcaggtggatcacctgaggtcaggagtttgagactagcctggccagcatggtgaaaccccatctctactaaaaatacataaattagcttagggtggtggcaggtgcctgtaatcccagctactccggaggctgaggcaggagaatcgcttgaacccaggaggcagaggtttcagtgagctgagatcgcaccactgctctccagcctgggtgacagagtgagactctgtctcaaaaaaaacaaaaaaacaaaaaacccaacaaaaccaaacaacaacaacaacaaaaacccatgtttttttcaagcttactgcctttaaaccatttggcagtactctgtggagcctttggtgattgcaacagcagctcagttacgttttccctgagagtatgatatcaacaacaataatattatttaaagtggtatttatatttaaaatgatggtaaggataacagtaataatgaattttattagtacataatatgtactgggcactgtgttaatgcttacaaaaacactgtgaggcagagtgtcttaatttttatgtgggaaaggctcaaagagttgagttacttgccaaaggtctcacagctactaagcaatggaggcaggatttgaatgcatatcggtctcactggaacacctatgccttgaatcactctgttaccctctctgacctgtgcgtaattcttaaaccgctgggtacagagaggtgatgcactttgggtacagagaggtgacgcactctggacatttctgattatgtgtttatcctaatgaaaaaggcccaattgccttggcatgcgtcaaacccagtggaagagttattgtgggtccccaagggccctgcacgtgatggctgtgggccctcaccctgaggctggagcaggcggcctttcctccagtagacgaagaacagcagccgaggccaggagaaaaacatgcctctcctgaggattagctgcctggagcctttcccacatatattttttcctctggtagaggttcagagctataattcctgttcattccagtctgaaagttggcagtttgatcaatgatttcctgtgccttgatgatgaatggctttcgtatttaaaagataaatttgtattttgagggttcaatgccctttgatttctttataatggaatttcattcaaattggcttcttaactgtgacctgttccaggggctcttggccaaagtaaattgtgctaatgaggaataacagaaacttcaggaaaatcatgtactcctaaattgaagtcatgaatgaggccttggaaatcatctagtccagccttttcgttttacagataaggaaatgggtcccagggagagaagaaagagcgtgtctaggatcacgtcgccacttccggctctttctactgaaatgacctccactgaggggtgtgaagatagtatcaattatttgtctaagacttgtcatttcaaaaacttgtcgatgtaaattctagtgcatactagacttgtaggttgtcagtaaatatagactattttttcttagtctattggaattttttcttaaaactttttttgggtgtgctagacatgtaggacaaattttcttttaaactaggttgctttatggtttgtgaatggtctctgttttacttatgaaagttatacatgttcactttgtagaacggggggtgacaaactatgtcctgtgggccaaaagggttctgttttgcaaatcaggttttattggcacccagccatgctccttcatttacttattctctgtaatgacagagttgagtagttgagaccttaggacctgcaaaacctatatatatatgtgtgtgtgtgtgggtgtatgtgtgtgtatatatatgatttattaaatataatttttatttaatataattacacatatttattaatgcacatatttaattatacttataaccatatagttatgctatatatagatatgtataatatagttatatataaaatatataatatatattctttacacatatatataaatatatttaattaaaaatatacatatataaaatttattttatttttaggttatagcttactgtaaactcaaactcctgggctcaggccatcctcctactttggcctcccaaagtgctaggattacaggtgtgagccaccatacccagcccaaacccaaaaacccttcatagaaaaaaattgttaaaccctgctgtagaacgtctgaaaaaatacagagaaatcgaacatctgaaaacatacggaaaaatcgcacgaagaaaacagctatccatatctcaccttcagtgaagtaggttgactgtaattttaccattctcatggccaaataattttgaaaatatctgattatttcctaaggctaagtttctcgaagtggaattcctaggccagtgagtgtgagtggcttttttttttttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagcgtttgggtccctgggtacttgagattagggagtggtgatgactcttaatgagcatgctgccttcaagcatctgtttaacaaagcacatcttgcaccgcccttaatccatttaactctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccacctttcctccctttctattccacaaagccaccattgtcatcctggcccgttctcaatgagctgttgggcacacctcccagatggggtggtggccgggcagaggggctcctcacttcccagtaggggcggccgggcagaggcacccctcacctcccggatggggcggctggccgggcggggggctgacccccccacctccttcccggacggggcggctggccgggcagaggggctcctcacttcccagtaggggcggtcgggcagaggtgcccctcacctcccggacggggcggctggccgggtagggggctgacctcctccaggacggggcggctggccgggcagggggctgacccccccacctccctcccggacggggtggctgccgggcggagacgctcctcacttctcagacggggcggctgccgggcggagggtctcctcacttctcagacggggcggccgggcagagacgctcctcacctcccagacggggtggcggccgggcagaggcgctcctcacatcccagacagggcggcggggcagaggcgctccccacatcccagatgatgggcggccgggcagagacgctcctcacttcctagatgtgatggcggccgggaagaggcgctcctcacttcccagatggaatggcagccgggcagagatgctcctcactttccagactgggcagccaggcagaggggctcctcacatcccagacgatggccggccaggcagagacgctcctcacttcccagacggggtggcggccgggcagaggctgcaatctcggcactttgggaggccaaggcaggcagctgggaggtggaggttgtagcgagccgagatcacgccactgcactccagcctgggcgccattgagcactgagtgaaccagactccgtctgcaatcccggcacctcaggaggccgaggctggcggatcactcgcggttaggagctggagaccagcctggccaacacagcgaaaccccgtctccaccaaaaaaatacgaaaaccagtcaggtgtggcggtgcgcgcctgcaattgcaggcactccgcaggctgaggcaggagaatcaggcagggaggttgcagtgagccgagatggcagcagtatagtccagcttcggctcggcatgagagggagaccctctctttttttttttaagacgaagtctcgctctgtcgccgtgagtggctttttgaaccttggtacttagcgcagaatttcttttcagcttgtatttctggcaatgcctgtaccttgctaacattaaacaaacaaacaaacaagaactccttttctaatggatttggttttgctttcatggattcaggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtaggtgccatcattcctgcctacccttagctgtccccgtgctgggaacacaccagttcggggcttctttgctgtcctgtagcagaagaggagttttattccttgtgaagagttagttgctgactgttggatggaagcaatttgatggtttggttcaaaatactggtaatctcattttcagtaggaggggagcagctgttgagcagatgcagtgcatcccactgatcacaagctagcttaccaggaccatctcagtacctagatcaagctgtctagacttaattctgtagaaaagaaaagtcctagaaaggttatcgcattcacacacagaaggaaaaagaggaagggggcagggaaagtgagtttgtatctataaggaaatatgcacttcaggtggactgcagttgactatgatactttctctgaggcttaatgtctcatttacaatctattaggtaaaggttttgctctttgcattagcattttcttttgggaacttgtgtactcaaatgcaaaaatcagctgggcatggtggtgggcacctgtaatcccagctactcaggaggctgaggcaggagaatcgcctgaacctaggaggcagaagttgcagtgagctgagatcacactgctgtactccagcctgggtgacagagtgagacttgtctcaaaaaaaggaaaaaaaaagccgggcgcagtggctcatgcctgtaatcccagtactttgggaggccgaggagggcggatcacgaggtcaggagatggagaccatcctggctaacacagtgaaaccccgtctctactaaaaatacaaaaaattagctgggcatggtggcgggcgcctgtagtcccagctacttgggaggctgaggcaggagaatggtgtgaacccgggaggcggagcttgcagtgagccgcgattgtgccactgcattccagcctgggtgacagagcgagactctatctcaaaaaacagaaaaagaagaaagaagaaagcccttcttttttttttttttcttaatagagacaaagtcccactgtgctcaggggttctcaaactcctggcctcaagcagtcctcttgcctcagcgtcccaaagtattgggattgcaggtgtgagccactgcagccagcctgcccttccttcttgaatcccttgcagtctggctcccctccccatctttagtctgaaatgttcattcaagagtcactaatgacgttttttaaaaaactaattttatcaagtagctcatatttttttgtagataaattggagaatatagacaagcaaaaaagaaatctgtcacttattcaggaaaattaatatttgatagtacttggctcatagtttttatgtactaaataaaaataaaataaccaaacctgccatttgataatgactgttagctttttggtgtatcttgtatcttcttacagccttttttattctttgccatctttaaaaaaaaatctagctgtattttttttaaataaaaattagctcattctcgtatgagttaatctgaaatttgactttctcacttaggaatgtattgtagtcctccttctctgtaaatcaatacagatctaggtcctcgttttaaatggccatgtaggattgtaatttacttttaatttattttaattagtcaacacatttcctgtttttgaccatttaggttgtttccagtttttcattattagaaatatctctgtgatgaacatctttgtgtatctttgtgcacttattacattatttccttaggctgtgctaatggccttctacttccaaatagaatagcttgttttcagtgctccctatccttggctgtctgaagaatctgacactgtcagcctcctccctctctgaattttcttcttttggcttctctgatcctgtgtaatacaggctttcatacctgactgttcctactctgctcctttgcttcctaaggtaggcattctccaagattgtgtattcaaccttttctgttcttgaaaatctcattcaccctcttgtgttcagctgtcatcactctgcatggttttctgcagtccatcctcgtctctttcctgaagtccagtttcatattcccagctatctgctgggtatcccagtcagagccttcctaaactgtaataggcaagattactgtcttggctgcatgccctgtttgcctacgatttccctcagtgcctttcccaaattctgtcttagagtccccaaatgattttaatggtgtcactattttctgactccattacacttgaaatcctacaatcattgggtccctcatctcctgccacctcaggtgattgctggatttcatggaatcgccctctgcaatgtttcatctgtcacctcctcccatatccattgctccaccctcacacccctccagaggaccattgcatttgctttctaaccagtctcttcttcctccaatctcttctttcagactgttactcccttatcctttacaaaaaccttcagtggcgcctcgttgtctaagcttcccttagagctttttcttcctctgtttccttctgcatgtcctatgaccaaccaatttggaccacctccttgttttctggtcttcagatctttgctcatactttcttctccccctgaaatgccctttcctactactactttccaaaatcctaccccttctgcaatgtgcatcctagacacctgctccttcacgaggcctttcttaaccccttcttatcccctcaaccagatgtaattgccctcttcctaaactctttgtgcttttacattgtacttagcgcattctctcttaaatatagatacttatctccttttcttctcatcttcctctctgatgttgtgttctcaaaggcagtaattttattttgtggaactctgaattttccatggtgcccattacctctgaaaagtcaaaggtctgtatcttgctaatgactgggcaagatacagagttatgaaatttcttgagactccctcagtttagtggagcatgggttatggggctagaaagtcctgagtttgggtctcagttcaggcttttactagcctggaaactttgggcatttacttcacttacttaggtcttactgtccttatttgaaattgaataataatacttagatctcatagtcttgcagtaaggattaaataagatatttagtctagtatctgtcacatggtagatctcagcaaatacttgttgcctttccttttccttgccactatgtttcagcaagtatagctaaatcatctgcttcttcctattgtatctgttttttagggatcttacctttattatccaggaactctccctaatgtgccttgggtgaagatgttagttgaagtgacttctctgccgtgtttgtggacctggagggactggctcctgggcctttggctccatttgcatcctcctctagccaactctggatgttaacacatcttaaagctctttggcaaacacataattaaattgctggtgacaacatctgaaatgatttccatttgtagcatgcagtccagtgatgctagcttatattaggcttgaagtgaatagaatgttctggatttagctctgtttcttgagaattcactgcagtctagtttcattgtaactcttgagtgtaataatatgttttagcttataattttgttataagaaaagggaaagggaaaggttttttgtttgtttgtttgttttgtttttgagatgggatcttgctctgttgcccaggctggagtgcagtagcatgatcatagctcattgcatcttcgaactcctgcacttaggtaatcttcccacctcagcctcccaaagtgctgagattacaggtgtgagccactgcacccagctgagaaaatattttaagttcataagacctaaagaagagcaaatggaggacacaagtggttagggcagattattatgcagtttaaataaattctacttcacaattgtgatctttacataaggaaatatattttcctttaatattctaatctttgtaaataattacataagaaataatttgtttcatgcttaaaatgttctgccctggaaaagctagccatcactaaagctaattggtcttcatcatcacattaacaagtggtagtttcatggcaggtaaactttcttccattagggttggtcttctacgaattgattattccctccactctcctatgtccatttcactcctgtacattgtcctctatattgctgctccctctctaaaggggcttgctttttttttttttggagacgtagtctcgctctgtcacccaggctggagtgcagtggcaagatctcggctcactgtaaccttcacctccaggttcaagcaattctcctgcttcagcctccccagtagagtagttgggattacaggtgtgtgccaccatgcctggctaatttttgtagttttagtagagacccagcctaaaggggctttcttatcagcctgtaaacacatctgagtctctactgccttctcaaacacccagcctggactaatccacatccacatctctagctactaccctttcacccttgctgtcatagccaaacttctttaaaagctccatcggctgggcttggtggctcatgcctgtaatcccatcactttgggaggccgaggagggtggatcacgaggtcaggagttcaagactagcctggccaacaggatgaaacctcatctctactaaaaacacaaaaaattagctgagtgtggtggcagatgcttgtaatcccagctattcgggaggctgaggcaggagaatcacttgaatccaggaggcggaggttgtggtgcgtggagatgtggagatcacgccattgcactacagcctgggcaacagagcaagactccatccccccgcccccaaagaaagctccctttatcccttacctctcatttactcttcaactcttgccaatctggtttctgcccctactttgttacccaaatccctctctataggctatacacccagtgatcagttttcagacccccctgtatcttatgtattattctctcggctgctcgcccaattagttctcctcaccatgcttgaaatgttctttgccatggctcctgtgataacacatcctcctggctttcccactacctctcggcagctccttttcagtctcttgcgtagactcctacttttctacacagctttgcatgtaggaatcccttaaggtgcaccctcaactccctgcttgctatggtctgaatgtttgtatctcccctgaattcatatgttgaaatactaattaataaggtgatgatattaggaggtgggcccttttggaaggtgtttaagtcagtgggggtagagccctcctacatgggattagtgcttttctaaaagaggtcccagagagctgccttggcccttctaccatgtgaggacacagctctagtaggtgtcatctgtgaggaatggccctcactagacactgattctgctggcaccttgatctcagacttcccagcctctagaactatgagaaacaaatttctgtttttatcagccacccagtatacaatgttttgttataacagcctgcatggattaagacactgtttttctccctttttacgtccccctgaaagatctcctctacttctgtggctttaattcctctacatatgtggatgactcctaaacttacgtctccaacccagtccttcctcttaactctactattatgtgtctagctgcctgcctaacctgtctaattccatgtatcacaggcatctcaaattcaacttgaccaaacccagattcctgatctgccttttctagctctgattctcttcatcatatttcaagttgcagaaaaggggagcaccatttacccagttactgaagcctgaaacctggcatcctcttccttccccaaacatgccatttcagcacatttttctttttctttttctttttttttttttttttgagacagagtcctactgtgtcacccaggctggagtgcagtggcatgatctcacagctcactgcaacctccgcctcccgggttcaagcgatttttctgcctcagcctcccaagtagctgggaccacaggcatgtgccaccatgcctggctactttttcgtatttttagtagagatggggtttcaccatgttagccaggatggtctcaatctgctgacctcatgatctgccctccttggcctcccaaattgctgagattacaggcatgagccacatgcccagccctgagcacagtcatttttctaccagtcgatgttgcaatgaagataaagttccaaatccttgacatgctccagccttcccctgtgagctgatcactcccacaagaagctcctctgccttccatcctcagccactctgaccttctgtttcttctggggaccctgcacctgccagccccagccccttccttatttatgccatccctttttctggccctcttgcttggctaacttatactcatccttcagtttgggctgagctatttatatgctgttccaggaccctgaacttctcctttatggcacccatcctgattgtaattatattatttatattgttttgtttgttgtctgtcccctctgctgaacatcgacttcacataggcagggacggggtctcttttttcactgctttgtcacttaccacaccagttcccagccaggaaaagaaaagacggttgtttccctgctttgataaaatacccagacaaaaggatgcccttattgctcttagacctctttcccgaatcttccctggttgtcacctgcaatgatgttatgtctgagttgaatgtttctcactgcacgctagtttgctcagaggtaatagaggaggaactgttttctcactttctctttctctttagcctttattcctaaagcttgtttctagtcatttcttttaaccagcttcctgagaagtatttccattgtcttttctgaactctcccttagaccatgagaaaacaaaagtttatgctgattttgggtcatgacctgacactgaaattggtggtgttaagtacattgccgagtaactcagatacattgatatttaaaaaaatactttttctgattataggagtgattttattgttaagaaaaaattgagaatataatcaagggtctagaagagaagaaatgggagagattcagacttttctcttgtagaataaggtcctgctgtacatgtgatttttgtccgccctttttcacttcacattgatattttgataaaagccctgagaaatgggagtgaaacctaatggaccgcagctttggacaagccccgagtgcaaataaggctggtcagcagcttctagcaggatctgcttcttctagaagcagagaaaggtaacaggctgccctgagaccaggctctacagagcctccctcctgcctcgtacatgccaagccggccctgtcctggcacttacagtgactaacggccgggcacctccctctcggttgatgccctccatgcaggacatctccaacacattgctctccgttctggtgtgttccttaagccaaactttctaggtttaatttcactggatgttcatagatcctcgtgtcccagactaattgtctatgtatttgttgatatttgttcttgcctattttcattttattttttaaattcaaggcaagaggcctatttattttgtattttatagtgcctagcatggaatttggtgcccaataaatactttttttttttttgagatggggtctcgctctgtcgcccaggctggagtgcggtggcactatctcggctcactgcaacctccgcctcctgggttcaagcgattctcttacctcagcctcccgagtagctgggactacagatgcatgccatcatgcccggctaatttattgtatttttattttttaatttttaattttatttatttattttttgagacggagtcttgctcagtcgcccaggctggagtgcagtggcgcgatctcggctcactgcaagctccgcctcccgggttcgcgccattctcctgcttcagtctccggagtagctgggacttcaggtgcctgccaccatgcccagctaattttttttgtatttttagtagagacagggtttcaccacgttagccaggatggtcttgatctcctgaactcgtgatccacctgcttcagcctcccaaagtgctgggattacaggtgtgagccaccacgcccggcacatttattgtgtttttagtagatacggggtttcaccctgtcagccaggatggtcttgatctcctgacctcgtgatcccccggccttggcctccaagagtgttgggattacaggcatgagccaccgtgcctggccaataatcttaaataatctaaaaataatgttctgcccaaattacaaattaccaaattagggtccatttatgcataattttatccattaattcaggaagcatttaacagtgcctggcacagttgccaggcatggagtatacattagtgaataaaacaggggtagttcctctgggattctaggctagtttgtttgtttgtttgtttgtttattgagatggagtcttgctcttgaagctcaggctggagcagtggtgcgatctcagctctctgcaacctccacaatctgggttcaagtgattctcctgcctcagcctcccaagtagctgggattacaggcatgtgccaccacccccggctaatttttgtatttttggtagagacgggatatcaccacattggccaggctgatctccaactcctgatctcaagtgatcctcccaccttggcctcccaaagtgctgggattacaggggtgagctcccggcctctaggctagtttaataccagatgttacacagataataaattcatagtttcaacttgtgatgagagttatgaaggaacatggcagggtgccctgagagaatgcgctaaggcaggggtgtccgctcttttggtttccctgggccatattggaagaaaaattgtcttaggccacacaaaaaatacactaatgatagctgatgagctaaaaaaaaaaaaaagaaaagaaaaaaaaaaagaaagtcgcaaaaaaaaaaaatctcataatggttttttttttttgagacggagtcttgctctgtcccctgggctggagtgcagtggcgcgatctcggctcactgcaagctccgcctcccgggttcacgccattctcctgcctcagcctcccgagtagctgggactacaggcgcccgccaccacgcccgactaatttttttgtatttttagtagagacgaggtttcaccggattagccaggatggtctcgatctcctgacctctggtccgcccgcctcggcctcccaaagtgctggaattacaggcttgagccaccgcgcccggcataaaatctcataatgttttaagaaagtttacaaatttgtgttgggcctcattcgaaaccatcctggtcggcatgcagcctgtgggccacggttgtggacgagcttgcactgaggggagacctatagtatctggcattgtgtgtgggaagaagcctggagactgagccctggagagaaggagagggtgggtcaaggtgagagatgagctctttttgagagggaaccagcccaaaggcgaggcattcaaggtagagagtggtaatcgaaagcgagaaatggaaattgttatctctttgttttagtaactgggaatgtaagtctccccatgtcatcggcctctattctttctaaaaacttttcaagggatgtatttagccttcctacaagagtattttgatttgtttttgaacaggtctttctgaacctgtcccacttttattgatgctttcgctgatgtttgtgaaaggcatctgggaagggcactagccagtcaggcttttaacacctgtctgtgggttcaacaaagaggaattaagcttcttctcaattgcagatgtcgtgttgtattctgggtcccataggagatcttgactgacccaggagtggtcccctccgggaagaaggacgctcagccaccagctgcccccaggtgttcgtccccaggggtagaactcacccactttatgagcaagtctttgtcaaggaaagaagacggcaattgaaattttcattgagctgttagcatttttttcagaaaaccattttgtcccagtgtgtgtaagaagttattccttcattcaacacatgttgagtgccttctgtgtctggcacatttccaggtgctgggatacagcagtaaacagattccatgtcagtggataaacacacactggaaacacataagtgaaacacagagggtgtcagggaggttataatcactacctagaaaattaaaggagggaaggaggccttagggagagtcacctgggaggtggagacaggtgttgaaattgttaaaaatagcatcaggaaaaggcttactgagtgacatttgagcaaagatttacatgtgagggaagagcattccaggcaagagggcacagtgagtgctatggtcttgcaggagcatgcttgggatatttgtggaacagcacaaatcctgcagtggcttgagtatgggcagtgagagggaagagtacacacgagaggaggtgaaggggaaaagggaagatcatgcatccggggccttgtggccactgtgaatactttggctttccctctggttaaacaggaagatgctggaggctgttaaattggctgtaggggcaagggtggaaggagactctgatgagatggcggtagcatggatctagatggaggtggtggaaagaggtcaggtttgagatattttgaagggagagctgatggactagatgtgggctatgtgagaaggagaaagattgggagaagaataggttatggacttgttaaatttagatccatattagggtgctcgtgtcaaaaatgtagttgggtgtatgagtctggagtcaggagagaagcctgggtgggaagggtgtctgtgagccatctgtgtacatatggtatttacatccatgagactgtggagtgactgtgtgttgggtaagaacttcagtgtcttggggttgtaggcatgagaggaaccagcgaaggagacacaggaaaggtggccagcaaggaggtggagacaaggtctgacgatgagtgactctctggacccccgtgcaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtggtaagcccctgctaatggggaggtggccggggacaggtgtgtttgcacttgctgttgggctctgttcaccctgcaagtggtgcacaggtgtcctgtgggttgctggcttgcttctctcctcaggtggacggtcagatggttcagaagccactgaaagcacactttgtaaaaagctgaattgactccagggagcaggcttagccggaacgaaaggcctgattgtcatgcttaggtctgcagtcttttacctctaactccattattaaagcctaaaggagcttgagaactgaacctgtaacctgagctctagctaggtgttgggggaggggagaggtaggggaaagctggggaaagaggtgatgtgagggctgggagggtcctcagtgggaaccccacctttagggcctgagagaccaagtgcaaggaggggccgcactggccatttagagacattctcttccattatttctataagtggggacagaagaccagagagctaaagtgaattgtttaatgtcacccacctgtttctgtagaaaacaaccttggagttcagtaatagcacattggagcgtctatactttggaatgctcaggatacactaagttaaaaaaaaaaaagcgggttacaaaatacatgcagaatccgattctgagaaagctgggggaaattggagtggctttcttcctaggaactgcttcagcctcaaacccagagtgatctttcctttctgtcctccaggacttctgattgcaaaagatcacaaggaggagaaatctgctgtaggttatcccctataggtaggaggaacccagagaggaattctagtggtgaagaaatggaaaaactttgttagatctagattcaggaaaaggttgacttctatccagagataggctaaaaatatacaatttgatagaattcacttaagttcccttgctcatgtgaactttgatatatttgctatgagacccaccctactctaaatttaagacttggggacttcaaggagtgtttgtaaaagacaaaattcaaacagcacaagttggagtttaccgtcttaggatccattgctcgatattttttagattcaactcaactaatactagtgaatttatatagtttatatatttgttgggttataatttccagataacaaaatgtacagattttaagtgtatattgtgaattttgagaaatgtatacactaggtaaatatgacctcattcaagatggtcatttttatctaagtcccctgtcacacatgatttaagtcaaattcgaaatttaaactatgtaataattttgactcaaacttaatgtgtttctgaatttggtatatttctgctttgtttttcaaagttgaaccatattttctttccagttataaaatgacatattttttataacaaatttaaacaacatagaagtatagaaagaatggctctcataattctatcccccaaagaaacataattattaacagtctgatgtatatccattgagattttatatgtacacacacacgcacacatatatatgtctacttttaaaaaaaatagcatcattctatacacgatgcaaacttttttttttttttttttttgagacaaagtctcactctgttgcccaggctggagtgcagtggggtgatcttggctcactgcaatctctgcctcccggactgaaagtgattctcccacctcaccccctgcagggagctgggactacaggtgcatgccactgtgccaggctaatttattttgaatttttttgtagagatggatttttgccatgttgcccaggctagtcagaaactcctgggctcgagcaggtccacctgccttgggctcccaaagtgctgggattacaggcatgagccattgagcctggcccaaactttttttttaaccaaatacttaaatctatactacatagatctaatgctatacagacatcattccataccaatacatatatataatcttcatttttgtgtctaataaatgcttcataatatggacactttataatttatttaaccaacctctctctgataacggactttgaggttatttctaattttccacttttgcaaacactttataatgaacatctagattgatttgagtttctgaatattttcatatgttaaattaatattatatattgctaaatccagagaaactgtaccattaacactgtttactgaagtctgtaagagagcattttttacccacactttcacatatactggaaactcttaaatctccattaacctgtttgagaaaaattatattttgtttttattattatgtctttttaaaaaattagtatttttgttgggcatcttttcaaatgtcaatttgtgatgtgtatttccccttttaattttctttgtctggtctattgagtgtttctatttttaaaagttcatatcagccgggcgtggtggctcacgcccgtaatctcagcactttgggaggccgaggcaggtggatcaccaggtcaggagatcgagaccatcctggctaacacggtgaaaccccgtctctactaaaaatgcaaaaaattagccggatgtgcatgtagtcccagctatttgggaggttgaggcaggagaatcgtttgaacctgggaggcggagattgaagtgagctgagattgtgccactgtactctagcctgagcaacagagtgagaccccgtctccaaaaaataaaaaataaaacagtttatattcagcatctaggcttggcacatagtagacagtcattactagctacgtaactatgtgccacttatgcatatttgcaacattttcacaagtacagagaataatacattgaacccccatataggcaacacccagattccataactatcaacacgaggccaatctggttcataccattctcacctacttcccaccctgaccctgattaatttctttagtgttctttgtatgtagggatttaaactttgtcatatggtacaaatattccctgcccccctgcagtttctcatttgtctttcagtatattaatatttttgtgccatactggttttaaactttcatattgtcacatctgttaatcttttctataggatttctggattttgtgtaatttttaaaaagatcccctcctccccaacatcaaagtttataaaaatattgtctttgggctgggcgcagtggcttacgactgtaatcccagcactttgggaggccgaggcaggtggattacctgaggtcaggagttcaagaccagcctggccaacatggtgaaaccccctccctctctactaaaaatacaaaaattagctaggtgggcctggtggtgggtgcctgtaatcccagctacttgggaggctgaggcaggagaattgcttgaacccaggaggcagaggttgcagtgagccgagattgcaccattgcactccagcctggatgacagggtgagacttcatttaaaaaaaaaaaaaaaaaaaaaggattacatgcttttaaatggtctattgttcgataaagtttaatataaatttaaaactttgtacaggtacagtgaggataaattttttaaaatttccactaaactgcaaaagtggtttaaccaacataaaattattcctgatgaaggacataaaatatctgtaaccagttgttaaagtgagaaggtgggttctaatcagatgtgctcagttacttccatcttagcatctctgttgtaaatccttgggcctcagtcttcttgtttgaggcccaaaggcatttatttgcacatttgttcctattatccagcaggactatttaagaacattctaaaacgggtcccaaattgctgaagatttatcatcctgctattccagggattgttggtaatcttcatcctttcctaattagaagaggcccctgggctgcaactacagtcagcaaggtgcgtgggttagaccggaagaaggagcaggctaaactcagggcagcggagtcttcatgctcatcaggttctcacctcttgtctccctctgcaggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtgatggcaagatggtggctggcttctctgcttatcgcccctcatgcagtgggcttcctttgctaggaagacagccaagggagttcgaatagttggggtgtgggctatcttttcaaaaatctatttgctggggctcttaatttctttagtgttctttgtatgtagggatttaaactttgtcatatggtacaaatattccctgcccccctgcagtttcccatttgtctttcagtatgttaatatttttgtgccatactggttttaaactttcatgttgtcacatctgttaatcttttctttaggatttctggattttgtgtaatttttaaaaaggtcccctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatggcagagcagtcccttgggggatccagccctgtacaatgcatctcttcctggagaaagctggcctgctccagaccccaccattcccaggcgcccttggagtggactctactgatgacagacagaccctctgagagacaagaccctctgactctgtgatggaagatgccagagattttcctttggggtaattgtccttaaacaaaaccaaacagatgaaacacacacaggacttgtggctaaaaaggctagtttttcacttgcatttctcaactaacccaggttttacatgcatctgtgaatccttttactactacctctgtggagagatggagagacttcagataaacgtgaagctaatgagtaaaaccctctctgccaaaacctacactccactttaggcccttcttgaagatgagcacaatttttaaatactgagcacaatttttaaatactgacatcacttcctcttccccctcccaccccagctcagcagcctcaaatctacagagaagaagaattatggcatgaacattcccacagacccaccatctttaagacttgacctctgtaagtttaccaaagggctcctcacaattgtggtgggggttctggttcaaaatttggagcaaacatgaagtttttggaaacgttttctcatttgaagcctccagtatgctgtactattctggaaattaccttcaagagtctcacttcttgtttctgttgtgttttctgtgggcatcatgttcttcacgcttgcagtagaaggtgctttctcggtttcccagagtatccaacggctcacctttctcaagtgctggcagtagctatgcactcacgggctggtttgggtcgctggtgcagcagcgcaaatctgttgccttctgaatttttctcacctaatgtgacactggctacaatgaatcttctcttcatcgggctgaatgaaagattcaagaaccatcttcaaggtgcatggtgggaattatcaacctcagggatactcattttaactcaggcgtgtcctgctttgtaacattccattgttgggagagggcaggacaggtgtgttcttctgtgggcaggagtcatgtcactgtcctacatatgtaagagttgggaaggtgacgatttttgacacatccaggaactcttactctagttagaatttgtaccagatccaaggtgaaaaccccaataagcaactgaatttagagtttaaaaatgaatgactttatgctacatctgtggttatcaaattatataggttgttgagaagcagaacgctgtttgtagtaagaaatctttgtggaaccccagtgtgtgaagtaaattgtatgttattaaatttatttaaggttaaatttatggcatttacttaataatatatgaggtggtgaaaatgcaaattaacaaattggtaatttccaaggtagaaaaattaggtgttgaatgaatgtatatgttggtttattatagttttatatatatatagagagagtgttttgtttttgagtcagggtcttgctctattacccaggctggagtgcagtggtgcagtcatgactcactgtagcctctgtctcccaggctcaagtgatcctctcacctcagcctccccaggagctgggagtactggtgcgtgcctccactcccagctaatttttgtattttttcatagagatggggtttcaccattttgcccaggctggtctcaaacttctgggctcaagagattcgcccgcctcggcctcccaaagtgctgggaataggcatgagccgtcacgcctggcctaaaaaatatttttaaaatgatctttgaattaaatattcgtagaatttctaatgtatctctttgagacctaggaggttgatggaacagaactgctgttaagtcctttgggtttcaagtctagaattttttaaaggcaaatatcagctcattcttattttagattgaccttatcaggcatggattctggtctcatctactttatggtataaatgctccaaggtagggggtttggtatatattttaagcccggcttttttttttttttttttttttttttttttaatgtgagaagcagaatgtgcttctagaaactggttttaaagagatgagctgagaaagaaatgtggaatggagtatatttgaggaggacaaaacataacttcacttttgaacagaaatcactctagcttgccagcatgggatgtaaaccaagagagtagaaatatacccatcttattttaagttgggtttatggcatcgctcatatatgtaaaagcactacaaactctttaaagaaaattgggaaactacagagaagtcaaagaaaaaaaaaagtaacccatatttctattgcccaggtataatccttgttaatattttggtttggtctcctcttttttcccccaatatagttgtaaataaatgatgtctttcagagttgacatttatcctgtagcttgaatggcatgtaaatgccagttgtatattttttcatgaagtgtaggtttggaatacactagagttagctatatgcttgaatgctgatcactggattctgagactgactactgagtctacctttttaatcaagcctaacatgaatgggctccaaaaagtaatgaatgtaattgtactttttgatgtgcctctgcacttggcttggtgagtcatcataaatagctgttaaatatgtgactttacagattttgatatgttcagattgtaaaaaatgaatagtttatttcattaattgatgggcagtcaagaatctccctcccttcagtagggctgacacttaggagttaggtcatggttgtggttacttggcatggctaatcagattttgttctggtcagaatttgcccaagatcaatacccagcagaaactggagttaggctataaaaaaccattcatgtttccgagtgatcatttcagtcagcgattcatgttttacagtgtttagttgttgattattagaaaaagtaatattttcttccctttatgattacatcattataaatcaagtccttccatgaacacatttaaggtgtgtggagatgagatctctgaatccatttggggatgggctgcatttttggggaactctatgcctgtccagtgaagagtgcctaaaacattaattatagatcaaagatgttctgttgagggacaaagcttgatggtcatcaaacacaaggctttgtaaaaatacgaccacctattccacttactggatctgtcaggtgtgtaaaacttctctcgccagttcatcatgcttccatgagccctcaggactgggatttgagccttcctggctctttatcccttggggcagacatggaaccatctctgagggaccaggtggatgctgaagctcacccagtcagggcccctctcctagctccttttacactgaaattaatctgaaagctttcatagccaaggctttgcctaggtgctattattccagctggccaaagagaagtcttgggccagattgggattctcaatggattttatagacataattcccctgcaaacttaaaaaaataaataacccctactttataggactaattgtttgaattgtatctttctctgtatgttaaaccagatttaaaactattttataaccacaatatgtaatcagagcaatatagtgttttcagatatataccttgttttataccttatgtaggtgtcctacataagggtggcatgcccactggctgtggtaaaatttaatcctcattgctttgggagtgacttaaggccttttgaagtggagcttttgcactttatactttttctgtgaactatgataactatatttgatattaaagctgtaagtggcattttcagcaaatgaatatgtacatgtttgtgtctatttccaaaatgatttctgaactatctgcagtgaaaatgtatctgatggattgtagagcaaagcacattgcctaaattcatttgttaatgaattgggtaccattgttattaaaaatgcgtaaagtaattgttgttccttgttggtttcttctcagagctgtgaaattaacacatgaaaatatttccagcataaaatacctaagaacagtttatttttactaaaacttctatagtcatgtcatatagatataaatctcaaatataggcctggtgcggtggctcgtgcctgtaatcccagcactttgggaggggaaggtgggtggatcacctgaggtcaggagttcgagaccaacctggccaacatggcgaaaccccgtctctactaaaaaaaatacaaaaatcagctgggcatggtaactcgcacctgcagtcccagctagtcaggaggctgaggcaggagaatcactttcacctgggaggcgatggttgcagtgagtcaaggttgcaccaatgccctccagcctgggtgacagagcgagactctgtctcaaaaaaaaaaaaaaaacccaaaaatctcaaatatagaatacagttcatttatgctggatttcatcaaatcactagaaggaagatcgtgacattttaaaatcataaatttagcaggaaaatttttacctacttcttttaattttctgtggcagttttttaaactgaaaggactcacagatcatcagatttagaagaatagtctgggcacagtggctcatgcctgtaatcctggcactttgggatgctgaagtgggtgtatcgcttgagctcaggagttcaaaaccagcctgggcaacatggtaaaaccctgtctctaccaaaattacaaaaattagccaggtgtggtgatacacacctgtagtcccagctacgcaggaggctgaggtgggaggattgcttgagcctaggaggcagaggttgcagtgagcagagatcgtgccactgtgctccagcctgggccaaacagtgagaccatttatcaaaaagaaaaaaaaaaaagaaaaatcgtaagagaagaaagactggataagcattatctgtatcattacagtgggtttttagacttttttttttttttctggcagaggtgaggggacaaggagtggccccatagttgtttggcaatataaaagctgtaggaaaacgtccatgtagaggttgagtatctctaatccaaaaataaaaaatcagaaattctccaaaacctgaaactttttgagcacctatataaaaatcaaagggaatattccttggagcattttagacttctgatttttggaatagggatgctgtataatgcaaatattccaaagtctgatatctgaaatccaagcatttctggttccaggcactttggataagggacattcaatcagtatataattttctgggggttcagacatctctagtagcccatccaggtaaacagcctctgcccaacaggagactaagcaagcactcaaatccttttggtgctgaaattggttactcagtcttcgggactgaacttttttgaggctgtggtcagggacagtggctgaggaagttgagagctctgcttttggggcactggcacgggtgtgtgtgcctctctccccgacagtctggattatttgtttctcctcttgggtgacctctttttctgagtctggctgggagttgatgcagccacacctgctcccttttccagattgccctttgaagaccagagctcaggggctagcctctcccactcttttctttaaaggacttttcattaaaagacattacattgaaagactgtgttaaagaactatactacaaagggctggagtgggcagacccagggttctggcaagtgacatcttagggctcctcaacaaactgggaacttagattttttccttgcagcctctttcctggtttacagtttcacagttcttaagatggtgtttgggtttgtcataccgttctgtctacttttgtatagttggattttttcataataagaacttaaaagatacggtatttgagattttgttctccactgtctccagagccggttctcagcctcctttccggccccgttttaagagggctggcagcccctctctcccagaacttatcttgtctcaagtggcacttctgtctctaactgtctccagcctggcgacacctagtttacctgggaagtcttctctttgggtgttaactcacaaaaaggaagagatcaccctcacctgggtttttatttattttatgcttctcattaaaacaaaacatttgattcagctgctttggcaattgagagcagagaccaaagtgctatttttaagatgtaacaaataacagtagtttatttttatattcgggctagtgataggaaactggctgaaggtaaggccaggagcatgaagtaatggaaaacatacagtggcgctgatgatatttgggagagagggtttcctgtgaacaaagaaagccattagctactgggtgggagggacggagacgctcctggagtaatactgccatcttgtgggtttttgaggcattgctatgtggcgcaagcgaagcccttcccagttcctaatcatcccagagatcaccaattgtctcaaaacgccaagttatgtaatctctttctgggcccaggtatgtttccctgcatttttccaagcatctctctcccttccttttcctctcctctcttcccttagaaattcagttttcaccccccaccccgggtgttttagaggttgcccaatgtgaaagcaaatactgttgttggctctcggtattcgtggttccaggaccccccaacccccataccaaaatcccagaggctccagtctcatacataaaatagcattgtatttacatattacctatgcacgtcttgtgtgctttaaatcatctctggattacttataatacctaatacaatgtatatgctgtgtaaacagttgttaaactgcgttgctttttatttgtattattatttattgttgtgttatgattttttactgtttctttttccctgaatattttcgatccatgttgaataggtggatgtggaacctgaggttacaaaggggctgtatttaaaaccaatttaaggtagatgtgatttaaaggaagttttgtgtttttgtttgtttattagatatggggtcttgctgtgttgcccaggctggaaggtaggggctatttacaggctccataatggcacactacagcattgacctcctggcctcaagcgatcctcctgcctcagcctccttagtagctgggccaaaaggcactagccaccgaccagtctggaggaagtttttaatccactggagtgaaatttaacttttgggattaatagctcaatttacacaagtcaaatgtcattataactcagatctttttaaagatgaatctaatttaaatcaacactcagcaagtgtctgtgtggtattacctattatgctgcctgcagagggttatggggacggatggagcagctcagatctggggaggggagaaggccactgactctgccaaatccccgtagtggagaggaatcaacagtgctagggaggcaggaaggagagagtggtgagttttcaccagggaggagcgagaattctaagctttaactgataaaccatgagccacatataatacggaatttcagtccagtgaaataattggtcgactccctaggaatattattggtagactccctaggaattttcttacaagcaaaccttatttgacagcccatcacataagttatctttcacataaatggtctcatttactcctctcagctattttgcgaggctggcattaccattattcctgttttgggtacgactggaaatgtattttgaccactgctattgcaaggatgtgaacccaggacttttgactcttaggtttaattctctttccacagaggatttatggcaaatgagttaaaggttttcatataggtgggcaccaaattggaattgtcagtttcaaaactgtcctattagtacaaataattgggtaaaatacagttggcctttcatatgcatgggttgtgtatctgtgaattcaaccagccttagattaaaaatacttaaaaaattcagtgttgaatatgtagaaagtattttttttacagcttttaattgtacctttattcaacttagttcattaaaaatgtacttgttttaaagatcctgcaaataaagtgaccactcactaatgtgggctataggtcacccctcagcatgttatttatttttttttaaaaagcagtatgtcttataggaatcttactgatcacacagtagttacaataatgtcagatgtgatgtatacattctaaatgagacaggctggttaagaatttacataatgtaaaaatatacatattaaaagttagccaagtggacagatgcatgcagtggggagagcaggtgacaggaactgctttaatgatcagtacagggcccagatgcaaggaatctgggtttcccctattatagtaaatagctttcactaatgtatacaggaattccatacacatctaaacacacgagggtaagttgtgacttgctacatgtacagtctaaagtggtgtaactgtgatcttcctgtgatactcccaagaaaactaaatagtggaccccatgcaggtagtgggaagcactggtcttttatcacaggttgaacctgaggaggtttaactcctgacattagtatttgtaaagagtgtatgactcctttttctatgttttctccacaactgacatgcattcagtgtgggggaattctgatggctatttgacctatcagtgataactgaactactattaaaaatgtgggaaccttttcaataatattgaattacacatttaacattaaaaaaaacaaaaacaaaaacatggatcatccatggctttaagccagaaggtagaagggagtgtgtctgaattttaatgcttttagttatactattctgtggtttctaccgctgtcctaaagaatgacactggtacactgcttctttccataccaacacaggcactagtttgaactcagacaaaagctgaaacagaagaagtgccactctttctccagggtcttttgagaaactggatcaaaattataaattactcaagtttccttttcagtggtatctttatgtgtgtaactagagaacaaaccaaataagaaatgtctacccctgcaagagtgtggactttgggtgtagttctgttaggagtcaggaacctcgagcagcagtttacagtcagggctgttttcttacacacaccccatttaccctgcgtttgtgccaactattacggcaaatgcgttttgcagggattatgcttcacagctgaggcctacagatcctcttagggagatttctctagctgagtagaaaacttctatccgaaaaggcgctgggttctgtgaacctgaagagaagactcagggtctctctgaaagcctttaaattactgctggaattggaagttcctattagtgagaaaagagcattaaaataacttgaaggtctattttattggcaacttagaatgcaaagtattttatttttaaacttttaaaatttgaaaacaaactagcctacattaaatcatatagtttccaaagctgaacgttctcacttggagctcagttctgccgcttgaaatacaaacacaacttctaacgctcctaggtgggaacactactgtttgatgatctatgattagatgaactgatcgatctcagttggcaacaccccttttttcccttggtaagggtttaaaaaattctagaatagatgcatttttctagttttacactgacaatttcatcccatacgtctcctgggaggcatagaccatgtataggaatccatcttcatccttctcactctcatacacctctgagactggtgtggagacgctcaccatgctatgtccgttcaccaccaggaggaaggcttgattagcattgagctgtaagcgccttctaattatcttgatgagctcactcatgttgacgtctcgaacgtcaggtacaaggaacttcgttttatccaggacaggaagctgcttctcaccttggtatcgttctgttatcaccgggcttttggctggatgctgctcttgaataagtcggacatctactctttgttggaaggtgcggcgctgcttgaaggtcttctccgctggcctggtgcggggatccaggcggcggcggcgacggcgcgagggtccccgcggctcctgggggcggcgcgggcggtagaaagtattttttcttgtcattctggaagcagtacaatgtaacaactatttacatagcttttacgtataactaatgtagagatgatttaaagtataggggagggctgggagcggtggctggcgcctgtaatctcagcactttggaaggctgaggtgggcggatcacttgaggtcaagagttggagaccagcttggccaacatggtgaaaccccgtctctactaaaaacacaaaaattagcctggcgtggtggtgcatgcctgtagttccagctactcgggaggctgaggcaggataatcgcttgaactcagaaggtggaggttgcaatgaaccgagatcgtgccactgcactccagcctgggtgacagagcaaggctctgtctcaggaaaaaaaaaaaaaaaaaaaaaaaaaaaaaaaaaaaaaagggggcggggggagaatgtgtataggttatatacaaatactgcatgattttatgtcctggacttgagcatcctcaggtttttgtaaacggcagctagtaatcaaaaccatctgctgcttaacagtcctggatgctggtactgcctgtggccatagtgaggagtcacaagctatctctctttgctcagtgacaggtctgcaagtctcattatttcctggccatctctattggatgcccatagacaactcacatttgcctttacttatacctctcttaaatctgggccttgtccactttctcagtgagtggtgtcactttccattcagttggcagaggcagtccccacctccctcagttgtctatatccaatctattttgagacagggtcttgctctgtcactcaggctgggtgcagtggtgtaatcatagttcaaggcagcctcactctcctgggctcaggggatccctcctgcctcagcctcctgagtcactgagaccacagtcatgtgtcaccatgcctggctaatttttaaattttgtctctttatgttgcccaagctggtctcaaactccttggctcaagtgatcctcctgccttggcctcccaaagtgctggaattataggtggtagccactgtgtccaacccatatccaatctaatagtaaataaatccttttaattccacttctccaatgtctcaaatccatccatttttccgtatcctggagaaggtgccaccttctattgcccatctgtcctgctggagccacagctgtctttctagagagaaatctgacagtgtccttcctgctcaggccccaccagttcctccccattgctcttagaacaaaacaaacctgattggagaccctgagtgtgatctgaagtctcctccacgatctggtccctgccttcctttccagtctttctggttttgagcatctcccccttgtccccttcactcgagtctctcagagctttgtgtgttcttcctggtctttcacatggcctttgggcctgtctccatggctgtgtaacagatcacctcaaaacttagtggcttgaaacatcagaaatttattctgtcacagttcaggaggccagaagtccaaaatcaaggtgtgggcagggttggctccttttggaggctctgagcaagaatctgctccatgtctctccttccactgtcatggggcttcttccttgtgtccctgtggccttgtgtctaagtttctcctttatcttacaaagacatcagtcattgaacttagggcccaccctaatccagtatgacctcatcttaactaatgacatctgcaaagaccccattgccaaataaggtcacatactgagattctgggtgaaggtgaattttgggcaaacgttatttgaaccactcactacactgtcatgtgccaggaatgtggaatcccctccccacttttagctaaaaccgccagaatggatttagcgttgtggaacctctagactcctcccgtgtgtgcacgcaccttgtatgcacacataggtgcacactgacaagtgctggcacacacatgcccagggcttcctctttctctcccatggtccctggtgaaatttcctgtaataccttttcatgccctccctccgaggcggggaggggtaccgctatctacaaccagctgtggaaaataccccgagaagcagtgaagggaggcagcactaaggaggagaggggtgtgggctgagctaggaaagaggaggttttaggaagctggcctgggggttcacttggaagaaaacctgttctcttcccaaatcttaggatgtctggtgggataaagccatccagtctggcctctccctacccgcaccgcctggcctcctcatctttgtattcccagagacaaacccagggcctgggagactgaatccaaacatcaatttaccaaccaatcaatccgtagagcagcggtctccaacctttttgacaccagggaccggtttcatggaagacacttttttccacagactggaaagggctgggagtgtgaggtggagaatggtttcagatggttcaagctcattacatttattgtgcactttatttctattattattacattgtaacgtataatgaaataattattgtaatataagaataataattattattacattgtaatatgtaatgaaataattacaactcaccataatgtagaatcagtgggagcccttagcttgttttcctgcaactaggtggtctcatctggggatgatgggagacagtgacagatcatcaggcattagattctcataaggaacatgcaacctagatccctcccatacgcagtttacaacagggttcacactcctatgagaatcgaatgccactgctgatctgacaggaggtggagctcaggcggtcatgcttgccttcgccccggggctcacctccgtctgtgcagcccggttcctaacaggccacaaaggggtactggtctgcggcctggggtgtggagacccctgccttagagcaaaagagttttggggtgtggtgagaataccttgcccgggtgaggaaggcttcctggattggaatgcggcgtccaaactgatacctgacgggcagcgagcactaggccaggggaaaggtctccaggctgccagaccgctgggcagatgatggctcttctgtccacggcacctggttggatgtcaggagtactgaggagtgtgtgtgtgtgcgtgtgagtgtgagtgtgtgcgtatttttgtgcagagcaagcgtgaaagaagccaacaggagccatacccatgagttgaaaatatcagaaaggggagctatgacctgcaagacacattgtgagtgtggtgtcttggccattgtccgctgggaccacaggaaggtcagggatgcacttctgcttggtcctacggctggcagttgggagatgcgggcgtggggagcggagcccgatgagtgtagtgtctggagcggactgggagcagctcggcctgggtgtccgaggagcgggcgggcgctgctccgggcgcccaccagggggcagtgctgccgggcgagagcgcggtgggctgaagggcgcggggctgcggggctcgggggtgtgggactagaaggcgcgtggctgtgggactaggggctggcgggcgcggggcgcggggcgcagggctgcggcgggggcggccagggcggcttttgcctcccacgcaggcaggagagagttcttgcgtgcctgcctatactcgccgccgggcatgtttccaggtgagcggaccgtgctgactctgggctgcagaaatgcgcccccagaggaaagctctgcgctttgcgggagctctttaaagccaaggttccagagaatggatttaccccaaagctgataacgctaacgcttctgccaccccaaggccgtgttcatgcatatatctatacgagattccctgaaagtgtgtatgtttcaggcccactgggctctgcctcttggtgactccactccaggtttcagtttggttggccccttgacggtctagatccctaacccccagatccaccagagctactgagaaactggggcaagcctccacagagacaagcgacttggggtatgtgtgggtatatgggtgtggatgagagagtgagcgagcgaaggagttcagcagtatagatgccagtagcacctacccttccagttgtgacaacctaaagtgtcccaaacattgtcaaatgtcatatatctggcgaggagagccgggagttgttcctggttgagaaccactgatttagagattgtagctttccttttccattgctgcttatgggttaagcctcacgtcttttccagaggggttgtattgtgacttgtacagcctcttcccggagatttctacccaccaaattgaaagggtcacaggccgactccgggggtgaagagcctgggttcaaccgaggaaagggccaggggcctcctttcctcctgtggcctcggctgcagcctgcgagctggggagaaagtagctgctggcctggccgggggtgctgcgctctgctcccagtttctctcttccaacagttagaacatgaaagctggaagcgatcctagagggtgtctagttcaacacctgccccttcccttaaagaagtgtttacgatgagaacactgacattcagagccctgaagcgtgtcttccagggctgcgtagcttttatgaggtagaagaccaggcccaggtgtcctgacttccagcctagagcttttactgctccatgggcagcctctctgagtcccctattaaaatgcagtccccctggagggcacacaccataaactagatgagtggctgcctaataaatgaccctgaaacttagtggcttgaaacaaaaataaatagtctctcagtttctctgggtcaggaatttgggagcagcttggctgggcagttctgcctcagagtctctcataactttcagtgagatgttggtcagggcttttgagtatagactttggtcaagaatcttctcttggccgggcactatggttcacacctgtaatcccagcactttgggaggccatggtaggaggatcacttgaggccaggaatttgaggctagcctgggcaacttggtgagaccctgtctctacaaaaagtacaaaaataagccgagtggggtggcatgtgcctgtggtcccaggtacttggaagacttgggtgggaggattgcttgagcccaggaggccaaggctgtagtgagccatgatggcaccactgcaacttcagcttgggtgacagagtgagaccctgtctcaaaacaaaacaaaaacccacaaaaatcttccacaaaaatcttctctaagcctcaattttctcatctgtaaaatggagataataacagaagttatttcataggctgttatgaggattaaaaaaataattcttttgtggcagagattttcaatttcttactctaatatcacttcctctttcttcctttgtaatagaagctccaatatttagctggaaagttggctgcctggaataaaagtctccatttttcatctttttttgtttttccaaccagttctgtctgaagacatgtatagaagtggtatatggcacctttcagggaactttctttaaaaaacagtatctccatttgctccttttatttgttgccctcctctactctgcttcctggaacgtggatgtgatggctggagctctggttgccaacttgggacacaaggatgagcatcatacccctgggatgatggagtgatggacaggaaggagtttgggttccagaaagttctgtgcaattgtcataccaatcttgcactgcctaggtgatagagaaataaaattaaacttgtttttttcggccgggcgcagtgtctcgtgcctgtaatcccagcactttgggaggccgaggtgggtggatcactggaggtcaggagttggaggccagcctggctaacatggcaaaaccccatctctactaaaaatacagaaatattagccgggtgtagtaacacacgcctttaatcccagctacttcggaggctgaggcgggagaatcacttgaacccaggaggtggaggctgcagtgagctgcactccagcctgggagacagagcaagccaccatctcaaaaaaaaaaaaaaaaaaaaattcccctcttgtgttttaaaaaatcgccctcaaacattctgctatccaagagaaataaacttttatcttggccaaacaggtattttgtgctttctggttcatgcaactgaactgaacatcctatatgcttacactgttagcaaatgcctggtagtcaggaggtgctcagtaccctggtaaacattttgatttcaaagctggggtcaaaccagccaaccaaatctcataacctggatgtggggagagtaaaggggacagccaggacagtggagaaagagctctggggtcaggagacctgggtcacagttgcagctctcctctctccacctcaatttaattttaattttatttatttatttatttttgagatagagtcacactctgtcacccaggttggagtgcagtggtgcaattatgactcactatagccttaacctcccagactcaggtgatattccagcctcagcctcctgaatagctgggactgtaggcataggctaccacacccagcaatttttaaaatttttttgtaaaaacagggtctcatcgtgttgtccaggttgatctcaaactcctgggttcaagccatcctcctgcctcggcttcccaaagtgctgggattacagatgtaagccaccatgtccagcctccattttattttctttaattgaaaggggctagaatagctcaggagttttccaactttttatggcagtaggaattgttcttcaaatggaaaccaatatataaaaaagatttaagtagaactttggatctatctaatccttttggttccatcccccagactgccttggggtgatcctcaaggctttaaaaggagcataatttgaaaaacacagaacagactgattctccaaattctttccaggagcaacagtctatgactttaaggggctgagctgagccggaaaacatggtcaggttttctagaatggccataatctggggtaagggtggtgtcaagctgcttcgaggtcctgggttcccatgaggcctctggctctaagtgtgctgacaaacctgtggcttcatcgcacagtgaagaaaagcacattaattcatagtcaggtggcctcaggagtcttcttttttgtagatctaggctatatatcacattgcattagccagaggtcagtagacatcatcaaaaacaacaggaacatgggaaatttcattttgctggtgctgcaggattgaaaatgtcagctctctctggctacctggtgaaggaattatgccatggctcaagagatggggatgaaaaccttagctcatcatttgaaaattgtgcattacagactttgctgtgaaatataagcattgctgtaaaatgcaaacatctctgtcccattgtcatggtcactgttcatcgttgaggtcaataatagtgtaatcactgggttatgtgaggacgggatgaggtaatacatgaacattcagtgacaggttattgactgtttcttctttaaagaccaagagttgggttttagtatttttcttactaagttgcaagaacttttggtaaggaagtgagccttttgaatacagtatttactgcaaaattttcccagtttcttgtttttaaattctggttgttattattattggtatttaacacacagatgttgaaagttttaagtagtcaaaactgttgaccttttccttaagaacagcaattatccaggtgtgtgccagccatccaggcatgaatgcctctgaagtccttttcaagcattggcttattgagtcctcataacaagccgaggtaggtactaccactgtgcccattttatgatcaaggcagtggccctgggtacattccccacctagcacatcccccgatgccacatgcccattggtcacagaggctgaaagataccaatatcctttaaggagaggcagcaaatgaacatgcaaacggggacaggccttggggcgaggtggggacacagaatctcagtgctagcctctgtaaagtttgaaacagccttgcagggacttctggtaagccaaacagggtgtgacattctgagaaccacagataagttcttttactttcttataccccatggccagaaaaaacagataagttctgaggcctacctagtctggaagaaaaataggaaagaagtattaaccagagcatttcttgattccagattctcactgcctcagcctggagaccaggatggcacccccaagtcctttcaaagtcacctgcaatggaaactctcttgcttttagtttttcccaggacagtcagccaaccaaccactgggtctggcaggttgtgctgtggaatagaggctggagccctgatttgagcttgcagaggactggtcctgccatgtaacagctttgtgagtttgggcacatgaaattgctttgtaaactacaaagggctgtgtgtaaaagcctaaggtgccatgaatatcagactggtgacaagtgaccaccttcctgatgtagatactgaggagcatttttttttcttttttaccatgctttcatctgcagcattgtttgatgactgccccaaaccctccaagtcaagtgaatacttctgagcaggctgtaaaatccatcattgggccacttttcttcttccaaactgtacacaacccacactgaatacctgcttccctctaggcctgggcacttctgttccctttgcccagcatacctttgtccctccccacattttcaacacttgtacttctatttttcccttaggacttcattcgtgtatcacctcctccaggaagcattccctgataacaccctggccacatccctggaggctggtttatatgcccttcctctgtttccatagtgacttctattttctacttaccatgaggcacatcacactgtatctgtctttaccactggatacgtcttgtttattcttctatttgcaacgttctagaatccctgaatatttgacaacgtatgctttccctctaccatatggcatgagtgagaccagggttggaacaatggtgcgtgcctgtacagtggtatgatttaagctacttgcttggcctctctgtgtttgcataaatggaagatgagactaatgataactgagacttaatatggtagctgtgaggactatgagaatccactgagagcggagtgaaccgtgcttggtacagaatagtggtaggattatggaattcaaaacgaggcagctgttgttgtcatcagtgtatggctggcctggatccatgatactgatgtgacaccattatttatattgtgggtcagattcctccattcttgtgggtaagttccatgagggaaggtctttgttcagcttacagctgtatctctgtagcttagaatagtgcctggaacataacgggcagttggtaaatgctggttgaatgagtgaatgaatgaggtaccaagagaccccatgggatgattaatcttgatggccagtccagtgtcccctggcgtccaagacttcttttatgccttataatctggctagtgtgtgtctccaaagagccttcatttagcccaaaccagaggttcccaaacatttttaccaactgtcttctttatcataagtttgaggaaaaagttatttctcttgaagagaaagcaagaaggaagagaacgccctgttttaacctccagtgccaaacgcagcctgaaacacacacgcccacacagctcctgttcttgggagagaggcacggtaaagtggcatctggaaaaaaaacccagttcaagccaaatttgtgtcaatcccttctctgtcagcctgtgcttccaagcacggtataccaagatgacagttccacccagctttctgctttttcttctttccaaagagaactttgattaaaaagaatcttaagatgcctggaaagaaatttctagcctacagaccagcattgtctatgataactttctgtgatgacgaaaatgctctgtaatgtgtgctgccactagttacttgtggctgttgagcacttcaggctggtgtgcctgaagagctgagttttcaatgtaattttaattaatttaatttagatagccacatatgattaacggctacggagctgggtggacgggacagtgatgtgtggctgagcggagagggctgcaaagggggtctcagataggggtctgaccctggaagtcttctcttggccctttctgggggactggaatcaagaaaaggccaagagcctctcagtgctttttaacataggtgccccttgatcagcttagaataagaaatgaggtcacattccttttaatgttcaaaccacatgacttatgataagggcgtcatgagccctgatcatgcctcactttcttctctcaccgagggggatctccctcctggaaaaatctcacacactccctccctggggacttccttggtcctggggcgggcagtgtcattactctcatcaccaggagagaaaatcaggaattctcgttctcggctgctactgccgccttggtcactaggtgtcaccagtggtcctgcagcccaccaaaaggaaggcggccacaccagttggcaggtctggggacaaacctggaggctgcggtggagggagaagttggcttcctgagggggtgaaactgacactcacaaccgtactagatgcaccagatcaagtgtcgtggtgtgggggaacgtgggcgatagggttctgggacatttgccgtgtgactgtgacccgtgtgacccgttttggtcgtctaagggaatagtttctgcctacatcctgctgaaagaagtggcttttggaatgcctgccctctttctcaatggaccccagcaggcagcccccttatgaaagggaattgtttgatgtcagtgctcatcccagagcctgagtgcttaatattccccgtggtcacccacttttgagggaaagtggcttcaaagcaggagtggtgacagacctggctcctggtccccacactgctgaccacttctggtgtgactcaaccttccattcccacccccaactcccgcccagcacctgtaccagagagaaaataagacctgctacacattttggtaactttttgctcttgacagtaaaataagattttactttcctgacagctcagagtatagtaggggcttaaatacttgctagctgactgaatactagttagagggttattaatgtaggtaggggagaactgcactttctttccaagtgagattcaataatacgtatcttgcccccaacttcctggagtcggaaagagtatggtttcattatagcctggcctccaatcagctgtgtaattgggtatgtcacttaatccttctgagcctcagtctcctcatatacaaaattagggcgaaatctaactttcagatggggtgatggttagttttatgtgtcaaattggctggatgatggggtttccagatatttggtcaaacattattctgatgtttctgtgaggtaagagcatttctggatgagattaaggtttaaattagttaatatatatattttttgagatggagtttcactgtttttgcccaggctggagtgcaatggcatgatctcggctcactgcaatctctgcctcccaggttccagccattctcatccccctgagtagctgggattataggcgcctgccatcatgcccagccaatttttgtatttttagtagagacagggtttcaccatgttggccaggctggtcttgaactcctgacctcaggtgatccacctgcctcagcctccgaaagtgctggggatataggggttagccactgtacctggccatggatttttttttttttttgagacagggtctcaatctattgcccaggctggagtgcaatatggtgatcatagcttgctgcagccttgaactcctgggctcaagcaatcctcccacctcggcctcccaagtagtggagattacaggtgcatgccaccgtgcctggctaacttttttattttgttttttttttagagttggggtcttgctatgtttcccaggctggtcttgagctcctgaccccaagtgatcctcctgccttgacctcccaaagtgctgggattacaggtgtgggctaccatgcccaaattggtagactttaagtaaagtaggctccctccataatgtgggtaggtctcatccaatcagtggaaggccaaaatagaacaaaagaaactttctcctacttctctagcagatggcttcagactacatctgcaacatcacctcttcctggttctacagcagatggccttcaggctcaaactggaatatcagtgactggctgggtctccagtctactggccttgactggaactgcagcatagactcttctgggtctctaggctgccagcccactccacagattttggacttgcccattctccataattgtgtgagccaattccttctaatgaatctcatctattcttttcttttcttttcttttcttttcttttcttttcttttcttttcttttcttttcttttcttttcttttcttttcttttcttttcttttcttttctttctttcctccctcccttccttcctccctttctcccttcctcccttcccttcctgtctgttttgctcttgttgcccaggctggagtgcaatggcatgatctcatctcactgcaacctctgcctcctgggttcaagtgattctcctgcctcagcctcctgagtagctgggattacgggtgctcaccaccatgcccagccaatttttttttgtatttttggtagagacagggcttcaccatgtttgccaggctggtcttgaactcctgacctcaggtgatccacctgccttggcctcccaaagagctgcgatgacaggcatgagccactgtgcccggccagtaaatctctttctatatagtctcacgttctgttggttctgtttctctggaaaaccctaatgccgatggctatggggattaactaaaattatagtgtaaaagcatctggtacagtatccaaccagtaccaaagtatctagtagatgcccaataagagctactttgcaacccagcttcccagttttcttggtcaattattaaatagattcctcaggacaggaagaatacttcccctagacctggaaatccgtcggctagtctgccaatgtttgtcactttcagtggaccgccgggctctgtcccattttgtgatgcaaacatttcccagggtgcctctctccctcacctggctctagtctcctaggtctcagaacaagaaggcatgtgcctttctttgttccctgttcactaattgcttctgggtgggtaagagtgggaagaagaagataattccctcctcctcctccttatcaatagtctccattaagccacacatagatgtggtatctgaaaggtgagagggtgggttcattatgcttcttcagacacataagacctcttttcaactgagtgcttcttaccaattgatggcaatcagtagaattatttttagcatatctgaaacctttctttctcctagtacactttttttttttttaacagaaatgcattgtcttgaagttctggaggacagaagttcaagatcaaggtgtcagcaggcttggttccttctgagggctgtgaggaagaatctgttctatgcctccttcctgacagcaggtggtttcctggcaatcattggtgttccttgggccatagaaacattaccctgatctctgcctttattttcatatggtgttcttcttgggtgcgtatctgtatccaaatttcccccttttgaaaggacaccagtcatattggattaggggttcatcctattgtggtatgaccacaggttaactaattacatctgtaatgatcctatttccaaataaagtcacattctgaagtacagggggttaggacgtagcatataagttgtaaggaacccaatgcaacccctaacaggtgctattttagaattctcttcaagtggttagttcttgaatctttctgacataatcctagttatcttcagtagctttattgttattaggtaaaacaatgggttccaggctcatcttgcacatttctgttccaggctcttcttgcccagacctggactcagccattcctccaagaagccctgtttgtgtttatttttatagtttggtgagaaattgtatttcaagaccataatctgggctctagggttgctcactgctaccaggttggctcttgtttctagctcttttcagtggacaggtttgaaagtcatgtgaggggctaagagtttctctctgtaaatggttcttaatacacaaagttcgttagcccttgctgaccttaaaaatttcccagaattggcggggcatgatggctgatgcctgtaatcccagcactttgggaggctgagatgagtggatcacctgaggtcaggaggtcgagaccaggctggccaatatggcgaaacaccctctctactaaaaatcccaaaaattagccgggtatggtggtgggtgcctgtaatcccagctatttaggaggctgaggcaggaggatcacttgaatctgggagggggaggttgcagtgagctgagattgcaccactgtactccagcctgagtgacagagcgagaccctgtctaaaaagtaaaaaataaaaaataaaaaatagtttcccagaattgttctccacaggaaagggtgtcagctttgctgtctgagccaaactctggttgagttgacaatgttctactgacctaaatcctcccattgaagctttcgttacaaatagcacaatttcttcacctctgctccccgtggccacatggctgccacacagggctcaagtagaggctgtctcccattttcagggggtgaagttgtccctggtgacagctcgaatgcccccgagtctgtttatcacctgttcatgtacccctggcccactgtgtgctgcctactctggccctgccacgctgttccccctccccttcagtgctcccccagctcctctccagttcccacagcctgcaagagccacagtccatctcagtcttcttggattacttaggccttcatgtgtctcagttcccaaatctgtgaaatggaaggaatcgtacccacctcatcaagctggaaacttaaatgagtaactacctagtataaggcttagcccagacaggcctcatcaattttagcttttattttttattttattttatttttttttgaggtagagtcttgctctgtcacccaggctggagtgcagtggcgtgatctcagctcactgcaacttctgcctcccgggttccagcgattctcctgcctcagcctcccaagtagctggaactgtaggtgtgtgccaccacgtccaggtaattttttattattagtagagatggggttttaccgtgttggctaggctggtctcgatctcccgacctcaggtgatccacctgcttcagcctcccgaagtgctgggattacaggcatgagccgccgcgcttgtaattacatgcgtgagccaccgcgcctggcctgagtttttatttttactctagcccaatagtgctccattctagctgcatattagaaatacctggggaggttttcaaagaaaatagtgatgcttagtccctaccctaggagattctgactgaattggctgggcacttcttccttcattcctaagtgacagtggtgcaaggcggtcgtgagcgtgagcactcccctcaatgtttgggagtggtgaagggtggttagggtttaccccagaatattagacatctcttttccccactacgggaattcctcacagtccatctttccccttaggtgagacccttctccgcgctttcctttgttcttgttccaagttctgttggccactctcagttggcagacaaattactatcacgttctcattcagagatagtttatttgcttgcagtgttttccttccccaccatttccagggcatctccacctttcatacagaaaatggcccatcgaagtattttcctaaactaaagagaagtcttcttcttgtctctgatgatttttttttttttttttttgagatggagtctcactcttgttgcccaggctggagtgcaatggcaggatcttggctcaccataagctctgcctcctgggtgcaagcgattctcctgcctcagcctcctgagtagctgggattacaggcatgtgccaccacgccaggctaattttgtatttttagtagagatggggtttctccatgatggtcaggctggtctcaaactcctgacctcaggtgatccgcccgcctcggcctcccacagtgctgggattacaagcgtcagccaccgtgcccggcctctgaagatgttttatgacaataaccacagtcctttttttgtatgcttttaattttagaaattaacgtaatttatataggtgcagacaattcacaattacaaagatatcaaaccaacctaagtgcccatcaactgaggagtgggtaaagaaaatgtggtatatatacaccatggaatactactcagccattaaaagaacaatataatgtcttttgcagcaacatgaatggagctggaagccattactctaagtgaaataactcaggaatggaaaaaccaaataccatatgttctcacttacaagggggagctaagctatgtggacacaagggcaaacagagtgttatattggacactggagactcaggggaaggaaccgggagagggctgtgggttaaaaagtacatactgggtacaacgtacactactcgggtgaggagtgctgaagtctcaggtttcagtgcaccagtcacttgaggagtgtacgttgtacccaacatgtagatgaattctacacaattcatcatgtaacaaaaaaacattagtaccctggtattcctaaagtatagaaaaaaaggataaaataaataaataaataaataaataaatgggtgcagaattataaaccatatgaatgtaccttaattttaaaatttccttttgctgaacatttaacatttctaattttttgatattataattactgtaataatgaacacctctatgtacacatttgtactcacatatctgatttttttccagtgtgttgaatcgtggaagttaactttctggattaaagattatgtgtattgttacggcttttgaaatatattgttgccaaattgccctccagaaaagttgtactgatttacagttttatcctctgtcatggtatatctttctttgtgtattttttcaacattttgcacatttttacaaattgtaaaatatatcacacatacaaaagtttatgtgacatatacatacattttaaaagactaaacaaaaataaaaaaccactgtgttctcatatctcagctgtaatgaactaaaacattaccaatatctttgaacctgtccaaggggtgactgcctccttctggtttgtccagaactgtcctggttttagcactgaacgtcgcaggtcctagttaaccatttagtctcagcctggacagctgatcaccgtacccctatgtgcttctctccaaatctacctcctccctcctccaagggtatcctgtatggacttctaaataatgtactctgaggtttttactacataaatggaatcacatgatatgttccttttgtgagttgcttccagccagcattgtttttgagcttcatcctattgatatctatagccgcagttcatatagtttttctgctgactgccatccatttgatgaatacatcaccgtttctccatcttctgtcaataaacattgcagcttttgttgctgtgagctgcacagctctgaacagtcttatctgtctcctggagcaaaggtccaagagtttctctaggttattttcctaagtgttaaattgctagaggacttacataacctcatcagaagtgccaaattgttttctaaagaagttgtgcctatttccatccactagcaatgcatgaaaatagctgttttccacaccctcatgaagcagtgtctgactttgaaactttagccattgtggttgctatgaaatggtatttcattgtgggtttaatttacatcttactgattaccagtgagattgaacctcttttcagaggtcgattggcaatttctgtttcctcttctgtgaaaggcctgcctgcattgtttgctcatttttctattgggccagttgtctttttcttacagatttgtgggcccactattttttgtttttatcaaggtaaaatcaggttaaattggctttcagaatcagtctgaagggatgaaaatccaaaggactacacctatttaagggatggacatatcaaaagacagaatgaaaatgcttgttacacagtcccttcagtcttctttatctgcagatggctaatattttatgctttaagaaataaaaccaactaacattatcttctgctccagtggttctcagcagcatccacatcatctgtagactcattaaaatgaaaattacttggccccaccaacagcctactgaattgggaactctgaaaagaagaccctgcaatctgcttcaacatccctgcagtgatttggatgcatgccaagtttgggagccactgttctacattgtctccttgtcccacctggtggatggagaactgaccatgacctaccattctacaggtcatcatcatccttccacctacaaatagacattagaaagtgttttttaagaaaaggacagatatttggggccccaagaatgggatttttggtggcccagctcagattgcagggtattcagtttatggactacttatcctgtcaacactctaatgtcaaaacttggacctaaccagaccattctctctgcccgaaggaggcattaaaaagaaaaaggcaaaaagatgggacgtcctgcctgcgtggggagatgttttcagggatgatgtccatgttgttttcttcgggtgtgtgggttgagataatttctctgcttttggtccaggagagcgttccttgtcctctcccactctggcgaggctggggcagcttcctctgaggctgttccccagtcaggcaccactgagccggtgccagtaatgagcagtgaccagaagtctgctatttgctccagggcctgtgtcttcagcacttaggttgcccttctctggattccttctctttgaaaccacccaggatagctgcatctcaggtgactctcatggctcactgaggggcagagtcagccacaatctttattttgttttattattatttttttgagacaagatcttgctctgtcactcaggctagagtgcagtggtttgatcatggttcacgtggccttgaactcctgggctcaagcaatcctcctgccttagcctccccagtagctgggactataggagtgtgccaccacaccaggccaattacttttatgtttttacattttttggtagagacagggtctcactctgtcacccaggctggagtgcagtggcataatcaaacctcactgcagcttcaaactcttgggctcaagacatcctcccacctccgcctcccaactggctgggactacagttacatagcaccatgcctggctatttttttttttttttttttttagagacgagcatctcgctatgttgcccaggctggtcttgaactcctgcgctcaagtgatcctcctgctttaccctcccaaaattctgggattacaggtatgagccactgcgcccagcccacactgtattttaaagagtcttgattgtgcctggttagcatcacttctaatacagctacatgagtctgtctggctgccaagctgagaaactccttggatttgcaggaaagtgacttcaagcatgctggctgatgaggaggtcttcctcatctgtgcacatggaggtggggtggagggattgagtggtgcttatggagatgtgaaagtcaggaactgctttgacacctattctcagcactttctggagtctcttttgaaacttaaaatgacccctttctcttaactgtttcctgcacacacagcagctctcaacctcagcagcctttcgtgtacctcccccatgtctccaactagttggaccaggaatttaccctgacccaagttaggcctctcggcaaccctgccccaggagtctggactgagacagctggcctgggtcagcgtggcagcctgcgtcagtggccgtgtttcttgtcctgtggactggagcagtggagggtatgtgggatctgtagagtgagaaaaaacgaacagctgtcggaggagcagggagtcttgacaactttccagttccttcctgaagtccagctctataattatattttgggtcctgtgtggagagatactcctgcaccatttgaatacatttctgaagatgctagatcaaactgtattctgttacttaaaaccaaaagaggcctaatgcacacaggagtaatctctaagaaaaactgttgggtagagttagatcttatgaagcgctggaactgcacagcggcttccccagcacaccccctttctcccctggaggctgcatccactgtgctgagtggccacgccgtttaatgctgtgcccatcagcagagggacccagctaccactcgatttagtaatgcatttcctttccttaccacagtagcccaacacatttgaggaaaaagaatcatgaaaattttgtcttttccactcccccgaacccccgcctttgaaatcaccaccacagctgctaacagaagcgtctttatgtagaatgtgttttgcccttttggagaagacaaagaattattaaaagagcagacagctgcttgtactggcaagagaatgagaagagcttgtcagcactcactcttctacccttcctcagctgaatcaccaccgtcttcctctttacctcattttgctctctctttgcctggtccaggagcatagaggccatcaccctacccttttgcctccaactctgggaaaacagaacagtctaatctctctttctctggttaaacctgcataagtctcaactctaatactttaagcaagtctgacagttgataaacttcaccttgactcataatcatcctgtcaatctctctctttaacaaacatacagatcactcaatgttccaagattcatgtaaaaagaagtcttttgttttaatcactgagaacttccggagaaaagaagaaaggtgagtatgaaagtttctggttattttcctgtatctctgggaaaatccatggcagctttgtatgctgaatttgctagttactaaattgtgtgatttttttttttgagacagggtcttgctttgtcacccaggctggagtgcaatggtacgatcgtggctcacggcagcctcaacatctcaagcttaagtgatcctcctgcctcagcctcccaaagtgctgggattataggcatgagccaccacacccagcctgaagtatgtgatcttgggcaagttatttaatgttttttaagattccctttcttcacttgcaaactgggataaagataatgtctatctcatgggaatgttgtgaagattaaatgagataggacaatgggtctcaaacttggctgtacattagaatcaccataggagtctcgaaagtccaactgccagggagcacccagaccagttaaagcaaaatttctgggtgtgggagccagccattaatatttttgaaatctctgtagatagttccaatgttcagctatatatgagagacagtgagatgatactaataataagcactcaatgagtaattgcagcttttattaatataattaaaaattgagtgagagtttcccaaatttaatagactgctgaaattgagggcttacagggacccagattcattttttcttaaattcatctatccaacaatgactgagcatttactatgtgctaggatctgtgccagactccccctctccagttgatagtaaaaatatcatattgccttcaagatgaaactcaggttctttaggatgacctgtcctccccatcccttcacaccctattggctgtcagtgctatggcccacatgctggtaagttccagccgctctaaactacagggtcatttcaggccctcctgtccctgtgcctgtcctcatgctcttccctgtgtgtaagatgtccttccaacacatctcccctgcctttccacctggcctctctcataggatagaattcctgatatggaacctgaagaaaagatgggtgccactatgatttgaatgtatcccccaagtttcatgtgttggaaacttaatttccaaagtcatatgtcaatggcatttggagatggggcgtttggggggtaattagggttagagaaggtcatcagggtgggactcccatgatgggactgttggctttataagaagatgaagagagacctgagctggcaccttcttgccctctcgccatgtgatggcctctgccacattataatgcagtaagaagaccttcaccagatgcagccccttgaccttggacttcccagcctccagaactgtaagaaatacatttcttttctttataaattacccagtctgtggtattttgttctagcaacagaaaatgaactaagacagatgcccagcactgcctggcagtctccacccatcctctcagatgaatgagctggccactgtcctatcagtctcaagattctttgagcatcctgcagtgggtgcatgattagttctcagggtcttctttctgtagaagggctgggcaactctctctttctgttttctgtcaggcctcactctggtggaagactgctcatgctcaggcaggcttcctttcctttatcttgcttaccaggctctagtgttccaggatcctgtggagctattccccagggcccctcaaagggagagaacccttcctcttgaaccattcacaggagcagggcagctcagagccattacttggaacagccggagaagctggaggctggatctcctgtggccaccacatgaaatcccatgaggttggcagccttgggggaataacatgactttatgaccatggataatccctgaagactgttctgctatctccagaggagaaagacctccaacagctctgcactgcagccacctaatgggtgaggggctgtgatggctgccacagctgtggcaaattctgctgaagtaaagacttccattaggaatcttctcaccccttcctggctttgagctgacctccagagtggccctgctgagaaagttctagtcctttctctccatctccagctctgtcaggaggtgcccccagtgtatagatttgcatgtcctcttactgaaccttcagagctctttctgtaggggctggctaggaagatcttactcaatgttcccagtacacacccacaattccacccacccgtaattctggcacttccaaccccaggcctgtgccactgggtgaagtcatcaacttttcaggcaggcacagggtgatgccttccttctggcttggtgagggcatccatccttcaagattcatattctatcattggcattggggaaggggaaaggaactactatttgaattgttacatgttatctcacttaaacttttgaaaaaaaatgtagtggataattagccccgtctttcaaaaaaggaaagagatgcttcccaagatgacatggttggaagaccagttagatcttgctgtgttgcaaacagtccccaaattagtggcttaaaacaacaaccagttatttagctcacagttttagagattgtctggctgtcagctggattgttaggagtagggcacaactggccacatgattgctctcatgctcctacaggctagcctgggcttgttcacatggcagattggtaggattccaagaggaagagtggacaggtgcaaggcctcctgatgcctaggcttggaactggcactgcaccacgtctaccataatctgttggccaaagcaagtcatgaggcctgcccagatgcaagggtaggtgaaatagactccaccactagatggaaagacctgcaaagtcatattgcaaaggggagcacggagagataggggtgagaattgggtctacttttgcaatcaaccacagttgttaagtggcagaagtaggattttatttttcaatgatgaaaatagcatatacacatgagaaaaattcaaatggtacacaaaagggaaaatgaggatgagaaagtctcatttttactcttgggataggaaaacacattctaagtcctactctccacatgtaaacaccattaagggttttgtgtgtattttgatacaattattttgtacatatacataaatgggggtccaatatatccacgatgctatagctcactattttcacttaacaatatagctaagagctctttccatagcagcacaaacagaattactccattcctttaaatatctatatagcagtcgactgaataaaggtaccatgttttatgcaactactttccctactggtggacacataggttgtttccagtttttgttgtgacaaacaatgccagagtgaacaacctctaatgttctctgtatacttgtagattagattactagaagtggaatttctaggtccaacatcatattcaatccttgatctgatccgttctcagagcgtatgctctttccaagaggggtctctggttaacaagtgtttgtctagctttttcttcttatttatttattttttttcagacagagtcttgctcttgtcacccaggctggagtgcagtggcacgatctcagctcactgcaacctccgcctcctgggttcaagcgattctactgcctcagcaccccaagtagctgggattacaggtatccgccaccacacctggctaattttttaatttttagtagagacggggtttcaccatgttggccaggctgatcttgaactcctgacctcaggtgatccacccgcctcggcctcccaaagcgctgggattacaggtgtgagccaccgtgcccggccaaaaaaattttttttttcgagatggctatgtttcccaggctagtcttgaacttccaagatcaagcaatcctcctgcctcagcctcccaagtagctgatattacagatgcaagccactgtgcctggctcctggaagctacgttagaaaattcaacatagccatggaccactgtgcctatatgcacacatgtgacacatgcgtatgatctctccagacctcttccttcttgggcaggtttgggagtctagagccatgcattattaaacccttccaagaagatccagattagttgtcttttctacttcttgctttatgaatatttttttgagatacgtactactttattacgggccaatgagaaaagaatcctagtaacaaatattaacatacagacgatgggttgcatccaagtgaagccctaatgtataaatgagcaaggatttcataagctgtgcaaatagagataagcataggagaattaaatgaatcatcacacagcaaataatagtataggcctattgtcacattgaggaattctattacatgaattccatctttgtacacagcaactttaacagttcatgaacattaagtacagtagcaaatatgcagtgaagaaatttcttacaactgtattattattattttttttgtccaggcatggtagctcatgcctgtaatcccagcattttgggaggcctaggcggaaggattccttgagcccaggagtttcagaccagcctgggcgacatagggagaccccatctctataaaaaaagaattagccaggcttggtcgtgcatgcctgtggttccagctacttggtgggctgaggtgggagaatcggttgagtctgagacgtcagctgcgatgagccatgatcatgccactgcactccagcctaggtgacagaccctgtctcagaaacaacaacaaaaacatatttttaaatctttaatattatttttgcagttcttcatggatctgatgcctacatgctatctgcctgggtgccactggagctctgaattttacataccaggttatgtatggacttagctctattatgaacagcaggttggtgacatcagaatctggaggtggcatgcaagcacacccagatacctcactctgtttctcacagccctcacttatgtccctgagtagatgaagccaataattctgcagaagggaacaaacagcaggaggcccatttctgtgatatgaggatcctgcacttagggctgttcagcggataggttacaagggtagagttccagataatgcagtttcataaaagtaattacttaatggtttgagttctttatagaagtataggcatgtgcctcagacttcaaagcaggaagtacccagtctcccatctgtttcttaataacgcagatactgctgttgtgaaaaaggcagagttctggaatattcccactgttatagctcaaggaaaaatgtattttcctatggtacactgaagaaggatgaactcaaaggctaatcattgactagtcacattaaagtgttcatttcttcttagtgcccctttcagacagaagtgccttggatgaaagttaagagacctggggcctgattcttcagcccgagccagtgagcaggacacagagaagcacttgtgccctcatcagaagagtttcatgctgaatgagctccgaggagtgctagaggaattaccctgtgattgcccaccagcttccccttgttctgggatctgagaggaggcaagataagcctccctgtaaaatcctcacacctgcttagagtctgccccatgctggctatgctgccactttgcccatctttcccccacactagacaacattaatccatgatgatagctattccagcagagccagaatctggtttcagagtctttttcaagatagctctgtaggcagccactttggatcatccagtcagcatgagagaggagacttgtttgcagtcctgcttctgagtgaatttgtctaaaagcaattctaaaatcaatgtccagagaatagggttaagaggacattggggaggggaagggcagagtcagggctactggagaacatagctattacttaggtggggctgccccatggcagcccaggtataatatgccagccttcagataggcctggtgatctcttcccattgtatttccccactgtgtgtgtgtgtgtgtgtgtgtgtgtgtgtgtgtgactgtgtatccaagacccaagataactggctggagctgtgggttcagcctgcaaccatggagcaagagggatccccctgatggagatcaaactgatgtccttgattgccctagtgtggttttcaaccagctaagctagcttgtgaccagcagagaaaaataagggctcattgttcaaagtgtggtccgtggccagcttgttggcctcccttgggaatgtgttagaaatgcagaatttcaagcctcattccagagctactgaaacagtgatttagaggccaggtgcggtggctcacacctgtaattccagcactttgggaggctgaggtaggaggattgcttgagggcaggaaaatgagaccagcctgggcaacatttcaagatcccatctcttaaaaaaaaatagccaggcatggtggttgatatggttaggctttatgtccccacctaaatctcatcttgaattataatccccataatccccacatgtcaagggagagagcaggtggaggtaattgaatcatgaaggcagtttcccccatgctgttctcgtgctagtgagtgagtgctcacaagatctgatggttttataaggggctcttccccctttgcttggcgtttctccttcctgccaccttgtgaaggtgggtgctttgctttcctctttgccttccaccacgattgtaagtttcctgaggccttcccagccacgctgaacagtgagtcaattaaacctctttcctttataaattactcagtcttgggcagttcttcatagcggtatgaaaacggactaatacagcggtgcatgtctgtagtcttagctgctggggaagctgaggtgggaggatcgcttgagcctaagagattgaggctgcagtgagctctgattgcactgctgtactccaacctgggtgacggagcgagatcctgtctcttaaaaaagagattcaaaattgaaatcattttaacaaaccatgcaggtgattaatatgcacatgaaagtttgagaagtactggcttagaaaagtcaccatgtagcacagtaacttcaaactgattagaattttaagggtctactatgtgcccagaaatgtgctggactttggtagataccagtgaagtatgtgacaggctctgtctctgaaagtagcttggtgagtgtaaaggcaccatgcagagcacagactggaaagagaaccctgtttttgtgctgctttttattttcctttttcctctgctgttaattattttatccttatagtgatgacaaaaaaattcctttaactcttatgttgccctgcattgcataggccctaatacccaactttcagaatttctctcaattctcttggtggctttggaggcttgtctcagtcctttcactcctcatcctcaccatctgtttctccaccacctttctgcgggccccaggtttggaccaaggccttgcttttgcagagcacactgatagggcatttttccacctcagctattgctgatttgcttattctattgaaaacggctcagaatcttaggcaattcataaggcttggagtggaattgcagagtggaacctgcttactgataagaagagacagtcttattcaatagatccttaattggcggggcgggggtccttcacctgttctgagatctattaaacagctccttgggctgggtttcccgtctatgagcgtgctgaatggccaaggcacagatgccaactacattcactagatgacatacactattatctgtcttctccatcttcggcaggtttgccactctagactaccatctcgggagactgcactgcactgcccagcaccaagtaatgcaagatcagttattcctactacgttcattgctatgggtcagtttcaatggtgtaactgtctgatatgtcctctcaacatacagaacagcgattaggagaagcaagacagggtgtctctaaagtctgtcaagtgggtaaaagatggctgctgaagtgggttccatttgccttctctgtcctctttcaggccattagcttgtggtatggggcacctcacactgccatccctggcttctgccaactgccaacattcaggaaggcaggcttctttaaatctgagtctgtggattaattgcattttcttagacactgttaagaatctgtcagcatttccattaagaaaagattaataagatgacaaattgctagctctgtcaatgctcttttgtgtttttttccccctgaggattattttgggtgaagatttccactcttgaggcattgttacacaaaactatatgatcctccactctgcaatagaatagtcactaaccccatgtgactactttaaagtaatttaaaataaatgaaagatttagtttctcagttacaccacatctgcaaccttcctttattcctttcttctcctttgtgtgtgtgtggtttttttgttttttgttttttttttgagacaggatcttgctctgtcactcaggctggagtacagtggtatcatagctcagtgcagcttcaaactcctatgctcaggtgatcctcctgcctcagcctcctgagtaatcgggactacaggtaggcaccaccatacctggtgaatttaaatttttttttttttttttttttttttttttagatagggtctcactgtcactctgtcaaccagtctggagtgcagtgttgtgatttcggctcactataacctccgtctcccaggctcaagcgatcctcccacctcagcctctccagtagttggactatgggcatgcaccaccatgcccagctaatgtaattttttttttttttggtatcttgtagagataggttttcaccatgttgcccaggctggtcttgaacaactgagctcaagagatccgcccatcttggcctcccaaagtgctgggattataagcatgagacaccacacctggccaattttttttttttttttttgtttcaagttttcacagtgttgcccaggctggtctcaaatccctggcctcaagcaattctctcacctcagtctcccaaactgttggaattacaggtgtgagccacagcacctggtcacctgcaacatttcaagtgttcaatagtcacgagtggctagtggctacagacaaaggacatttctatcacagttcttttagacagtgctaagagtggcccagtagaatttagaagaaagacatggtcttctttgtcacatgggccttagtcctaatctcatttcttctaagtagtgagatgactttgggcaagtcatttgacttccctaagggctcagttcctgcgtctgttaatggggtacttctacttgcataacagggtccttctgagagttctggcatcagtgctcaattggcaataacctcctttgtcctgcacctcctgccaaacaacctatttctcttaatccctagatcacctgtattactagaagctcattttgagcttgaaggtctggccaggagcagagggaatcacctttccctcaatggtagagaggggaatttgtgatatcctgagattctaagattgtgatacctgcccaggcagggaggggataggctttgcttcttctgcacaccttgcctttatctcaactcatttcttctctcagtcactgcctgaaatgaatgagtgtgttgaaatgagtaatatttggagtttcaaatgaataattgttacataaatcattagttctcaaattttagtggacatcagaatcacctggagggcttgtcaaagcacggatttctgggctccacccccagagtttcagggtctgcaggtctgatgtggggcctgggaatttgtgtatgcattcccaggtgctgctactcctggtggcggtctgcagtgtacctgagtcatggaagctggagcatttttataagcaaagattaaattgtatccttgctttacacagaggatacccagcacgttcttgagggcatgagaattccttataacattgttataattgtgatttcattgtcaaaatagaaaagattcaccccgattgtggattatagattatctttgtttccttcatttttttttttctttttacaaacccttgtatcaagaagtgctgacttacaatagaggacggcgagggagctgctctgctacatacaaaattcccagccagaagcaggtggtctaccagtggtttaccaccaggttccccacaaaactggcagtgcatgaatggcatagatgacggtctccaagccaactgcagcatgtagatttcagtgcctgcttttgcatttgtatgtacaatcacattattaccaagcaatttccagaactggcaacatttgacttttgacctagtgtttctcaaattgtctcttccctttctggtgataccatggctgtagctggacccctgggccttccctatccctgctcctgttttgttactcccaggctacttggtgggaaagtgagacatttcattttcagggcatttttggtgggtgagcgtcgtaatctacgattttgcctgtagagggcagcagcaccaagaacttctggctgcattttcagtgtcaagcgtcagcctggtatctctctgttccttccatccctcttgtcaccttgccctttttttctggaagtcacatctaaaaaagatatttgcaaagtaccccggttgcctcggcaactggtgctcaggaaggcggcctggggtgtagcagcggtgttggctggacgcccacctgctttcagcgtggctgaggggactgcccccaccccacagcctggccacctggcaatgcccagtgactgtgggaggtggctgtctgggaagcctgttctcgctgccgacttctggggctttgctcgcacatatcctcttttgctttcttgtccccaaaatgcctcttcccagaaagaatctgagtcagtctctcgtcattagattagttcctgccaaactacggcagatgtcaaagcagctgataggaagattatgattctccctttcgcaaccccaacagaaaaagcggagtaaagaacccgagcggagaaggttgtcaggcaaagttccgatgaggagggaagatggttctattttggcagctcagtaaccatattcccattccctctgccccattcaacatggagatgcaggaaggagtcccccttaactccctgtctgaacagcccaggatctttggatttaatgttgccttaaaacaagaacagtttcctttctttcaatagacaccccttgacttggcccacatgcttgtggatgtaatggattttctgaggagtatttttcctggtctagtgctgtctttcctgcatgaactcactcatactctctcagttgcacacacgggtttcaatttatcttcttcctgtcagacagcacctgttctgtcacaagtgagcgataactcctgacaatttcttctcctgaggctcacagggaaggaagttctctgaacctcctggttgaggagccactctgcagtggtctcaggagttcatttggtttggaaccctcctagtgtaaccctactcttgtcccggagtgaaccctttctccttaaggagatggcacaagatcttagacacatcttagatccaagaccccagacaaaatggctcagttcagaaaagactcaagtcatcaggatggtaaagtgggctcaggaagtcctgcagccacctgggcatcctttgtggggaagaagtcagcagtggccccaggaaaaaaaactagatcaaatccagggggtcagggcagaagtggcctggccttgtgttgtgccaaacccctattaacctcaatagggaaggcactaggttcaggaggctgaagaagagactcagagccagcaaaggagacatggtgttttttttggagatggagtctttctctgtcacccaggctggagtgcagtggtgtggtcttggctcactgcaacctccgcctcctgggttcaagcgattctcctgcctcagtctcccaagtagctgggattacaggcacgtgccaccacacccagctaatttttgtatttttagtagagacagggttttaccatgctggccaggctggtcttgaactcctgacctccggtgatccctcctgccttggcctctcaaagtactgagattacaggcatgagccaccatgcccggccaatgtgggggttttattaggggctcacatacaggggagagagtccagtggtggtgtgctggacaagatagccaccttacaaacagtccagtggcagcaggctgggcaggaaaaccgtaactgcttgcaaacagtgtgcagtttaaatagcgttttcacctaacaccctccccttaatgacctccacctggcaacctttgtttagcccaaaactcagggcctcaatcccttgtatggcccgcattccatgggatgggtggggggctcggatgttcatcactgataaggtatgaatctccaggttggccatgccggattccttagcttgaaacacacattcagatgtgtctgccatacagggtcatcctcagggtctgcttatgttattgctatcaggtgtgtttaccctccacgcagcatgtatcatgcagcctgtatcagccacaagtgtccaggtgggagagcaactggtgggggcgctgtggcagcgggcaggagggagggaggctgactggtgttggaatgcctgtgcctctctgttgactgccttttccctcctgggttctacttctctggtctctcacgccaggcatcccctaagtctttctttcccatcagaactttcctcctttcacactgaggtgcaaatggttgataacagttgagagtgacagttcctgagagctttctctgtactaccgttttaagataattgtttataatagaaaatgtcaatcatgtagaaacagaatagcataatcgactcctgagtagccatcatccagcctcaacgattaacttacagcccacctggtttcttccatacacctagattacttggaagcaaatccaagccatttcttttcagtatgtgcagaaggctctcttaagtcccaatgtgaccatgccacaagctggtgaatgacatctggtggcaggatagggtccatgctactccctggattagaacaggtcctctgcaatctggtgctgacatctctccacttcccaggagtccctacattttcagctatgctcaatgttgttctcccaaacatcacatttaaaaaatccaccacttagaactcctgacctcaggtaatccacctgcctcagcctcccaaaatgctgagattacaggtgtgagccaccgtgcttggcctggtcttgcccttactttcaatggcaaaaacagcaattacttttgcatcaagctaacactattttgtcttcctctgtggacagtgaagtggttgagaacagggactgagacttatgttccctggtgccacagtgttaagccctgtatctggcacatcacacgtgttgaatccctgttgttgaatgcgtgaatgaacacagggcattctgcacgatcacttggagaaactcgagatgaactccttgtgccagttacaatttccagagagatcagggtgttaggctaaatcggattcttaatatttttttccatccaacactgctgtgggttatggaccacttcctgagtggagggctgtctatggctctcacatggaagaacacactggaggggttggagagggcaactggaagtggtgggggctgggtttgacacaagtagtttgaaaaagcctcctattgtttcaggtgcccttcaggtacagcctgttggttgagaatcattgagctggagagataaggtgctagggcaaaattctaggcaatagtccagagatggacagggaatttgaggatgctgcgcacagacacagtcttccttccatctctcaggctcttttgaagaccatccctgaattagaccaatgagaatgaatggcactattttccccacaaaaaacgtgttctttttcttcccccatgaagtctagtggaactgatactgagattgattacacatttgagtgagctcctgggaagaaacagggaagttagaatgtttacaactttccctgccctgattcatttcaaggacatgggtcattagcctctgccagcagacagagataggtgcataaattccgaccattttgtgatcaaatgtgggcataacgttttttgatccttgaggtgattgttattatttactggaaattccattattaaattccagcagcaaaagtctttctcttcttttctcatagttctcactaattaaaacctgctattagtcattgtctggctagaacttaactactgacctaacctaagccttttaaacaagaagctttttatcacagttcttcagatactctggcttgtgagtggcaaatcctcaaccctgacacccatgtgcatcacggctcgctgtgaaaacacccttgttaacatgtaaaacacctccagtgcattttgactattgcagcaaagaccattcgcaaaatgaaaaaaacagaccctaatatccagttctgttgcttcatagtgtgacctcagaaaagtaaaatggcctatttagttctcattatcctcactgacaggagagactagaacatggcagttaggttttcctttgcatgccaatgtgacaggctggtagcagtttcttggaatgttctgctgagaaaggatagtgggaagtggtgctgtgtttcattgctgatgggatcccatgggtaagggatcatgagtggcaagatttaccaagtgtttatcaattccaggtttgcaatatcttaggcctgtccctgtagagagatacagagtgtggttaatgttctagttggccctaaaggcaaaattgaccaggcagtagttcagtatttcagtatgttttttgtaggtatacatcatcacagcctccaaaagatgtgggaattccgaggtctttggtgcacttcagaatttttaatgtcctggatgaccctgccacttagactgaaataaagtccttcttggtatgtgcttattaaccaggccaggctattagattcccaggtcacctggtatattgctggattagggtaggtggggggacgaagaccagtggcatcccaggaagcaatgggttttctgatggatgtagtattattagagtactaagacaattaggatatatgtaatctttaagcttagaaagtattcagataacccaacaaagaactcatgttagaggttttctgaatcttagagaggttatataagtgttcaaagtcacatgaggtggggaggagggagctaacatcttttaagagcctgttataagccaggcactttatggagttataactcaatctttccaacagccctgtgggggtagtaatatagtaatagtattacataggcaagaaactggtgattcagagtcatggaataactttcacattgttgcataaggagagacacagaaagtcagtcttcccaacagtctggattctgatcatagtacactttgtgtcaagacttctgtctatttcctaacttcccaattcatggggaccccagtaacttgatacttctgacaaccaggaagtggtattaaaaaagacccattcgtgataaagatgtttgtaagccaactgtcagtataaataattgctatgggaattttgaagatattaaaattgaaaagggtttttaagccatttagaagtatttttttatattcaagtaattgacaagctaatcaaaacttctttattaacatcaggtttcccaagtacttctgtaggtcatttattgctcaccaacttcaagaaatatttaaaagccataaataagagttatgctttcttttaaaaggctaaggactgactatacaagaggttaatttggctacctagacaaagtaaaaataaggaagagtggacttggtgcttccaagtgagttgaggatgatagaaaacaattagacctgctcaatttgcatttcaagtctgtctctctgtccagagaagggtttgtgtcctgaagaagataaaaccaacatcagtaacagggaacaaagccatttgggaaataagatgataaaactatatggaaacaacttaagtggttgtaagtctcaagaccttgggcaatgacccggaagggtagtgagacgagaactttgtgtgtgagagctccagacacctgcgtgttaaccctcagcgtacagaggaaaacaaagacgagcaaaacaaccacagtcttcaagatggagaaaaatatttcacgagtatactgaagaccagctggcttgacgttggttgaggccaaaatctagagaacgttattaaaacaggctccttttttttaaaattatacttcaagttctagggtacatgtgcagaatgtgcaggttttttgcataggtatatatgtgccatggtggtttgctgcacccatcaacctgacatctacattaggtatctgtcctaatactatccctcccctagccccccacccctccgacaggccccagtgtgtgatgtctcctccctgtgtccatgtgttctcattgttcaactcccatttatgagaacatgtggtgctttgttttctgttcctgtgacagtttgctgagaatgatggtttccagcttcatccatgtccctgcaaaggacatgaactcatacttttttatggctgcatagtattccatggtatatatgtgccacattttcttaatccagtctattgttggtggacatttgggttgggtccaagtctttgctattgtgaacagtgccacaataaacagacctgtgtgtgtgtctttatagtacaatgatttataatcctttgggtatatatccagtaatgggattgctgggtcaaatagtatttctagttctagatccttgaggaattgccatactgtcttccacaatggttgaactaatttacactcccaccaacagtgtaaaagtgttcctatttctccacatcctctccagcatctgttgtttcctgactttttaatgattgccattctaactggcgtgagattgtatctcattgtggttttgatttgcatttctgtaatgaccagtgatgatgagcttttttcccccatatgtttgttggctgcataaatgtcttcttttgagaagtgtttgttcatatccttcacccactttttgatggggttgtttttttcttgtaaatttaagttctttgaagattctggatattagccctttgtcagatggatagattgcaaaagttttctcccattctgtaggttgcccattcactctgatggtagtttcttttgctgtgcagaagctcttgagtttaattagatctcatttgtcaattttggcttttgttgccattgcctttgatgtttcagtcatgaattctttgcccatgcctgtgtcttgaatggtattgcctaggttttcttctaggatttttatggttttaggtcttatgtttaagtctttaatccatcttgagttaatttttgtataaggtgtaaggaagggatccagtttcagttttctgcttatggctagccagttttcccaacactatttattaaatagggaattgtttccccatttcttgtttttgtcaggtttgtcaaagatcagatggttgtagatgtgtggtattatttctgaggcctctgttctgttccattggtctatatatctattttggtaccagtaccatgctgttttggttactgtagtcttgtagtatagtttgaagtcaggtagcataatgcctccagctttgttctttttgcttaggattgtcttagctatgagggctcttttttggttgcatatgaagtttaaagtactttttccaattctgtgaagaaagtcagttgtagcttgatggggatagcattgaatctataaattactctggagagtatagccatttttaggatattgattcttcctatccattagcatggaaagtttttccatttatttgtgtcctctcttatttctttgagcagtggtttgtagttctccttgaagaggtccttcacttcccttgtaagttgtattcctaggtattttactctctttgtcgcaattgtgaatgggatttcactcatgatttggctatttgtctgttattggtgtatatgaatgcttgtgatttttgcacattgattttgtatcctgagactttgctgaagttgcttatcagcttaaggagattttgggctgagatgatggggttttctaaatatacaataatgtcatctgcaaaggagacaatttgacttcctcttctcctagttgaataccctttatttttttctcttgcctgattgccctggccagaactttcaatattatctgaatagaagtggtgagagagggcatccttgtcttgtgccagttttcaaagggaatgcttccagtttttgcccattcagtatgatattggctgtgggtttgtcataaatgccttttaagatatgttccatcaatacctagtttgagagtttttagcatgaagacgtgttgaattttgttgaaggccttttctgcatctattgagataatcatgtcatttttgtcattggttctgtttatgtgatggattacatttattgatttgtatatgttgaactagccttgtatcccaggtatgaagcccacttgatcatggtggataagctttttgatgtgctgatggattcgttttgccggtattttttttgagggtttttgcgtcaatgttcatcggggatgttggcctgaaattttctttttttgttgtgtctctgccaggttttggtatcaggatgatgctggcctgataaaatgagttagggaggattccctctttttctattgtttggaataatttcagaaggaatggtaccagctcctctttgtacctctggtagaattcggctatgaatccatctggtcctggactttttttggttggtaggctattaattattgcctcaatttcagagcctgttattggtctattcagggatttaacttctttttgatttagacttgggagggcgtatgtgtccaggaacttatcaatttcttctagattttctagtttatttgcatagaggtgttcatagtattctctgatggtagtttgtatttctgtgggatcagtggtgatctcacctttatcatttttttattgcatctatttgattcttctctcttttctttgtctggctagtgtctatttagtctgttgatcttttcaaaaaaccagctatcggattcgttgattttttttttttttttttgaagcgtttttcgtgtctctatctcctttagttcttctctgatcttagttatttgtcttctgctagcttttgaatttgtttgctcttgcttctctggttcttttaattttgatgttagggtgtcgattttagatctttcctgctttctcttatgggcatttagtgctataaatttccctctacacactgctttaaatgtgtcctagagattctggtatgttgtatctttgttctcataggtttcaaagaatatccatttctgccttcattttgttatttacccagtagtcattcaggagcaagttgttcagtttccatgtagttgtgcagttttgagtgagtttcttaatcctgagttctaatttgattgcactgtggtctgagagactgtttgttaagacttctgttcttttgcatttactgaggagtgttttacttccaattatgtggtcaactttagaataagtgcaatgtggtgctgagaagaatgtatattctgttgatttggggtggagagttctgtagatgtttattaggtctgcttggtccagagctgagttcaggtcctggatatccttgttaattttctctctcgttaatctgtctaataccgactcccactattattgtgtgggagtttaagtctctttgtaggtctctaagaacttgctttatgaacctggctgctccttgctgggtaaatatatatttaggatagttagctcttcttgttgcattgatccctttactattacgtaattcccttctttgtctcttttgatgtttgttggtttaaagtctgttttatcagacactaggattgcaacccctcctctgtttttgctttccatttgcttggtaagtattcctccatccttttattttgagcctatgtgtgtctttgcacatgagatggctctcctgaatgcagcacactactgagtcttgaccttttatccacttgccagtctgtgtcttttaattggggcatttagcaggtttacatttaaagttaatatttttatgtgtgaatttgatcctgctattatgatgctagctggttattttgcctgttagttgatgcagtttctttatagtgttgatggtctttacaatttggtatgtttttgcagtggctggttccagttgttcgtttccatgtttagtgcttccttcaggagctcttgtaaggcaggcctggtggtgacaaaatctctcagcatttgcttgtctgtaaagtattttctttctccttcacttatgaaacttagtttgcctggatatgaaattctgggttgaaaattttctttaagaatgttaaatattagccactctcttctgccttgtagggtttctgcagagagatccgctgttagtctgactggcctccctttgtgggtaacccgacctttctctctggctgcccttaacatgttttttcttcatttcaaccttggtgaatctgatgattatgtatcttggggttgctcttctcagagtgtcttatttcccgaatttgaatgttggccagtcttgctaggttggggaagttgtcttggataatatcctgaagagtgttttccaacttggttccattctctctgtcactttcaggtacaccaatcagaggtagatttggtcttttcacatagtcccatatttcttggagtctttgtttcttttcgctcttttttctctaacctcgtcttctcactttatttcattgagttgatcttcaatgtgtgatatcctttcttccacttgatcaattcggctattgttactactgtatgcttcatgaagttcttgtgctgggtttttcagctccaggtcatttatgttcttgtctaaactggttattctagttagcaattcatctaacctttttttaaggttcttagcttccttgcgttgagttagaatatgctcctttagctcggaggagtttgttattacccaccttctgaagcttacttctgtcagttcatcaaactaattgtccatccggttttgttcctttgctggtgaggagttgtgatcctttggaggagaagaggcattctggtttttggaattttcacctttttgcactggtttcttcccatcttcatggatttatctacctttggtctttgtagttggtgaccttcagatggggttctaagttgatgttgatactattcccctctgttggttagttttcttcctaagagtcaggccactctgctgcaggtctgctggagtttgctggaggtccactccagaccctgtttgcctgggtatcaccagtggaggctgcagaacagcaaagattgctgcctgttccttcctctggaagtttcctcccagagggtcacccaccagatgccagccagagttctcctgtatgagatgtctgtcagcccctactgggaagtgtctcccagtcaggatacatgggggtcagggacctgcttgagaggcattctatcccttatcagagcttgaatgctgtgctgggaggtctgctgctctcttcagagctgccaggcagggatgtttaagtcggctgaagctgtgcctacaaccacccctttccataggtgctctgtcccagagaggtgggggttttatctataagtccctgactggggctgctgtcttttcttcagagatgtcctgcccagggaggagggaatctagagaggcagtctggccacaggagccttgctgagctgcggtgggctctgcccagtttgaagttccctgtggctttgtttacactgtgaggataaaaccacctacttgagcctcagcaatggtggatgcccctccccacaccaagctcaagtatcccaggtcgagctcagactgctgtgttggccgtgagaatttcaggccagtggatcttagcttgctgggctctgtgggggtgggacctgctgagccagaccgcttgattccctggcttcagccccctttccagtggagggaatggttctgtctctctggtgttccaggtgccatttgccactggggtatgataagaaaacttctgtggctagctcggtgtctgctcaaatggccgcccagttttgtgctagaaacccagggccctggtggtataggcgcttgtgggaatctcctggtctgtgggttgcaaagactgtgcgaaaagtgcagtatctgggccggagtgcatagtacagtccctaatggcttcccttggctaggagagggagttcgctgaccctttgtgcttcccaggtaaggcgatgccctaccctgcttcagctagccctccttgggctgtacccactgtccaaccagtcccagtgtgatgaactgagcatctcagttggaaatgcagaaatcacccgccttctgtgttgttcgtgctgggagctgcagaccggagctgttccttttccaaaacaggctcttaattatcagaacaagaagtgttgatcaccccagcaggctttgggttttccaagaacacaggccagaattatctcatactcttttctagtacattatactttggtaattatgtctggattttagcagtgagagtcttaaaatagcaaacactttaaaaattattatgggccagattttatccaagcatcttatattatctcatttaattatgtcatccacatttgaggtagatactattattttcatttcatagatgaggaaatcaaggccctgagattaagacatcctatgtagggcccatatgtcatgtcctgaggtaattcagtatgaagggcccatgtgtcatgtcctggggtcgattctccaaatggtaagtaatggtactgtgactcagcatcagttattgtatcctgcccgagatggtaaatctgcccgttagttgggtgacttttcaaagcttgggaaaatgttatagaaatacagagataatgaggtaaatcaaatttgtagtattaatactttggtgtggtttaggaatatgttttatgatcatttggatattttgtgtatattttaaggtgttaaggaatccagcatattggataatctgattgcaatttgaaatgtgtaatttttattagactcatgatactaattttaaagatgtcatagatttttattaggtttgtaaatggtattgaaatgtttattataacccagtttactaaatttggtttcatttattacattaattgcttagaaattgattaagtgcatagaaaattttgttttctaggattctgtcaggcttttggagtgcttgagaaaatcaggtctgttaaatgtgtaaaatttaaaatgcctgagggaatttaattaactaaatttataaattggattatttaaaatttaatcttttatacttagttaactgaggtaatcaaagaaaaagacaccatgaattcttatttatttattttttaagatggagtctcactctgttgcccaggctggagtacagtgggacaatctcagctcactgcaactgcctcccgggttcaaatgattctcctgcctcagcctccagtagctgggactacaggtgcccaccatgacacccggctagtttttgaatttttagtagagatggggtttcaccatgttggccaggctggtctccaactcctgaactcaagtaattcccccgcctcagcctcccaaagtgctgggattacaggcatgagccaccgtgcccggcctgaattcttattttcatataaaatattagatttataacaagacttttaagttgaacttcaaggcttaggcaacactagtcctttgaatttacactttcaatatatttaattgattaaaattcaattgctttggagtagtcccttgagtgtacaatgttcccacagatatttaaaagctcaaatgatattagtaagcactcaataagtggtagttacagatggtccctcagtcctgatgattcatttatcttaatgatttttgactttacaatggttcagaagcaacgcactttcagtagaacgtcaataaattatatgagatcttccacactttagtataaaataggttttgtgttagatgattttgctcaactgtaggctagtgtaggtgttctgagcaactttaatgtagactaggctaaactgtaatgttcagcagattaggtgtgttaaatgcatttttgacttaatattttaacttataggcttattaggatgtacctcatcataaattgaggagcatctatataattaacagtaactcttgctttccctgttgtccccttgaatctctgcaattaaacttccatgaccatgtatgtatttcttgtgaccctgagggtcctgattagccacaagtaagaattactccaaacaaaacaatacttctttgagtcaataattttattactattatttttcacactgaggagacttagttacataaagtgatattctatgaattgattatcagtagtagaagcacaaaggtatggacagtgaaacaagaagaaacaccctttatcagaatgaagtccatgtgacagaagtacatacttcagacagcctatgtacaaataagtagagcttcctgtctatgtacagacatattcacagagaataaactgacatagtatcaccatgtatctcatcatccagtgaaaattacgcataataaacacaacacatacaaaatgacagaagtaatttggaagtgcatccactggatttttgtagggatgaggataggggttacaatgctcctttaaaacggaggcgaacaaaggaagcatgagaccacgtctatcctaaaaaagatcctttacaaaaatggcattctgatatttttaacataacctgtctaaaagacagtttatatgttatagagcaaatgtctatgttggcgtcaacgttgacaacattttctttgttttaaccgtatctgaagaacaaaagtataatttctcttgcttttagtgctagcagcaacttcactgaatcaggaaggtagcttttgctattcttagctttgatggctttttaagtatgtggattgcttgatggtggaagctgttgcttccggagttttttgacttgagcagaagaaatatcaaggctagatgcagggtatatatgtgtactttgtgttcagggttcaatagcgcaattcagtaactgaggctccctcttccgaatagagtctcagccctttagagaaactcttcagaccacaaaacagcctctaacagaggaatatcactggcccttggttcagataccctttctttagggcaatttggccacttaagcataaaattgatggggttgtccagtttagtacccatgtttactctatatggacaatttaggtacccagttctggtggatttctagactattaagtgctttttagtaattacttttactcaaattacataaaagggctgggtatggtggctcattcctttaatcccagcactttgggaggccaaagcaggaggatctcttgagcccaggagtttgagaccagcctgggtaacatagtgagactccatctcttaacaacaacaacaaaattagccaggcatggtggcatgtgcctgaggtcccagctactcaagaggctgaagtgggaggatcgcttgagtccaggtgtttgaggctacactgagctatgattgcaccactgcactctagcctgggtgacagagcaagaccctgtctgttaaaaaaaaaattatataaaaatttgtgatgaagttgaaacattaaagtttttagttgtggggacatctttatatatgtgtgtgtaaacagtgtaccatactaggttagaaattgtgtattttagcggagaggaggaaaataaccaccaaagcattatgaaatctgctgctttacatgtcctcccaaggaaggttagtaatttaggcataaggaattattgataaattgtatacctctatttcccatttttataagggaacttcttagacccatcctatatttatataaaagctcaaacacatcctacatttcccaggtatatgtttgctaattatctatttcattttccatatgggtgaactttgctttatataacaaaatggattcctgaaaaaaatctacaattttaaaataatttccatgtagtattagaacttgctaaagaaactgtaataagctattttgaaaacgaagactgcttttgtgaaatgaataatttctttgattttcaaacagttttattaaagcacacatctaaaatgtataagtagattaggattgcctagaacaataattgtagttaataaaaaatagaacagataaactccaatttacaataaacaatacaaaacaggaatgactcatggactgcttattgattgactatattcagaagccctgaatatatgtattattggtattttatggctttaattaagacagttgtctcttatgaagtactataaagtgcaatattaaaaaattaaaaaacccaaaaggcatccattgtccttcagttttattctgataagaattggggatttgtttaattaaatggcaagaagttatctacccttaatttatgcatgtaatttcatccttaaaataattttattcaggatttcagactttttttacttttctgttttttatgacatgattttaaaaattagtattttcttttggttagctgagtattttggagaactgttagtctccaaggccttagttacttatggatccattatgaaggaatatgcaacccaatatgtaagaatgcagaaacaaattcccatccttttggtgaaccctggcccatgagatcaatcagtagctttacaaatcctatccaacctaccacacaaaaggatataaacacactgcagtactggttaataagtggagatccaatcatttatcccagtttcatatttaaaataaaaatattgattcctcttgataaattagtgggtaagtacaggcccagagttttggagtaatctaaagtggtgtctccccaattttgagttctttgtgagtctgagattatgacctaatgaccttaaaagcagtttgtgaccttgacttcaccagagcttcatggtcatgctgcacccagtatagttcaacactgttcagacagtgattatcattagtcataaggttccatcatttaagaacaatataaagaacttaaaaaggcttagtagagaggaactataaaaattattaagagggttaaagactcaaataaaaatctaaagataattttaattgaaaataggtaaagagtcacatagcggtaacttccaactatggggcaaagagtgaagagtgcccagatgcagttactttttgccaaaaaaaaaaaaaaaaaaaaaaaaagttaagtcattaagtggatgggtttgggttaacttggagggaggcttttcttgatgctgatggttgttaatcattgagctgggtcacaccagcatctatgctgggatctcccccgtaagaggactgtcctttggattagcgtgataggctagacaaaccctcttaatggaattaaatctttggtggaagcctaggcaaactccatggcattctttcagacttagatatttgtctgtttttaaagattttattaggttttccagtctgtcaatgaatgatctggtagaagtgctttggcttagataatatggtgctctacacagtccctcactgttcgtacgctaatttgaaaacagttgcctagcctgtcgtaattgcagggtcatttttgcctctcgaatgctgcctgacttgtggatttgcttgtcctttgtagctgcttcttactctttcttaagaaatctgtccctagccatattaagggcctctgtggagtttgggtggttctgagcaaggctggtgccccatgtgtgaggaaggcatgcaaaatgccagtgtgtacattagctggggggagtcattgtggaaaacagattccttccagagcaaacatgagtgtgcctgtgatttctacagacgactacatgctccgggtgattacatgccacaacctgcgcaggtccaaagctcctggtgaaaaaggaatattgccatggtgtaatcataagtaatagagttgagctggctgtgagtagttcccttattgcttttcttgtttgctatatatttaaaaaatatgaagctctgagattaaaaatgaaacgcaaagacagaggcagaggcagagtcagggagctaacagtaaatagaaggtggaatagggcagggttacttttcttacccaaggtcttcctgagattattttttaaaaaaatctaaaactgtatatgggctcttgtaattggctaaacatagcctgatatttgttactgttttaaactacatagggatatatttccacgtgacacttgttttcttggaatcctaggaaattaatatctcctttcttccctttccttattattctattttttctcctacccctctcttaatgacaaggccttacctaataattgaagacagtattgttgagacaggtataggggttgaggaggtatcttttaaaaatattaagccggatcgttaaggaatatgtggcttagcaagagtgagcactgacttctatgcatgctttcaggagacagtagttttctccagaaatcaccctgagaacagcttcactttgtttcttctggaacacagctgccacctataatagggccacctacttaccagaaaaacaatctgtccaggtgcaaggaggcatagcatccacataatctcgcgtgtgtgtgggggtgtgggtgtgtgtttggtagatgtggggaggaaagcacactgccatgttctgaaatgcctgccatcagacccatgttagatagtccaacgcagtaatttctgcagagcatttaatgcaacttccatcttcttcagctctatctggccagccactctaccaggtgtcttttctttggtcaactttttgttaaagtggtctgggggtgggctccctttgtagctcatctcttctctcactgttccagaggcctttaaaagctatgtgcagtggtggggagtttgccaactctctccctgcccaggaatggatgtacattaacattgtcaaatgtctaatcagcgaggcagctgcgttttgctgaaagggctccaaaccacctgattcatgtcttccctataaaataaattatgatggcccttgtcaggtgacacctgttagaagccttacaaagcatttttcctgaatataaaacagtctccgcctctttttataatcttctgggcaaggctttaggacattctgctgcatctgccgagggtataaacaaccctatcccttagtccctgcatatatcattgctctgtcactgcctgactcagtttaggtcctgggaagctgcataaacaccatctgatcttcagcttcagttcatcaggatctggtcaggtgcagagggcagctggagttggcatgggcattctcagatgcaatttaggagtttctatttgggaattgtcagtttgagccaagctgctctgctgccttggaagtatgggggagggtaggcggtgacagcaagcaagacctgctcggtttgctgtgaataaatgaaatcatttgcgtgcaactcatttattttagattgattagtacaatgttggctcttgaattgttgatatcttttataccctgctccagagaagcaaagagagtatctgcagtctaaatttttgctttgtattttctgttgtgtattctttgcctctatatcagcattagggatatggctgaccgatttccttaaggctataaattgatattcttagggtgggaaaatatgggtacatatgtgtatatttgtaaatatatgtgcatggaacaaacaaccttatgaaatcaggaagaaatgttccctttggtttgtgtgcatgactttccttttccttgactttggcaaacttgatgctccctgctttagaatcctgaatgtgatagggtcagagggtgatgatgtaagtcatattatatgtgtacatatagatctggtataaagatatatatatatatatatatatgtatatatatatatatgtatatatttatatatgtatatacacaggcatgcaggaaacgagttagagatgacctgttttggaaaccacggtgtggaaagttcttataattatgccaatgatttgaatggtttaaagacccattgttgaactctgtacacatctctctgaatttaccctggctcaacacataaccacttacagacacagaaatgaagggaaagcaagggcaggctgtggaatcacttgtgtcccatccagtgagggagcagtgctgttgtaggtcaggctcagtgcacatgactgatgtgggaacggggcttggaaattttgtcttctcaaatgcaacttcacatgaaagaccacaacacttcctgtgaagtggagctccgagacaagcaaagggcaccatagctgctttgatcagccttcactgtaagctgggaataaatgggagggagtgaggaggcagagggaggatcaggaataagaagagggcggcatcaggtctccttcaacttctgttttacatggtctgtttgcagttgagtcagtcacctatttaaaccttatttcaaacaacgcaccagtcaataatataaaattcacacaataaccaacttggttgcccttcaagaaatacacagggaaaacaactggagtttttaaacgtaaagttcacttcctcattctttcactctctaaggaagcaggacaaattcttgccccagtacaaagtcctgaccttgatgaatgagattcattcccattaggtggcaggttccactcagcgcctctattggatggtgtttcaatgtcttggaaggcattgtcccacatctgaagaccccaatctgccgagttggagagacttgaaagccagcctccgactggcagccatcttgatttcttgttttcccagggggcctcgggtttgaagtgctttttacttctgggtgaagaggaatgatgggcatttcctgttattgccatgctctgtggggtgagctgaggttttctggaaggaatactgagcttgatctggggctgtcaggttacctttcctcttattctgctgtgagttctgcatcctgtcctcttatgttaagaggtatgtgctcacaacaaaatcatagcaggcgtcaatgacagaatagattggagataggaacacatatggtgaaatttcccatatgccatatgtaccaacttagacgtaggatgggtacagaataatgaaccatccttgattcaatttttcaactgattttaaggaaagcatgacttggagaaaagaaaagtgctctacatagttttccattgattcagtttgcctattttttcccccttgctggctttattttcgactgacatagatctgagaaaacacacaaggtgtcatacagaacttgggggcgtggaatattttaatttcatgcattcaatgtaatgttgagcaaaatcaagaaatcaaattgttggagtgaatagcttgaaaccagtataaggaagctgtcaaataccgtgtactctaaaacttagacagaatcccagataaggtcttgatggaagaagagacatagatgttacaagaactttaaccaaagcctggtcctggtaccactcgacctggcactcagaaaccttcctggggtgcactgagtgtgcaaatgcctttccaagcatcgctaagttgcctcaacccaagcagtgctgatcagagttaagttagtgctattgggaataatgatttcttcagacactaaagccctttatgactacactggaaaacgttttaaagaactatgcccttacatcccattaggtggcaaggcccactaagcacctttactggatgacttcttattgcacatctaggctctcttggcagcccttagcatcaaaatatatctacatgacaatcacagctaaacttacccctcttcttttgatgataatgggacatgcgctggaaaaatacaggttcagtttatatagtcttgctgtcctagaaaaagcactaatttggtttgtagtcatattttctacttgcatgctgggacaatataagaacaaaacaaaacaacccaaccctggttacctccccacttccccaaaccaagccacccagcctgggtttttacctctttctgtcctaagtaccctgagtttcttggtcagggtactctggtggaggtgggcagatagtctctctgtttggcttgtaggaatgttttggaaggctcaactcagggcccctacagaccttctccactaagccctcctccctgcaagctatttccctaaaccatctaccttactaggcaggatcacagcaagtccaaggtaggctgaaggtcacagcaatgctacctttgtcttgttggttccattagttcacctcttgtacttaagaggtaaagcccagactgcaagttgatgcccctcttcaaataagtactataaatatactagagctatccctgaaaagatgcatttgtacttttatatatatctgattttatatatatatatataatttttctttgtctttatttacaggtatgtactaatctataggtatgcaaggagaggtatagtacaggaacaggcaggatttgtgtgttcatgtgcgtatatttataatatgtgtatttatagatatatatagcctgtgtccttgtttgcatcgactgtacctccgaccagcgaggtgtacttgtcagtggtgaatagggagaagccctgtattgacggttctctttgtcttttacatgaagtcatttcagtaggcagggtggaagcagcctgtgaagtgaatgggcccagtgtgaatccatctctcctcaaattcaccaaggagggacacttggcacccagggctgtgtgccagctgcctcttctcaagaggtcaaggagcccagagcccagagtgtggagggaccattcatgctgctggtgcaagatatggcttttcctgctagatggagacggggcatgtaagaattctgtcttctaggagaacgctcaccaccaggaacacaaagtagaggccaaacatgatgaagcccaggattttgttcattcgccacttgcagagggcgatagagaggatgacgaagagcagcatgatgaagagaaggacgatggcacagaaaaggccattgctgctgacagccactggctggaatctgtgaatgacggtgtacaggagccagggcagtgggagcctgtgcagaagtgaagcagggcagaggggagtgggaagacaagggagtagtcagacacgttgaagaaggcaaatataacctattattaccttctcaggaactctaaactgaaaagggtgtcttgttaggttcactatgactcgggcatggttggcccaggaaaccactttataaggaaataagactttaaaaacctttatgtcctgactgaattcagaacagggagaacagttagacaacatcaaagacatgactgctgtgggtgatttctacatttgcgaatttgactggaaattattttgtttccttcctagttgagattaaaatgttgctttcagtcctaaaaaggtgaattccaggatttgcacagggtgaagggagcaggcaggtgcaaaaaaggcacagaaatgagtggtgaaaatgaggaaaaaattaaaaaatggagacaaagaatagcaatgacttaatagtctaaaggcaagtgaaattaaatgatggtggttgggggccacgatacaatatcacaggctgaagtttattctgggaaagatgttgacaattgtttgatgaaaaattggtctttctgaaagatttaaggaaggcagtatcttacatttgtgatgtgtgtgtttttcttaaaaaaaactttattatatatttttatacctgttttctcccttttcattcaccttttaaaatctgaggatctcttgtgtttcctatcgagagtggtgatcctgaaagacctcaggagagctagtttccactacaccacaagcattgactagaactctgggaaaggaagatggctggaagtgcaaggctcagggaacatgggcatttccaagtggctggtgataggcatctggctctacccatcagcctaatgacagcatggtggctaaggagatacctgcttggctagctgagctttctgaatgacaaaagctaagggaggttcagttttggcctagactcagggtgtgggaagaggaggtactcttttgaaacattacattcttcaaaggaagagagaaatgatgagggtgaaaggggcagtgagtttactcatctgcctcctgtgctggagagacggcattggaaggcagagcccgtgcattgtggatctttgaaattccaggcctggtacatgcagcccctaactgggtgcatatgttaacctgggccaagctgaagtgattgatgtgactgccttgtggggatcaataccggcactttgcccagtagagtctggccaggaggtgcttctttctgtgaacttgttggggaggggttccaagcttgggaacaaggggtaattccagttcttagcaggagggggcagccttggcatcctggggtcagcaatgaaaagtcagaaaatggaaggggagtgcctgagagtgggggtgatggcaaactgagagccattgacagggacttggcctgggaaactcttttcccatcccttgtgaagaaagaccaaaacccattttattcttattaaaacacacacacacacacacacacacacacacacacacacacacacacactctcacacttctagtgaagttgagtttaatcgcactataaatggcttgcaaaaacctttcgggggaaaatgacacttttcatgccttttggtctattaattctatcgtcaagaattaagtataaaaataactgaaaatgcagattaaactttactcagaaaatgatcatttcagtgttattttgaataataaaaagctgagtatctctaataatctctaataacagggaactagttaaatagtaaataagtaaatgtaatgttatatagctgtttaaaaaatcacaagcttagaatgctacaggaaaatagccataatataattctaagctaaagatgaaagatgcatacatacacacaaatagcaatgtaatttcaatcatgtgaaatacacaagaatttcaaaaggttggtgagttattgatctttaagctttatttttcttttctttctttttcttttcttttcttttttttttttttgagatggagtcttgctctgtcgcccaggctggagtgcagtggcgtgatcttggttcactgcaacctccacctcctgggttcaagcgattctcctgcctcagcttcccgagtagctgggactgcaggcgcacgccaccattcgtagataatttttgtattttcagtagagacaggtttgcaccatctgggccaggatggtctcaatctcttgaccttgtgatccgcccacctcagcctcccaaagtgctgggattacaggtgtgagccactgcgccctggagccttatttttattttctaaatctgtgagtatatgttaattttagaagcataaagaaaatgctggcaaagctatgaagaaagtttcacacttaatatattgcaatgacatcactcagtatattgtcaaaaatgttgtcagctggtataaattcttgggaaagaactttttggaaaagaaatgtacaagacatgtcaatacccattaagatgttcaaaatatttagttcattaatactgcttaaaggaatttatcctaacaaataattaaaagaggaggtttttctgcataaagatgttgatcaaaactcccatagcagaaaatttttaataatcctataaatgataatgaaaaagccactgaaaaacaagagggaatatttgaagccacaaaatgttatgagctatgaggagtcttagaaaaatggttatgatttactaatttattcatagatgcctctctatgccaggcatagattgctttaaaatggaaaaataaaagccttccaagtagataaaactgaatattttactaagaaaactttgtgaaatatatggaagagaacatacaacaaagaagtgttgtttccgagtaataggattaggagtgattttttttctttaaacttccttgtgtgtgtgtgtgtgtgtgtgtgtgtatgtatacaacttaagaataatgaacaaaaagcattttgtaattcttcataatatactatagagcattactattattttttacaagagattgaccaagaactctaccaggaatatttggaccacggaactgagaaacactgtttacagtaggtacaacttcctttaaaacatacaccttttaaggcattcattcatccatccatccatcccacaaacacttgtcaaacaactaccagtgatagcaatgcagtaagctctgatgagttcctgctcttgggatgcacagtctagcaggcagatataccaggacaagagtaagatgtacagacagtttttaggggcaagagcctccaagtcaggcccaggggaatcagagaaatcaggatttaagttgtcactaaaagggtaagtcagagttttccagtcagacaagcatggagagctcttcagtgggggctcacgtgtagttcagacagtgaatactcacagcagagttttatgcacagagagtgctacaattgatagcacagactctttgttcaaatcctacctacctcatttactagtgtgaactctgggcccttcagtatttttatctgaataataggggtgataatacatacttcataggattattgtgtggcttaaatggagaaaaacatacacacagtgcacatggtagacactgtatgaaaaacaatatggtcatggaaaggtggaagacagaacaatatttaagatattcaatgagaaagtaggtgtttttagtgaggttccaaactcaagtgttaggagcccagtactcctgggaacgtaaggataatgtcttatatcttattctctcagggtactgatgttaagtttatttgtcagactatttttacttttgacaagttaaataaaatggtggagatcgcagcacctctccccagtctgattcactttagtgattattcatactgagagctcatgtttgcttcattataagaacaggtctcaccttctggctttcaaaaaacctggaatatcttcaccagtacagataaacaaatggtaatgccaagactgtcagtattttccaaggaaggaaacaggatatgtatggtaggcctatgttttccccaatctgccttaaaatccaaatctcaccttaggctggtggggactttaattaaaattagaatgtgaaccttcttatcatgaagctatcacggtatctcagttccacttgaatgttgttatataagtgaaattctaaagtatttcctaaaatacccattctgtatgtaggtatgtgcttctgcttgtctagggatgacttatttttcattaagttctctgaaatgagaaaatgagaaatagaattggggaaatgcaatggtattctcaatctttactctgtattggtattggttagtcttaggttcagagatcctggtcatgtctttccagcttctaagaagacaaagacactggtggagctggtgcacacctttgtagaactacctctactcaccctacagtgatgtcaaaaatgttgcttccaacagagctggacacagccatgtcccctaaccccttccgggccactatgacactggtgataagatcagggatggaggtcccagcagccaagatggtcaggcccataatctcttcactgatgccaattgtctctccaacctaaatgtcaggacaggaataaacatctcagtgtttgaagttacaaaatcataaaaatcacaaaaatttcaatgcgacctccttttaatgcatttctatactgtgctatgcaaagtgctgagatgataaagatgaataagccacagtcattgctaatagagtttatgcttttaggatattcagacccaaggcatcaggaatgttcacatgaaaattaaacagataatctcaaaaaagagctctagagggctagagtgtagcctttatatggtgctttctaagattgagtcagggaagctgcaggattagaggtagaaaggccaattggccatggaatccagggggcagcacctggcagtggcaccaagtcctgtggaagatttgcccttcaacttactaccaaaaccaaggactgacacccagggtctccattctcctttagcatctcctagtgtctataatctattctgaaacacttcaagatgctataatttccactggaatctcgattctgggtgtttcgggttttggtaacacatagcaaagcaactgtggagaagcaaaatccagaaaatcagaggacctgggtccaagatctggctctggtatgtgttaatttcttgacattttgcttactgtaccaattatatgtcattgatcctcactttctcatccataaactggggataataatacctaccttaccaggtacttgtgaggactaaatgataatctgtgacagactctttgtgaatagtacattattattgaaaagcaaggggagggtggctattactttttttctttttttttctttttttttttttggtctttttctttgccttttaagactgatgagttctattttggaaggttggtctagcctcacgtggaagctcctccattctcttgagcaatttgtttgtcttcttgggactttttagaaaaacttacttattttctttagagatgggttcttgctctgttgcccaggctagagtgcagtggcacagccacagctcactgcagcctcaacctcctgggctcaagcgatcttccaaccttagccttcagagtagctgggaccacaggtgagcactgccacacctggctagttttttttagagatggttcttactatgttgcccaggctggtcttgaactctcggcctcgagatcctcctgccttggcctcccaaagttctgggattacaggtgtgagccactgtgcctggcctcttgggacttttaaaacctattcatgttttgctggacttggtgaagtgtggctctgaaaaccttcaagataatgctttccatctggtttccaacaggttacctgatgatgtccagcattttttgaaaaaatttaaagggccaaaatagcatataagaataaagccttttagggaatagaatacactcatttctaaatcctttttaaaaaaattcttatttttataagaaatagtatgattcctactagcttaaaagcatatttttgttttgatggtcatgcctgctccagagcctggtgagctgaactagcttaccctgtcctcatgggacacagaatcactgctccccattagtaagttccatgtatgcaggatcctcaccttggtcaccacgatctccctagttgacagaacatacacagcctgatacatggcaggctcttaatactgatttgctgagtaagcaaatcaatctgcatacctaggtgatttcactagtatgtttttctgctgattctcctagaaaaagttcaataagacttttgcacaggagtgccctatttgagcaaaatattctcaaattgtcagttttttgttagatttggagtgaagcattgccaaagactgagcagatgctgactaaacaactgttactgtcggcaagttccaatctgtttaaaacattcttaataattaaattcttggagggaattctaaagtagtgactgaaaaattatttgctgggcacaatgccatgcacggtagttccagctactcgggggttgaggcacgaggatcacttgagcctggacatttgagaccagactgggcaatatagcaagaccttgtccccgaaatataaacaaaataatttgtatttggagtttgaatgctactatatacaggaaaacataggaattgaagaggagaaaaatggtggtgtggttaagagcactggcttgggagatgacagtgctgggtacaaatcctagcttgccactcctagtgcaagttagacaacttccctgagtctcagtctttcctatctgtaaaatgaggataatatccactcagaattgttgatgactatatgtgagatgcaaatcatacagcacagtgtcaggtataaagcaaatgttaaataaaaatctagttttttttttaacttaatatgttttttttgagacggagtctcgttctgttgcccaggctggagtgcagtggtgtgatctcggctcactgaaacatttgcttcctgggttcaagtgattctcctgcctcagcctcccaagtagctgggattacaggcatctgccaccatgcctggctaatttttgcatttttagtagagatggggtttcaccacgttggccaggctggtctcgaactcctgacctcaggtaatccgcctgccttggcctcctaaagtgctgggattgcaggggtgagccacggcacccagccaaaaaaccagattttataactcagacattactcctttccctctccaatttattagactgtcaggtgtctggcagcaggaacagaagtgggcttactggggccaattcacatcatggaaaacttcatgagaattttcattagacatcaaacccctggtgaatctgtgtggctctagaaagccttttgtggaagaagaactagtcttcataagcttgttttgagtacatttcactcaagttaacttttgtcaaatcagtaaagatgatgggcacatggacgggacagtactctgaaaaatcagggagcatcagagaggcttagagcttttaatagaaagaacatcagcagtcttttgggggaaattacttcattttcaaaaaaaaaaaaaaaaaaaaaagcaaattaggccactcagaggaggccaaactccatgctgctcccaatattttgtgatgcagttctgtgccttggtttaaggaggatctgaaagaatgctatagtggctaaatgagacacaaggtcttagttgactcttaaaattaatttctaatattagatgcaggattgactttaactacaggttgtcatcacccattaaatttattaaagtgcaaaaacaataagaaacaagaacaacaaaaacaaaagataaaggcaaaaaaaaaaaaaaaagccaagggcaaattatgttaaagcattgtaggtgaagggcatttattttttgccaaacagtagccaaattatcaaatagcatttatgataaaagtgttgataacaaaagagttgaacactatataactgctatggattttatagttcagaagtacaaacaacagaattagagctagacttcttggaacagaatctattttgttcagctgtctgggtgtttttaaagaagtatttgtataggagaaaagagaaacttctcttccatcaatgaaaagtaaggcttccatttatggctttcattcgtcttggctttttaaaattattattgtttcagccattgaatttgtgttccttttctttgaaagaatggaaagaaaacaagactggaattaaggtaatcattaaaaagaaaaagatggaaccctgcatgatgttttataaaacggcaaaaaagaaatatctgggaaacaacatatcccagcaagttagaaaaacaccattttttctttattagtacatgaagaaatagaagatgattattaagaaaaactattatatgttataaatggcaaacagtcctttcagcctggacatctggaggctgaaaaccagcccaccttctgctgtgatttctgccaggtgttggtagcaaatgtctctcaatgagtgtataaaataatgactccaaggcacagagaacttgctcaggaagccaatgattttttggaaatatccaggaagagtaatctgaagtcaaatgtcagtaaaataactgtgatatgaataatataaaatatcatgtagaaataagacagtgtatcagccaacattttctgtggattttgctagtaacatgtattcttttaaaaaccaaggtatgctttacatagagtaaaactcattcacctttttaaaaagtgtacagttctgcaaggtttttttttcctatttctttacttttttttttttttttttttttttttttaaaagacagggtcttactctgccacccatgctggagtgcagtggtgtgatcttggctcattgcagccttcacctcctgggatcaaatgatcctccccactcaacctcccgagtagctgggactacaggcgtgtgctaccatggccagctaattttttgtatttttgtaaagacagggttttgccatgttgcccaggctgatctcgaactcctggggtcaagggatctgcctgcctcagcatcccaaagtgctgggactacaggcatgacccactgcaaccagcctgcaagtttttacaaatgtatgcagccatgtttctccacatccttatcaacacatgctactgtttttttttttttttttttttttatagccaacctagtggttgtgaagtgatatcttggattagtttcaaacaagtttattgagatgtaatttacataccataaaatttagccattttaaagtgtataattcaatggtttttaatgtattcagagttgtgcagccttcataatttaggttttgaacttattcatcatccccagaagaaacccatacccactggcagtcactccccattttcccccaacctctccaatcctaggcaactattaatattaacctattatatgtctctatagatttgcctgttctgtatacttcatataaatgaaatcatatgatgtgtccttttgtaactggcttttttcacttagcataatattttcgaatttcactcatgttgtagcatgtattggtacttcatttctttgtactgtgtaatattccattgtatggatataccatattttgcttatccattcatcagttgatggacatttgggttgttttcactttttggtaattatgaataatgctactttgaacatttgtttacaagtgtttgtggacgtatgttttcatttctcttaagcctattcctaggagtggaattgctagatcatatggtaactctatgtttaatgttttgtggaactgccaaactatttcccaaagtggctgcactgttttacattcctatcagcagtatgtaaggattctaatttctatacatcctcatcaacacttgttaggttctgtctttttgattatacccatcctagtgggtgtaaagtggtatcttgttatggttttgatttacacttctttaattaataatgatgttgagcatattttcttgtgctttttagccatctgcgtattttctttggtgaaatatctgttcagatcttcaaaattaggatacttgaagatgcttgccttcctattatggagctttaagcttgtatcttggatacaagtgctttatcagatatatatgatttgcaaatattttcttccagcctgtggttttccttttcctttttaatggtgtttcctgaagagcaaaagttttaattttgatgaaattaattaatcaattttcttgctttcatggatcatgctttggtattgtatcaaagaactctttgcctggcttatggtcatacagattttttttctgtcctctagaagtttgacagctttacaaactcttacatttcaaactatgatgtgctttcagttaaattttatgtaaagtatgaggtaaggatctaagtttatttattttggcatatggaaatccaattattccagcatcatttgttgaaaagtctattcacatgttctcagtatatatttccttatttcaaatttctatatcttatttatgttgccaagtataataattttaggattatattaaacaaaggatacaagtgggaagtttggaatttatgtagtttataatagagattaaaagtatgatttttggagttgcagagtcctgggttaaaatctcagttctacctatgtgattttgggtaatcttaccaactttaagcttaacttctttatctgtaaactgtggataataatagtacctgcttcataggctttgaacctatgtatagggttactgttaagattataaagacaaagggatgtgaattgttgggtgtgtaggacatactcaattatcaatagttaccactattatctttgaaaatgtgaaacccttgaatcttactcttcattcatgtttttcaataatgattactgagagtgtattcttgtgatgggcattgtgactcatattgagttaaaaataataacaatacatcatcatttatgtaaagtgaagctcaaggaagaggctattttgtctccagatgctttcctagagccagttttaaactgctggtgagaacgtgaggtgagtggctgctcaagataaagtcagtactactgaaccaggcaaaatcttgacattgctctcaggtctgggttgtcctggtgtctgtcaggctgcagaggcaagaagtagttagacttgcctgcctccacatggctgtccagaggctatgctgatttaattccatgctacagccagaagactagggaaagttaagtggataaattcctctagtcctggaatgctaactcgtctgtgtcacacccaatactgttgtggcagttgcagaaagcaaacacaatgattaaacacttgacaatcaggactggagaaaaacaaggcagaggcatgtcactatcaaaatcttacctggtgcgcccaccagaccatcaagtaagagaatactgcaatccaggtaatggagccaaagaacgtgatgggaaaaaacttcctcgatgactgaaagacaaccaggaagagttgagaatatcagtgttatccattgagactgatctggaaatccaaagctaaagccaccattgtagcaatttctctagcatttcctgcatcttagtaggattggcaatcaaaagaccctactcactcctgatcaagctgggacagtaagattctcccttggagatgtgaaattgataggaactgagtgatcacagtgctggctcctgagatggaaatcttgaagagaatgtctgttagttcctgctattagatgtttagattccctctgctcttgtcctttctaaggcctggttttttggcctttccttcaatattaacaccatattctccctcctcctttttctttcttttgctccagagtttgtcagaatcagtttctattgcttgcaaaccatgaatcctaacaatccatatgccaggaaacctatgggattaattccattgaataagaaatgggaaggatcagcaggtttaaaaatagattgactcatcttacagtaccacaaattatcaagaaagtcacacagaaaaagccaccaccacaacttttatagattctggatgatggccattctccaggacactggaaccacccatggaccagagtagacagaggcagaagcgcccaattgtactgatttccactgagatggcagatcagacattgctctcaagaatgttttctctcctgttcaccaccccaaaatatattatgttcaattctgcttctagaagtagactttatgctatctcaggcataaagtgtgagcatttttaaagtttcctagaaatagccaaaaaatcagacacttgaaatgcagtgtttcttacccagtcccactacagagaaacccaggcttgcactgtagtggtgttcttttgatgtcctttgttgaaaaattggggtcttttaaaaacacactcagacagcacaatgctgtcagagagcctcttgcctattattgccaaacactttatttgaaagctttccacgttgagaaacaatcccactttttgctttgataatgccatccaattttatctagagaaatgaattttagagttgacttgtatgaaagtaatctcaattgtccgaaaggctgaccttgggcagtcacacagaacacgttctgtcatggcttttgagagctccattaaaaggaaaagataaactcatacatggtaatcttttgaatatcaataatgatgaacacagtctctattgctccaaaccaggcttatgttttctttactaatttcaagttttcaatatatatttcttatgatcatttgcatggttctgttaaattttaccccatacatttctttaaatgattgctgttttgtggggccgtttgttagcttggatgactgtaagaccaagcaggtttgattaaatcgggggagggcatcaggccacagtgagtagccaaaaccttaccctcaaatgcttttccctgctccctttctttcttagaagaaaaatattttggacaaggactcagacccctcctagggacctaagcgctttaatgggtaatgggggaaataaaaaggtaatcatttttttaaagtggagttggagaccttcgtttttttttttttttttaagatggagtctcactcggtcacccaggctggagtgcagtggcatgatcttggctcactgcaacctctgcctcctgggtcaagcaattctcctgcctcagcctcctgagtagctggaattacaggcacctgccaccacaccccactaatttttttgtattttttagtagaggcagggtttcaccatgttggccaggctggtttcaaaatcctgacctcagatgatctgcctgcttcagcctcccaaagtgctaggattacaggtgtaagccaccgcacccagccattagatctttacttataaaagcagcttttttttttttttttttttaagctaggaaatcagccggattctggagaccgaattccctgagccagtgctaagagatgaagttttccaaggcatttagcttattaaagttcccatccttttcatctggtcacagtcactgtttcaggatcctacgtgcaatgagggtttcatcttccatggctgtgctctgttacaggaaagagaagaaccctcttgccacgtggggtcacgtgtgtgattagagccccaaccaatggttgattctgggcaatgtatgaggacaatgaaaagctttctacatgccttaaggtgtggcataagtactagatgtcctaggagagtcctcatttcatagattgctcgttttccaggttagctcatttactaaatgtataattattattttaactttgtacctctgcctgtttattctttgagataacttcacaagtcagaatcaaatcatttgaacatatttctcatctgaaaaatatcataactgagctacagaaaattcctagccaaaaggtataaagcaaggtatcagaaaaggaattaaaggaactaaattcaaatcaacatactagggaaaacctctctaaatcaatatttgatgcccatgattcttaatcaagaagccaattagtaattaatgggcatcgaaccatacctaatgttgcattaggggctcaatgaagaaggctaaaaatattctttgtgaattttcagtcttcatcataagctagaggtagataaagtctgagaacttactctgtacccagatcctgaactagagataaaattcaaactaggtcagcctgactgtaccacacgtgctcccaatatctagattatactgactctttcctaaagaaaaacagggccaataatgctcaaaatataccccgccatatacataatgatcatgatcatgatcatcataccaggctctgctctgaatgtcagaaaattaaaaaaagcatcagggaagtagaaactagcattccagctgtatggccatctgcctcgcccaacctcccatgttgttcctgctttggaagtatcaacgtttcattcatcagcagttgggctaagtgtttcctaactgttgaactactttaccatttccattttcacaccccaggtaatcacttctttcatttttcttggaccattccccttacttggacagcatggtctcattccagacatctctgcccagtagcaactgtacagtcatttagttaccagtgtcattggaaggaagaaaatagctcttggagccaaggtctaacatgacaatttatggttatagtaatgggggttcatcctgccatctgctgggatggacctcatactaattagcaaataagcaaattgcatccatgtgctggccattttgtgcccatgttgtggtttacttacataattgacagtggatgctctgattagaagcttttggtacatcagagtgatatcggcttggcttggaaaaagatgctggacattagctggttgtacaaattagctatatccttactgatttaaattcaacaaatattcactcagcatctactctgtgtaaggttctgggacatatatttaacaaagacccccccccaccccccaaatcctactaaagatttaaagtgtggtctctggattaatatgactggtattgaaatctctgctcacaaattaccagcaatgtgacctgagacaaattatttaatctctttaagcttaggtttcttcatctgtaaaatgggagaaataacatctagttgttttgaggacttcatgtacataaaatgtctagcaaagtacctcgcacataagtgctcagataattatatttgttattagacaatatagtcatgcccttgtattcatgagggttccaccacccctgaggataccaaaatctgcagatgcccaaatccataatatgaaatggtggagtatttacatataacctttgtgaatcatcccatatactttatttatttatttgtttgtttgacagagtttccctgttgttgcccaggctggagtgcaatggtgcaatcttggctcaccataacctccaccttgtgggttcaagtgtttctcctacctcagcctcctgaggtagggtttacaggcatgggattacagggatgtgccaccatgcccggctaattttttgtatttttagtagagacagggtttctctatgttggtcaggctggtctcgaactcccaacctcagatgatcctcctgcctcggcttcccaaagtgctgggactacaggtgtgagatacctcacctgactcccatatactttaaatcagctctaaattatttgaggccgaatagaatgtaaatgctatgtaaacagttgttaaattgtattgtttttatctgtattttttactgttgtattaaaatttttttcctgaatattttcaatctgtgattgtttgaatgcagagcctgcagatatgaagagccaactgtattctcattttagtttttaagagataaagaaactgataattggggaagtgaacatgactgtgaagacctggcccagagtcttggctttgcgtctttctagctgggtgtgcttgaataagtcaccaaacctctgtgggtgtcaattactttatccttgttagaccttgcttggcacatagtagacactgaatagatacttgatgaatcaatgaataatagaaattgcaaacatctagctgggttctcaggttccttcctagttctaatgggtcatgttttcatatctcattagatgcattcttgttttgcaggagtatctatcttagtcatgagagaagataactttttcggtccttagtttattttcagttttcatcaaagacttggtcctcattgaagtttatattttagttcttttactttggaaacaaagccattaataaaactgtaagtgtaaagcccatattaattatgtgagctgaaattatgcatggttcaacaaacactgtcatacaatttgcatataaatgaagcagaaataaaagctagtgggagtactatatactctgaaactataagtatacatgaaaaaatcatgttttccttgtaattactgtcaaggtttggtatgttcatcttcttgggcaatcaaaatctacagaagaggcagagctgccaggccctaaggaggggcaaatatgtattagttaatttttcccctctctttcctctccgtatgtattttctcaagaggtccctgtggaagcacataagttctatggtggactgcaaaaatgggcacaatactttgctgctcctctcatcaagaggtgaggtctatttttccactcttcgaatctgggctggccttatgacttgctttgaccaaaagaatgtattggaagtgacagcgtgcaaatttcaaactagatctcaagagggctttgtagctttcatacttgctgctctcggcactttgccattatgtgactaagtccaggctagcctgctttgagataagagagtatgtggagcagagacaagctgttccagcttcaatagccctgtaccaaccagctcccagccattaactgagcaccactaagaccagcagctgaactgtccagctgagcacaacccaaattgccaattcacagaattatgggctaaaaaatgtcttgtattaagccactaggttggggtggtatgttacaaagcaaaagataactgatacaaggtcaaatctaacaaaaatcttctaactaagcatgatcacttactggatttgtgtcaactggcatggtttctttcatttggcatattgtatatgcagaatacacccatatatcttccaaaccaatatgctttgtgaataaactgggaccgtcctgggtaatctgggatgtaggatcactttaaatgtgcagtagcttttttgatggttatctcatgctttccttaatcacagaatgtcatggctggcagggaatccagaaaccttctgaccatttattcacagaggggaaaaaattcggtccagagttgagaagtgcttttcctaatgttgtacagctaatcagctgtggggggaaaacccatcacagtcaatgtggtacaatgaaaatgatctggagtcaggggacttgggttcaaatccagcttctctcactaatacagctgtaaagtcttgctctgtggttatatgtggccatgcctggtttcctttactagacttagagtgccttaacaatataaattgtacattttttgtctttgtatctctttttttaaatacactttaagttcttgggtacatgcgcagaatgtgcagctttgttacttaggtatacatgtgccatggtggtttgctgcacccatcaacctgtcacctacattagatatttgtcctaatgttctccctcccctagccccccaccccttgacaggctccagtgtgtgatgatcccctccccgggtccatgttatctcattgttcaactcccacttatgagtgaaaaaaatgcggtgtttagttttctgttcttgtgttagtttgctgacaatgatagtttccagcttcatccatgtccctgcaaaggacatgaactcatccttttttatggctgcataatactccatggtgtatatgtggcacattttctttatccagtctaccactgatggacatgtgggttggttccaagtctttgctattgtgaatagtgccacaataaacatatgtgtacatgtgtctttatagtagaatgatttataatcctttgggtatatacccagtaatgagattgctgggtcaaatggtatttctaattctagatccttgaggaattgccacactgtcttccacaatggttgaactaacttacacccccaccaacagtgtaaaagtgttcctatttcaccacatcctctccagcacctgttgtttcctgactttttaatgatcaccattctaactggtatgagatagtatctcattgtggttttgatttgcatttctctaatgaccagtgatgatgagcttttttttcatgtttgctggctgcataaatgtcgtcttttgagaagtgtgtctgttcatatcctttgcccactttttgatggggttgtttttttcttgtaaatttaagttctttgaagattctggatattagccgtttgtcagatggatagattgcaaaatttttctcccattctgtaggttgcctattcactctaatggtagttccttttgctgtgcagaagctctttagtttaatgagatcccagttgccaattttggcttttgttgccattgcttttcgtgttttagacatgaagtctttcctaatgcctatgtccagaatggtattgcctaggttttcttctaggatttttacggttttaggtcttaaggtggagtctttaatccatcttgagttaatttttgtgtaaggtgtaaggaaagggtccagtttaagttttctgcatgtgactagccaattttcccagcaccattgattacatagggaatcctttccccatttcttgtttttgtcaggtttgtcaaagattagatgattgtagatgtgtggtgttatttctgaggcctctgttctgttccattggtctatatacctgttgtggtaccagtaccatgctgttttggttacggtagcctagtttggagtcaggtagtgtgatgcctccagctttgttctttgcttaggattgccttggctatacaggctcttttttggttccatatgaactttaaagcagtttttccaattctgtgaagaaagtcagtggtagcttgatggggacagcattgaatctataaattactttggaaagtatggccattttcatgatagtgattcttcctatccatgagcaggcatgttgttccatttatttgtgtcctctcttatttccttgagcagtggtttgcagttctccttgaagaggtccttcacatcccttgtaagttgtattcctaggcattttattctctttgtagcagttgtgaatgagagttcactcatgatttggctctctgtttgtcttttttttttttatctgattctaagaaattttctttttttttaattttttatttatttatttttttttattacactttaagttttagggtacatgtgcacattgtgcaggttagttacatatgtatacatgtgccatgctggtgtgctgcacccactaacgtgtcatctgtcattaggtatatctcccaatgctatccctcccccctcccccgaccccaccacagtctccagagtgtgatattccccttcctgtgtccatgtgatctcattgttcaattcccacctatgagtgagaatatgcggcgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttatagcagcatgatttatagtcatttgggtatatacccagtaatgggatggctgggtcaaatggtatttctagttctagatccctgaggaatagccacactgacttccacaatggttgaactagtttacagtcccaccaacagtgtaaaagtgttcctatttctccacatcctctccagcacctgttgtttcctgacattttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcactgtagattctggatattagccctttgtgagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgtattggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggtgactgtagccttgtagtatagtttgaagtcaggtagtgtgatgcctccagctttgttcttttggcttaggattgacttggagatgcgggctcttttttggttccatatgaactttaaagtagttttttccaattctgtgaagaaagtcattggtagcttgatggggatggcattgaatctgtaaattaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttggattcctaggtattttattctttttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcggtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggatttggtttgccagtattttattgaggatttttgcatcaatgttcatcaaggatattggtgtaaaattctcttttttggttgtgtctctgcccagctttggtatcagaatgatgctggcctcataaaatgagttagggaggattccctctttttctattgattggaatagtttcagaaggaatggtaccagctcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgtgtctatttgattcttctctctttttttctttattagtcttgctagtggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgtgtcccagagattctggtatgtggtgtctttgttctcgctggtttcgaagaacatctttatttctgccttcatttcattatgtacccagtagtcattcaggagcaggttgttcagtttccatgtagttgagcggctttgagtgagattcttaatcctgagttctagtttgattgcactgtggtctgggagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatctttctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtcttgatggtctttacattttggcatgattttgcagcggctggtaccggttgttcctttccatgtttagtgcttccttcaggagctcttttagggcaggcctggtggtgacaaaatctctcagcatttgcttgtctataaagtattttatttctccttcacttatgaagcttagtttgcctggatatgaaattctgggttgaaaattcttgtctttaagaatgttgaatattggcccccactctcttctggcttgtagggtttctgccgagagatccgctgttagtctgatgggctttcctttgagggtaacctgacctttctctctggctgcccttaacattttttccttcatttcaactttggtgaatctgacaattatgtgtcttggagttgctcttcttgaggagtatctttgtggcattctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttcttttgattcttttttctctaaacttcccttctcgcttcatttcattcatttcatcttccattgctgataccctttcttccagttgatggcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttccgttgctggtgaggaactgcgttcctttggaggaggagaggcactctgctttttagagtttccagtttttctgttctgttttttccccatctttgtggttttatctacttttggtctttgatgatggtgatgtacagatgggttttcggtgtagatgtcctttctggtcgttagttttccttctaacagacaggaccgtcagctgcaggtctgttggaataccctgcagtgtgaggtgtcagtgtgcccctgctggggggtgcctcccagttaggctgctcgggggtcaggggtcagggacccaattgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcctggtgcgccgtttttcaagccggtctgaaaagcgcaatattcgggtgggagtgacccgattttccaggtgccgtctgtcacccctttctttgactcggaaagggaactccctgacccttgcgcttcccaggtgaggcaatgcctcgccctgcttcggctcgcgcacggtgcacgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctcccttctctctgtttgtcttttattggtgtatatgaatgcttgtgattttttgcacattgatattgtatcctgaggtgctgaagttgcttatcagcttaaggagattttgggctgggacaatagagttttctaaatatacaatcatgtcatctgcaaacagagacaatttgacttcctcttttcctaattgaacaccctttgtttctttctcttgcctgattgccctggccagaacttccaatactatattgaataggagtgatgagagagggcatccttgtcttgtgccagttttcaaagggaatgcttccagtttttgcccattcagtacgatattggctatgggtttgccataaacagctcttattgagatacgttcaatcagtgcctactttattgagaattttttaggatgaagggtgttgaatttttgttgaaggacttttctgcatctgttgaaataatcacgtgctttttgtcattggttctgtgtatgtgatggattacatttattgatttgcatatgttgaaccagccttgcatcccagggatgaagccaccttgatggtggtgcataagctttttgatgtgctgctggatttggtttgccagtattttattggggattttcgcatcgatgttcatcagggatactggcctgaaattttctttttttgttgtgtctctggcaggttttggtatcaggatgatgctggccttgtaaaatgagttagggaggatcccctctttttctattgtttgaaatggtttcagaaggaatggtaccagctcctctttgtacctctggtagaatttggcagtgaattcatctggttctggactttggtaggctattaattactgcctcaatttcagaagttgttattggtctattcagggattcgacttcttcctggtttagtcttgggagggtgtatgtgtccaggaatttatccatttcttctagattttctggtttatttgcatagaggtgtttatagtattctctgatggtagtttgtatttctgtgggatcagtggtgatatcccctttatcattttttattgcatccatttgattcttctctcttttctttattagtctggctagcagtctatccattttttgatcttttcaagaaaccagctcctggattcattgatttttttttttttgaagggtttttcatgtctctatctccttcagttctgctctgatcttagttatttcttgtcttctgctatcttttgaatttgtttgctcttgcttctctagttcttttaattttgatgttagggtgtcgattttagatcttttctgctttctcttgtgggcatttagtgctataaatttccctctacacagtgctttaaatgtgtcccagagattgtacgttgtgttgttagttctcattggtttcaaagaacatctttgtttctgccttcatttcgttttttacccagtagtcattcaggagcatgttgttcaatttccatgtagttgtgcagttttgagtgagtttcttaatcctgagttctaatttgattgcactatggtctgagagactgtttgttatgatttccattcttttgcatttgctgaggagtgttttacttccaattatgtggtccattttagaataagtgcgatgaggtgctgagaagaatgtatattcttctgatttggggtagagagttctgtagatgtttattaggtctgcttgttccagcgctgagttcaagtcctggatatccttgctaattttctgtctcattgatgtgtctaatattgacagtggggtattaaatctcccactattattgtgtgggagtgtaagtctctttgtggatctctaagaacttgccttatgaacttggatgctcctgaatggtgtgcatatatatttaggatagttggctcttcttgttgcattgatccctttaccattaggtaatggccttctttctcttttgatctttgttggtttaaagtctgttttgtcggagactaggattgcaacccctgctttttttttttttctttctatttgcttggtaaatcttcctccatccctttattttaagcctatgtttgtctttgcatgtgaggtgggtctcctgaatacagccactgatgggtcttgacgcttatccaatttgccagtctgtgtcttttaattagggaatttatcacatttacatttaaggttaatattgttatgtgtgaatttgattctgtcattatgatgctaactggttattttgcctgttagttgatgttgtttctttatagtgttgatggtctttacaatttggtatgtttttgcagtggctggttccagttgttcctctccatgtttagtgtttccttcaggagctcttgtaaggcaggcctggtggtgacaaaatctctcggcatttgcttgtctgtaaaggagtttatttctccttcacttacgaaactgagtttgcctggatatgaaattctgggttgaaaattcttttaagaatgttgaatattggcccccactctcttctagcttgtaaggttcctgcagagagatctgctgttggtctgatgggcttccctttgtgggtaacctgacctttctctctggctgcccttaacaatttttccttcatttcaactttggtgaatctgatgattatgtgtcttggggttgctcttctcaaggagtatctttgtggtgttctctgtatttcctgaatttgaacgttggcctgtcttgctaggttggggaacttctcctggatgatatcccgaaaagtgttttccaacttggttccattctctccatcactttcaggtacaccaatcagaggtggatttgatcttttcacatagtcccatatttcttggaggctttgtttgatccctttcatccttttttctctaatcttgtcttctcacttcatttcattaagttgatcttcactttctgatatcctttcttctgcttgattgattcagctatttatagttgtgtatgcttcacagaattctcatgctgtgtttttcagctccatcaggtcatttatgttcttctcgaaactggttattccagttagcaattcgcgtaaccttttttcaaggttcttagcttccttgcattgggttagaacatgctgctttagctcagaggagtttgttattacccactttctgaagcttacttctgtcgagtcatgaaactcattctccatccatttttgttccattgctggtgaggagttgtcatccttgagaagaggtgttcaggtttttggaattttcagcctttttgcgcgggtttctccccatcttagtgaatttatctaccgtcggtctttgtagtcagtgaccttcggatggggtctctgagtagatgtgctattcctattttttagtttttttttcttttttttttgtgacagagtctcattctgttgcttacgctggagtgcagtggtgcaatcatggctcactgcaagctccacctcctgggttcatgccattctcctgcctcagcctcctgagtagctgggactacaggcacccaccaccacgcctgcctaattttttgtgtttttactagagacgggtttcactgtgttagccaggatggtctcaatctcctgaccttgtgatctgccctcctcggcctcccagagtgctgggattacagccgtgagccactgcacctggcctagttttccttctaacaggaccctgtgctgcaggtctgttggagtttgctggaggtccactccagaccctgtttgcctggatatcaccagaggaggctgcagaacagcaaagactgctgcgtgttgtttcctctggaacctttgtctcatacgggcacctgccagatgccagccagagctctcctgtatgaggtaggtctgttggcccctactgggagctgtctcccagtcagtacacatgggtgtcagggacccacttgaggaggcagtctgatccttagcagagcttgaacgttgtgctctcttcagagccagtaggcagggacgtttaagtctgctgaagctgcacctacaaccgccccttccgccagatgctctgtcccagggagatgggggttttatctatatgtttgggggtactgcctttttttttcagtgatgcccttgccagagaggaggaatctatagaagcagtctggccacagaggccttgctgagctgcagtgggctccacccagtttgaacttcccggtggctttgtttacactgtcagggtaaaactgcctacttaagcctcagcactggttgacaccccttcccccaccaagcttgagcatcccaggttgacctcagactgttgtgctggcagcaagaacttcaagttgtggatcttagcttgctggactccgtgggggttggacccaccaagccagaccacttggctccctgccttcggccccttttccagggaagtgaatggttctgtctcactggtgttctggcaccactgaggtatgggaaaaaaaaaaacaacacaaaactcctgcagctagctcagggtctgcccaaatggctactcagttttgtgcttgaaacccaggacactggagggtatcttctggtctgtgggttgcaaagactgtgggaaaagcacagtgtctgggccagagtgcactgttcctcatggcacagtccctcacagcttcccttgggtaggggagagaatttcctgaccccttgcacttcctgggtgaggcgacaccccacaccccaccttagctggaaatgtggaaaaatcacctgccttctgtggcgatctcgctgggagctgcatactggagctgttcctatttggccatcttgccagcaaccctgtctttatgtctcttaagcactggccaaggcccagtgtttggcacataataggtgctcaataaatatttgtgaaggaagttgaaaaaaaccaaagtgttcttcctaagagtcttatttctgcttggaatagcacagagtactcagaaaaacaaaagaaatccagtccattccagggctagcacttgggggagcaatgaagtaaagccccgctggctaccctgcccattctgcaggtgctggctctcagagggggactgcacagggagcagtggactggggacagctctgttttcttgctctgtgcctctccggattgtggcatcagccagagcagttgtcatgacccacgtaacgactgccttgattgatttttgttggttttccaaaagttaccagttaggaagttgggagcttttgatcttccctaacagcttctttgacgtttcaactaggattaccaagaggataaacactttgccagccctttctctgagagttcctcccaattctgagagtcaagggccttgacttactggcatcttcctcccattcctgcacatcttcctgagtgcctcaatggttgtatgcaaacatcctctcatcaaccaatctgcccccatcttctgggggccacaccacatgaggccccttttgggaatttagaaaactgtatctgtctccctgattttcctccctagggccacacaaaagcattggactaaacagcagagcaagagagagagagagacagacagagagaggagagacaatgcaagcatatcttagaaatgtcagtgtggtgtgagccaagaaaaatcaaacacattcagctatttggttgtgggttttcaggaagccaggcctttgcatagtgcagatgctgtaaaatggtatcttgaataaagaaacttaaatattgctttaagtgagccacacctgtgtcatgcatcctttaccaggaaacctatactgctgggagtccatacaaggagtcctttcttgttgtctacttgacaagacatggctctccactaggctgcattatttaagggccaaggtaatgggatggggtttttcttctgtctttttcaaatgaaggagctcttgaagacttatgataaattatgctggaagttatcaaaatattctattccaagtgcttttagaaatgattttttttaaatgatttttttttctactttgtggcatcactaaatatgaagcaaagcccaagccatgtggtcacatagacctgggtctggatctcagccctaccttctaggaaatgaccaggtataaattaacttctttgtgcctaagtttctttctacttatgccaacaatatacatattcctaccctagatgtttcctgaaattacataatatagtttactgtggaccaataactcaaggccttgggctctcagggttgggaaggacttttagaataaaggctggcaaaatgttcatcctcttgccaatctgagttgaaagatcaagaaggtattagaccagatcaaagtctcctgattggcaactgtggcaaaccaacaggaatcaatcaaggcagttggttatgacgactgccctggctgatgcacctaacaagaaaatggagctgtccacaatgctctcctccctgtgcagtccccctttgagagtcagcccctgcagcatggccagggtagccactgggacttctctcattgctcccgccaagggccagccctgggatggactgtatttccgagtatactgtgtgctgttccaaacagaaatgagactctcacgaggaacatttagtgcagaatctgatgcatattaggtatacagttttgttgaatgagtttgtgtgtgtggtcctatactaagaagtagagctgtttctccttccctctccttagttctttcacctctggggcaatggcccaagaactcacttcaacaacagtgggtgggtgtattctcttgatttggtctatactcaggttgtaatttgctgatgttgttgcgttcggagcacccagtatgtgataatggtagataataaaatcgattaaagtaatgatagtaaacatagtcgattaaagtaatgatagtcacaagaatgttcaagaaaatgtgagtaaccttcctgcttcagaccttcagttgcccttcttaccttctcagagacaaacgctgtgggggttttaaaacatgtttgcaaattctttgacactcttcccaacaggagagtgatatgctatatgacactgacgtattctaggtaaactttttgtttcctccccctttaatcaagacacacttaggactgctttggtcaatagggcatagcagaagtgaatctatgtaacttctgggactgaatcatcacagaccatgcagtttctgccttctgtcactgcaacattcactcttggagtcctgactgacctcttatgtaaaacatttcactatcctgaggctaccatgctgtgaggaagcccaagtcacatgaaaaggccatgtttaggcattccagtagaccgtcccagctgagcctaacctttgaatcatttctgcccaggtgccagaaatggcaaagaagcctccagatgatggtagccccaagatgagatacacataacccttcaagtctttctacttcaggccacagacataatggagcagagacaagccatccacaatgtgccctattcaaattcttgatcgacaggatccaagaaaagactaaaaggatggttgtttcacaccactaagttttggggtagtttgttatgcagatttgataacctgaacaatcagtgtgattgtgtgtctgctcagagaaatctgtatattcttaatgtcactttctctttttccttaaacttaaatattttttcttgttacataatagttgtacctatttatggggtatatgtgagattttgatacaagtgtacttcctttttccttttaacacaaactgaagcagactatgcaccctgttatgtaccatatgttttacaagggaactatttttaaaatgctttacttacaggtttgcgaacgtcaggtaacgtaatccagagaggaaacactatggggaaaacaatcagaaacgtgacttgcttgcgggtttcagaaggccaggcaaggctgagaggctggtcctcctcctcatcagcggtctgtggtagaaaaagaggtaaaattaaacaaacaaaaaaataaaatgtacacaggcacaacaacaggagcacagaacaaaggggaagctccatgtcttatcagttttctggactcgttccagtagcttcatatgtgtgattttgagatttgtcacagtctgagtcctaggaacaaataatacattgtccagccatgagcatgtaagaattttcttttatctccttgaatgctcttcagtttctcatgttcatcaactgattattcaactggagtgggctacaactacaattcacgagcttcttataacaaactatatctgtggaggaaaagacttgatgaccaccatctccccatctttccttctccttgaagacagagtcacaagctttcaggctccttgggaaggagagcactgataaaaaatatttctttttctctttttttttttttggaacactgattttcatcaggcaaatgaaagtaaccacagaaacaattcagtaatactactaagagagattaacttcccactggccttggaatagctaagtgcattgatttttgtgtagttgtgagtttttttctttcattgatattttacgtatttctggggtaaatgtattttttacatgcattgaatgtgtaatgatcaagtcagggtatttggggcctccatcaccttgagtgtttatcatttctatgtgtggtaacattccaagccctctcttctagctttggaatatatagtgtgttgttgctagctacggtcaccctagtctcctaaggaacattaggactgatttcttctatctaactgtaagtttgtacccattgaccgacctctcttcatttctccctgtcacccccacacccttctcaggttgtgagttggtcacctgcttaaccacagctaaattctaaaccattgtacttgcagccaaagacaacttatgcaaacatatgtctcagtcctcagaaacagaaaatacaagtcaagcaagacagtgaacctgcacggggtgtcggagccagggaacaaacttcagagtctctgacttggcagccaatggccagcgttttatttgtcagccactgaagtcagtagcttctgaagtcagggctagaagagatggagggggagggtctgggcccagcagggggtgaccgttagcctgtcagctgagccctcaatacttccaaaacagcactgtagacatcatcaatcactcccttccctgcttgtttgaaaatgaaagtgcagcagtggaccacgcatcagatctaaaaatatcaacaggaacttttccactgatgcttccttttgagaccatataaataactttagaaagctcctacccctggggctcttgcttccagcaccatacacttttcaaacagtaacagcgcccccctccagcacctgtgtccctacagaggtggcatgaggggcaggctcaggtcagctggccttgaggagaggtcagggctgggtgagaggccgggctcacagcaatgctatgtcttgtttatttatctggcaaaactgaggtactgcagaaagtatgtatagtgttttatacaatctcttcaactctccctaggagttacaatttgaaataataatttaaaaaagggatgcgaagccatattgaaaagggttagtaacaacaggttcttctgctttgggtatatgtccttggcagtgggtaaaagaatttgtaaacagcaaatatggtggaattaaagggattaggtataataataataaggcagcatcaggaagttgacagtttattttggtaccctggatcctttttaaatatacacctcacactccctatttctttctatgcaattcacatattattccatccattgctttctttcttccatcctgagggctcccatctttggtggaagcttggtgtgctggctctggtccctcttctatgccacctctgtctcttccttgtggatatagcaggtgtagagaatatcattccctattgggctcaccagcctcccaaggtgtcagctagctacgtgaataatctttgtgtcatggggccaatgtggattaaggagacaggtatattttcctgtctgttccctcccagatatgatccttcttgtttaacccaaatgaatgactttccccttacctcctggcagatgccccagaaataggcatgggagccttggggtactgcatcattcttaataaataccccatctcacatgagagatgatttttttttctagcagagagtcagtcagcttccctgaagacccatcaagctgatgagttcattaaggctcctccccattctgagattgatgcctccccctagctctgttcatcactaccatccacaatctagcaacttttctctcgacttcaagctaacctttttctgataaaacacaaaagcaactctttatgactcatatcattttaatgacaccaacagatggtgacatttcatcaataacccttctgcttataacctacggattagctcctttctccatctgccaaagtcaccaggcaggcattgccactagcaaatagcagaaaataataattgtctgtttagatgtataagctctaaacacactactgtccaatgcaaacaattaactatattgaacagcttccaaagctgcattggaggtagctgttgctagggcagaaatggactaggagaagagactatgtctcaggctgtgccaacagggctctccatggaaacttcacagcctcctgggggccaagtcctgctacagggaagtacaggaacctagaatcctggggtggatttgagaggtaccccaggagcaaggctgttggcatacattaggtgaaattatctttgccaagtaaagtctcactctggctcaatgggaggcagtttgcaagctggttagagaagtggaagaaaaaaatactgttccaagtttgaggcttattttgtctttgttcaaactggatgctccaggggagaggccactgaggttagggcagtgattttccaacttttcctagagttgtggtatgctggctttgaccttgtgacaactcacccttacctcctaaaatttctgcagagtgtccatagaaaacaaaacaaagcaaaatggtccagaaaggattcaaatggcttttgatatgagggcttaaaatagtttgatatctgctggggtctctgtagaagccttagaattgtgtaaagctttagggccttgtaatctttgatatgaaaaatctgacacaaaaacatatgactttaagttcccacatggtgggtggtggtgtgttggttgtcagaacttaaaagagtcagtgcagcatgctgggcagagtaggtggtagagaatcaggaatcctgagttccagtgtctgctcaggctgtgattccttgggtagttaccaccaacacctgcaagcagtcactaagcacctacaggtgcaaagcactgcatttaattctaggactcctgctttcaaggagtcttggatttaaaaggtgagacagaacagaagattccaaagaattactgcagtatttatccagttacagggctgctggccggttaacgtggcaagagactactgcttgtcttcccgtatctattctgcctattatggactgaattgtgttccctccaatcatgccccttccttctcccccacccaaattcatatgttgaagctgcaacccccaccagtacctcagaatgtgacttatttggagataggatcttcaaagaggtaattaagttaaaacaaggccactagtgtgggtcctaatcaaatctacctggtgtccttataggagaagattaggacacctagagagacactaggggttcctttgcacagaagaaaggccacatgaagatggggacacagcaagaaggcagcggcagcaagcaaaggagagaggcctctgaggaaaccaaccctgccaaacacctgctgcttggacttctagcgtccagaactgtggtaaagtagctttcaacaaaaagtgatacaaataaaaagcaatacagtgtaacaactatttacatagcatttacattgcattaggcattctaagcaatctagagatgatttaaaggatatgggaggatatatatttgttatatgcaaattctaccccattttatatcagggacttgagcatccatggaatttggtaaccttggggatcttggaaccagtcccccacggatagcaagggatgacagtactgcctttatgctttaacaaatggaaagcttgcttttacctaggcttggaataaagactctggttttcagccttctcggcaaggtgtggcaatgtgattaagttctggccaaaggatgtattggaagtgtccttcatacaacttcctggatctatctttaaagggtgcggatgcacccttcctccttccttcctctttcttgctggctggaggggacattttgaccacagcagaagataatcttgggccatggggtggaggaacaatatatgaggctctgagtttctgacacccatcaagggccattcgtgccctggactgcctatactgacttgagagataatcagaaactgatgactgatggcaatgcttccgggataaaggcacccacatgctgtgactgcatttgctgagcagcctgggatcactctatgaattacataggaagcaggaatctggtctctctataagatatcttattaatgcaggtcagggggccacatgttaacactagactaggtgtcaaaatgcaggacttaacactggttttcttggtgtttataggaaattctgcccaagtcatgcacccacttcacatcacaatatgttctttctcacagggataatcaaaagggcactcttaaaaaaaaaattatcttattcaagccattgttattttgggtttttagttctttacagtgcaagtttatcctaactgatctagtgttctctttatgaggactcaagggagaaacagctctcaaatctcagcactaagaaaagtcagacctcttctgagaaactgaaaaatcttagaaatactatgagtcatgtaatcgataagattctttctgtgttttgttcactggggagttcagagccaaatttgtaacctgtacccaacaatgacagtggtggatctgtgctcaccatgttgcggtcttagtactgtcatttctcatcctgggctgtattttctcaaaaccattcattttatcctttttcctcagatgtatttttgtaagtagcctcgaatcttgtgaaaaaaggtgaggcaggcgtaaataaaaaaagtaacattcttcagtggtgtaatagaaattttagtgtaactttatcaggttgaaaagacttgagagttgggcttggtggctcacacctgtaatcccagcactttgggaggccaaggcaggtggatcacttgaggtcaggagtttgagaccagcttggccaacatggtgaaaccccatctctactaaaaatacaaaaattagctaggtgtgatgacaggtgcctgtaatcccagctactcaggaggctgaggcaggagaatcacttgaacccgggaggcagaggttgcagtgaactgagatcttgccactgcactctagcctggcaacacagactccatcttggggaaaaaaaagactcaagaaagagaatatacatgttattctaagtgacaactggtaacaaattgataactgccttctaggactcttatcaataccgaacattgaaatctggaggctcggccatcagaactcttacacagcacagaagacgagtttcacgggtcactcagcatctactggaagggtaaaatcagcttgcctttatttttatctggtaaatgggaggtacagcagtagctggtccagatgctcatagcatcatgataatccatttagcttctttgcatgtacatcttacactttttccatttgaatttggtatagaagtttgcccccaaataaacatcaggtcttcggtggagaagcctgagttggattcaccagttcagaggttgcctcagaagccagaaaaatatttcttggaggcaacccggtttcttattttttgtctgtgaagggcactgagcaagattccagagtgaaggtgagcccactttaacacaatctctcctatcagagaattaaagtgaaaactcaggaggcatctgaaaataggcctaattcaagttcagttttattgactggtaataacatctcatcaccagttcacaaggagcaatctcggaggatcacccaggtttgcctaaatcccagttgaggcttgattcaggctgggagtgaagttcttacatctctcccccggctcactgtaacacttaggagtgctacctcttatcattgggaagcctgttcagtgtggaatgatgctgggtcaaaatagaatgtcagcacttacgtattttacataaaaacataattcattgactttaaaaacactagtgcctctcactgccttctaggccccaccagacgttaaacactatgttattgcaaggcagagctcatttgtctcctgggatgttttaatgtgggttaccttcctgtacaagaacttcttactcaattaatcatatggacaataatagatcacaacagacaagctgcaatcatagatgtctgcagtcatttaggagctttaggccccaagaaaaggagctccagaatttcagagtaggtaaggtcctgtccttgagaccagccccctcatttgatgggtagggaacctgagatggagtgacctgctgaacaaaagtgacagtgctaggccaaccctgagtaacccctaagtcccagcttaaggatcttcccctattccacactccccactttcctcagttctaaaaatagatatgaatgggctttacatccagttataccaggattctcagctttgttttgtaataaattaaacccattaaaataaaagctaggtatagcaaacatgaagtgtaggagttcagtcagggtggtgggaacaattgtaagaggaaattacaggaaagagaagcaaaccttcttggaaggcctgggggtgttttacaaagctttggggaagaatgagccgaaggcggtggttcttatcctggggcagagggcgagaagtaggtacaaaataatacaagggagtttatctgaatagcttgtttactcatgtctccagaaacgtgacctttaatcatccatgtgtaattaccctgtagtggtgttgactcaaagcctttgtcattaaatctgtgctgaataaatgctggcagggccagctagtcaaggcatgcagctgccacagctctgagtggcccagccccctagctgctctttcactgaatattggtgtctgagtatgttattcatccatcgtgcagcctgggtctgtgggtcagaccccagtaatgaaacatttaattgactttttttttttttatattttcttgagcctaaaactaatttctaatggtctaaatggctcacatttcttttttttttttttgagacagggtctcactctgtcacctagactagagtgctagagtgcagtggcatgatctcagctcactgtagcctccatctccctgggctcaagcaatcctcccactttagcctcccaagtagctgagactacacgtatgcaccaccatggctaatttttgtttattttttgtagagacaagatttcacttagttgcccaggctgactcaagtgatcctcctgccttggcctcccaaagtgctgggattatgggtgtgagctactgttccaggcctcacatttccttaaaaagctgataagaaacatctgaatgttgtattcttttccttttctcagagtcatataacatccacggcagcattgaaagtgaaatgaagggcagacctgggggtgtgtggagagtaggggccactgagatgccctcttctctcctttagcttactgagtaacatctccaagttcctaggtgcaaatttaaaaatgaagtgcaggtgctaagtcaccaatgaacatcaggacctcaaatataagttaggaagaaagacttgtcttttagcatctctacccaagaaaaaggtatagagatttagctcagtctgatgtagggaggaggtggcaaccaagtgcactatggccaaaatgagggcttgtgattttatgtgcacttcattgctgatggcacccctgattcccataactgtggataatcttggtctggctacttctaaaatggatatctgggggacactgtagaagatggattaagccctttataacaataaactttcctggggctaactttagcaagaactgaaataggagataattttcagacttcaacattcagtgttcaaaggccaacagagccccatgagaagaatatgcacaacaaaaacagcatcatctttaaacaaggaactatcctgcttctcttcctacctccctcctctttcattattggagcattgaaaatactctcactgacaaaggcggcatgttttatttttccaattaggtttccttggaaactggtaaaaaggtatgtgcctatatagtgagtgtgtgggaggctcctaggagaagacatcttgagagtgtcttacctaattgcagggatggttggagaagggatcgagagacaaagacccacttttcatatggttttctactaaataggaagtcaagcccaaggctgtcttaaatacccattcttttacaacatggttgttataaaattaactaggataatccaggaaggcacttacaagagtatttggcacatagtgaacactcaaacattcaaacaaatgttacttaattaaagtaaatatttagaaaaataatttcttcaaagacatgtaggagaaaaaaagcttgactaggtgaattataacatttccagcaatatgattctataattatttgatttgaaggtggaaaatgcaaaaattttgtacctccatctatccacttacccaatatttatcaagcattcattgactttagtgatatcaataatttcttattctctcaggcaatgtgaataaatagaaagcctttgtaaataagatgaaaggcaaaatttcacagcactaaggagaaaatacgattttattccagtaggcaagctttaagtagacttactatcagaaacaaagcttctaagcagggggcaagactcataatattgtgacatcttaattctgtgttttgtgcagagctgaaaacaatggtagagttggaactcttgaaggtaaaattaccaaaagtgcatagtcacactttgaaacagggaaacgctctgaaatcaacaactatttgccaaatgaaaggtgcccccccagaaacattccatagaacactctccattttgtaagtttaaatcacactacacatttcacaaaggaaatacctataaactcccacccaaaacagtggctggctcagaaatagtaagttattctcacctccattgtttcctaaacatattgcctaattagtgggatcagcatactaatgaccttccttatgtcaatggactacaaaaatagaacattatacttgaaattgaaatatgggagactgacccataaaattattcactactgggttgtggatcattttggtctcaccgacccaaacacctgacctcacaatctctaagtgacacatggaaaatgaacttttgggaccctgaaactgtagtttaggacttgccaaacaaggtgtgctgtgagtcacttccaaagcaaaccccgagttcagggatggctttcctaagggctctaaggctgaggataaagcatcatttgcttttcttctttgaaaaggtatgaaaacagggagagtctggaagaagaaaaaccgttagaccatatgatagaaaccagagagctgtattcagaaaagttcagttactcaactctgatgtcagtccctactgactgttatagactgaaagtttatgagcccgccccccacccccaattcatattcccaaactctactctctacactcctctgtattcagagatgaggcctctaatgaagtgattaaggttaaatgaggtaataagggtggggccctgatccaataggatcataagatataccagaaggcttgtgctctctctctgtctctatgtccccctctttcccctcagggtgcacatgcaccaagggaaagccacgtgaagacataatgagacagcagccatctgcaaaccaaaacggaagcccttaccagagactgaatctgccagaaccttgatcttggacttccaacccctagatctgtggcaaaataaactgttgtttaagccaccaagtctctggtatttttttctggcagccccagtaggctaatacaatgcccataaggatgtttatctttttcaaaggtctcatttttgaatagatctttttgctttgaaataaatcattgtgttcacttagtttatttttaaattgtcccttttttccactcattctttattgagccatagaaagatctctatctttgttcttttaatttctcaatgtctttgcatttgtgtgtgtgtgtgtgtgtatatatatatatatatatagagagagagagagagagagagagagagagacagagtcttactctgtcacccaggtgggagtgcagtggcatgatcttggctcactgcaacctccgcctcccaggtttgaggaattctctttcctcagcctcccgagtagctgggattacaggtgccagccaccacacctggctaatttttttttgtatttttagtagaggtgggtttttaccatgttggccaggctggtcttgaactcttgacctcaagtgatccacccaccttggcttcccaaagtgctgggattacaggcgtgagccaccacacctggcctgtatttgtattttttaaccaactaattctctctactctgttcttatcctctactttcctatcacttacctcttatccataagataagtgaaaaagaggtaagtttacgtgtttcttattggaaggcaatgccatctgaaacatttgtcttgccttctgtgtgaacatcctaaaccaacagagctaacagttaagtggaaaacagacttttttttttttttttgagatggagtcttgctctgttgcccaggctgcaatgcagtggtgtgatctcggctcactgcaacctccgcctcctgggttcaagggattttcctgcctcagcctcccgagtagctgggactacaggtgcgtgccaccacacctggctaattttttgtatttttagtagagatgggatttcacccatccaggatggtcttgacctcctgaccttgtgatccacctgcctcggcctcccaaagtgctgggattacaggcgtgagccactgctcctggccgaaaacagacttcttaaaaatgataaatcgttgcttgcctgatggtagaaaatagtatactccctttataataccatcatatggtttgttttatatatagatggaaaaaatcaagaatttggcaccctaaacacaacatgagaaggtttcactcagtaatggcctcctgaaaacaacttaatcttcttggacaagactctgaactgaaatcaaggtttcaaaatattttgttgtgagtgatgaagctgtctggacctaacttttccgagaggccaagaaaccattctgtaatcctgcaaaatggtttctgaagagtctggtgaaatgcaactgttatccctcactttgcattttgctccaacgattctgaggtgcaacttatggatgagactgatttctttccatattgctgtagtaaattggtttttgttgttttcatgggctttgtaaatcttgctgataaaatccataagtgatttgctaacataaaagctaactggagaaacataaaaaataattcaaaaatcatttcatcttatcaactggattaaaattaaaattattagaaatactaatgatagtatttctttccagagtggtaatggagtttttttcctttttattaatagcccttaatgtatcttatgggaacaattaatagacattcttcaaactccttcagaaagcccaatgacaagtggcatttttaccagcgagattctcagcgaatatataattctttgtcaatattcaaattaaggcagaaactctagagtctgatctgtatctatttcatcttttaaatgtgttgaaaggcctctgagtgcatcttaagcagttggtaaatatttttcaggtcatcacatacaggaactggaccccagtttttcctaaaaaaatatgtatgtacagatgacagaaaaaaaattgccttcagaaaatggaacccatgtgccaaggcctggtcagtaaaaaaatccctaatttttgcttgttttataatttgtcttaggttttctctgacactagtggatttcttttttaaggcagtcatagttctaatactgttcaggccttgaaaaatccaatctaggctggattatggtggctcacacttgtagtcccagcacttttggagctctgggtagaaggatcgcttgaggccaggagtttgagaccagcctgggaaacacagcaagaactatttctacaaaagattttaaaaaattaactgggcatggtggtttgcacctgtagtcctaggtacttgtgaagctgaggtgggaggatcactcaagcccagaagttggaggctgcagtgagccatgactgcaccactgtactccagcctgggtgatggtgcaagaccccaactctaaaaaaataaaaataaacagtctgatgaagagtcttttgatattcttatttctttcactattcagctttggcatctctcccccagcactgctcttgtgttctagtggtgtcagacataaatacacacacaccgcttttcaccaatgcctctacttcttgggtggcagaacctcttattatacttcactgatgttccaggagattgaaaaaccagggaaatgcaattcttgcctatttatttttaaagtttgaaaatggtggacctgactgttaccccttaattaattatttagaaaggcgactttctctttggaggttcccaaaccctgtattaaacctcaccactgctaagcacttaaatgtttgcttactaaggataatattttaggaagaaagacatcatatgaattcaggtaccgtatgcttggataatcttagaaatccctatcagagctaacattttttgaccaacatttattacgaaatcttccaaagagggtctaaaatcatagctgcaactttaaacaacagtgacgatgccaatctgtaacaaaacttctgatttttataatgaccttcctccctccctcccttacttccttttccaacaatctgtaacaaaactgttggtttttataatgacccttccttcctttcatctgtaacaaaactgttggtttttataatgacccttccttccttccttccttccttccttcctccctccctccctccctccctccctccctccctccctcctttcctttcgatggggtctcctttgtagcctaggctggagtgcactagggtgatcatggctcattgcagcctctgcctcctgggctcaagtgatcctcccacctcagactccaaagtagctagaaccacaggtgcacaccaccatgccctgctaattttttgtatttttggtagagagagtgtttttgtgatgttgcccaggctagtctcaaactcctgagctcaagtgatccacctgcctcggcctcccaaaactgggattgattacaggtgtgagccaccatgcctggccatgacatgttttttaaaatcaacctcagagaactaaatttaatagtaggaagatatttttgagcatttctctttttaaaaagagaaattaaaaaaccacactcacttccatcatgttt

SEQ ID NO: 779 - DNA, 18575 bp, Homo sapiens
tataaatatttgaatgaatggatgaataatacacctgtgaatgaactgacgggggtgtgggagttgggggttctatctgttgccctcaagggcgtggctgtgggccacaacctgacagcagaggtccagcctgaagccaggtgcctttctacacaatgaagtgcagcccatggccaagtctctgtctacaccaggtgctggcagcagcctctgtcacccatcaacccacatcagtcaaaggctagggtgatcagaagctgcattactaagaatctagcatctgggacaaggcagtatcatcactctccccaactgagatgtgaggaatccttgaaaccagcatcagagcagagaggagagccgcgcagtgactgcaggtgtggcctttggaacacggcgttgatctctctgcaggaaggggaatcaaggagtttctggcctaaaggttgggctggtggcctccagggtttcttcctgggcagcccaacaccctcctgggcccctcctgggaggcgctcctttccccagaggccaggccaggctgcccacaagctctctgacatctctgccctctcggtgtctccccaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtacgtgccatgccccggggccacgagcccacatggctataatcttccctgcccgtcaatcccaggagctgtggatcatacacacgcacacaaacctgcacacaggcacatacgtgtgcacatgcatgcaaacgtgcacacagaaacatacgagcatgcatgcacaggcatgggcacacatatgaatgcaaaaacacgtgcatgcacagaaacacacgtgcgtgcatgcacccccacacacacaccttgttctacagctcccaaacgccaggtctcataacaagtccctctagcatacctgcatcctgctgaatgctaagctgcccttccagccctggtccacagggaaacccgagaggagctgctcagcagcattcctgcaacccttcgccttcttgaccctgaaggctggcaggtggcccccatgggatggcagggagtgatggggtgggacccccacttcaggtgaggggatcagtagcatcatccctgatcataagcatctctggggtgtttggagcgagccaccaaggccaagtgctgcgtgttcagcactcacctccatcctcagagcaacccctgggaactgagcttccgttatccctttttacagatgtgtcctctacggcctgcaccagagtccccccgcacgtgctctctgcccacccctctcctgtcctcgcccagccatgccagggagccatcctcagggcctgcccactcacatctgcatcatagacccccttctgaggaccacccacccgggcgcgctagcgtagtccacactgtctccatgaaatcagaatgccaggaagcccctgggctgcaagtggagaaggccacagactgcccctggggtgggctctccctgacccccaccactgccactttacggccgttctcaagtgtgtggttggtgtccgaggccctcctaggcactttgtgcatctcgcttcaccctcacacagccccgcagggtggagtccttattacggtcccttctccagatgagcagactgaggcccagcgaacctcggggccctcccaggtttcacagtgagttgcatgccaacgccagggcttagggcagctactggatctgatgctcagaccaggcctgggcagtggcctcctgcaccccatctgggcatcctccctcgacgggtgaaagatttatgtgactttaggctgatcaaagctgagagccacgtgcagaggccatgacaggcatgtcacgcgtgtgctacagcaggcggtgagacaggcctttgaaggggtgacttggcaggcacccgacagcactctcgggtcttcaaaggcacaaagagcactccgggggctgacagcccactccagccgctgcctcctcccagcttcctgtccccatctctttgtggtccaaaccctttcctgaggtctctctttagtggccgtcactctctccctgactcacaaatttgctgccctttcgtctgtcctgagggccgctctctcttccctcctctctgtctcagttctctccaccatcacaccctccttttttttttttcttaaagataagtctctcactctgtcgtccaggctggagtgcagtggcgcagtcatggctcactgtaacctcaacctcctgggcttgagcgatcctcccacttcagcctcccaagtagctgggactgcaggtgcacaccaccaggcccagctaattttcgtgtttttttcagagaaaaggttttgccatgttgcccaggctggtctcgagctcctgagctctagtaaccctcctgccttggcctcccaaagtgctgggattacaggcatgagccaccacgtctggccatgtctggcttttttcttccacttgccccctgcgcctggagggttctgcccatctctggccacctgagactcttacctgccagtcacacctaggaggatccactgtccccaccctcacccccagtcaccacctccagtctagccagcgatggatagacaggcctgtaggggctgggcagctgggtcttccttacttaggggagactcctgagctggccccacctcctgcttccctgggagtccccgggaattgcctttgaggcccccaagccccaggaaggaggggtttcttctggcatttgcagggtcacaggtgaggctggaggcgctgctgtcctcagcacccaagtctcctgccttctctggggtgccagcaggaaacagcccaaagagacacagaggctaattttgccctcaccctgcccctaccgtgacccctcctcagtaagtggcaccgacacccacggggccaagtgcaagtctgggggtcaccttgactggagaccctcctcccgccacgttctttgaacttccctccatccgctccaagtctctcccaatgccatcctcagccctgcagcagccctcactcccgatgccttcccacctcctcaccactctgcccccacctggccagcccatcaccctccagggcccaacttggagcccccaggacctccccgtgccctgcctgatgtcccgcctgtccccacagagcctcacttggtcaccacccagtcctggcccttgcttactgtggctgcaccccgaggtgtcctcagggtctagcaggtggctgcccagacatggaggtggaggaaggagtgggtggggatgggcttgtcctcccaggcctccctgcctgtcctgctggccacagccttggcttgcccaggagaagcccatgggccacacatcccactgccaatcccacagcgtcctttctcgggaacaccgtggggaaagctgtggcaccagctccttccttttgcaactctgatgaatctcacccagggatttcaaggcccctggtcacaccaggatcataggcctcccccatcccctggacacacagagacacacctggattcaggtcaggcctcgcccactctcggctatatttctccccaagccgtgtgtcctcagctgtagaatcaggaccataaggaagttccctcatagggttcttgtgaggacggcacgatttacgcaggggatgctgacaccgtgcctggcacgtgggacgcactccacccgcggcagccgctcccatggcttctcagtgagttttccagccacactgcacttcttagacaggaacactccatacgatgtccctgtcctgcactggagggcccaaaaatctgaaataagaggaggagtgcgtgtgaagctcccagtggagcgtttggcacctgtccagcatgtccccaagggcaagtcacggctctgagattcagtgtctccttctgcaaaatgggccaatagtggttcctccctcccagggctgaagtgaggatgaaatgggataatccacccccgtccccacaccctgcaggtcatcatgattgctagcagttgtgtggtggagcaggtgctcttgagggagcgacacctccaggtgctcccctgccctgctggcccctctgcagggaggtgacacccaggccccttcccctggggcagccagctcacgcccgtctctctcccacaggtgccactgcaggttcctttggcagtaagtacacgcctggggagggtggccagggcccccactgcacgagcctctttgcatgtcctggaaaaagctggagagaaaaaaggggcttcagtgtcccctctgggacttgggcctattcactccctcctctaattacaccccatctgcttctccacctctcccccctccacctccccccctccacccatccccacttcacatcatatgccatgtgtcatgtgtcattttgctgtggcctgtggcccagcaactctcaggctctcccaggagctccatcagtgctgctttggaaaacgggacaggactttttgcaggtctcttggcccctgggtgggctccctgctcctcctgccacccacgccacttctctcacctggatctgggagagcagtctctcctgccagtcaagagtggggtgaccttcccccaccaggggcagaatccaccccctagcctaaccatgggggcagcctccctctgggcagcctctgcagccagcttgtcccagggctctgctcgtccaggtcagctcaggtcccaggggagtcggaccagggaggggcatctgcaggaggtgggggtcctgagagttccccaggagggcgagggcgacatggcgcccacaggttatcagtaaatgtcatcgagactgtccccagacactcacagggtgccaggcacggtctctcctttcagccttgcaaacccctccccctgggaggtcgccatctgctctgcgaggcagcaggagaggactggccaatgtcaaagagccagccgggagcagaccccaaatctcagagatgcttctggggtgcaccgtcaccctccaccagggctctgtggggccccacatcccacccaagttgtccctcccggacccagggggcccctggctgggaagccagtgagccgagagggcgccagaaagaagctggaccctgcagggacgctggtctgcacagccgtcgtaagttgcttctctgtggtgtccccaccccggcaaccccccaaccctctcttgcttttcccatctctcaccaggcatcagcaggtcccagaaagaccccgaccccaaaggccctgtggccactgcggccaccacagccatgacaggggcccctactactcctgtcccctccacgtccactgcctgggcccccatggcgcccagcaccccacagcccacaggtgggtgccagggtacagcgacccctgtcatcccaccctctcctgcttctagcctgggtccctgcctctcttggggtgggagggtcggcagccctgggcagagagcaggggcttggctcttagaatagagacgctagaaccctagagctgggaggccacaggccaaaggggcttgaggacacctgggtcaacctgttcctgagcccagccaggggattcagggatcagttcagcttccaaagtcgtcttcctcctgcccttcaagccattgcttggaagggctcccagaccattgtggccagacggctgcaggaactgagaggaaaggtgctgggggcagcgaggccatcctgacatgcagccaaagactggccttatctcccaatggtgcttctgcctccgtggtccctggagccccgcccacaccctgtccccacctggcccccagggcctctctgtccttagcccctcagcagcacaccggtgggatggatggagcagggttagcccagaaagcaaatgtctctgatcagcagggcaaagggagcctctggagctgagtttggacaccgtgggctgctgggaatgtggaggctgtgtgtgtagtgcaaggccaggccagggccagacgtcctgccccctcaggggtctgccacagacaggcatggaaacctgattctcgctcccctccaacggagggattcacgtgtattcaaggctgggggtgctggagtgggcctctgctctcacctggactcacctggggagtatccctgcactctgtgcagtgcaggtgccaggggtctgaaaggatttatccttcccagagggcaccaggaagacgatgaccaaggggaattcttcctggtcccagccagggaggggtgctccaatagcctgccacaccctgtcccccgccaccctgcagggaggacctggtggggactcctggccccttgggtagtgccctggccctccatctctctgatccaaggagacctgccccactgatccttcccccttggggggtggcatttctaaagggcagagtcccctccatcagctcctgcctcggcctgttgctgggtggacactcaggctccccagacaggggcaaatgctgagagaaagacctcctccttcctaggccatccagagcagctcccctgggggcagcacaccccacctctttctacatccttccttttctgcaggaggcatttacaggaggcaggggctagccaaaagattggaggatttccgggaagcctcctgacccaggaatcctctttggggtggaagacatgggtcactctgagaattctggacttcagacataggttggcccagccacaagggacctgtgctttgctgctgagcctgtggtgggcagacagaagcaaaaacagtggtggtgggtgctgtgcctgtctccaaacaggggtttggctgggaggccagatactctccatatcacatgtgcaagtgcacacatgcacacacacacatgcatgcacacacacaggcatgcacacgcacatgtacacacacacacacacagaggaatccatttgcagagctgcttctgacttggtgccagggcagccgtgggaggctgggcagattgtgcaaagttgggaattaaagaggaaaagtcagaggccagagtgggaaatgcaggggaggtgagggtccccaggaccccctcagtgagcagaaggcacaccctccctctcggcaagacagtgctgctctgcaccctcagccctgtatcaagaagcaggacattaggggaggaggtggctccaatgtgacagccagtggcccctacagcccacatctaggggctcctccctcctcttcagcaactgaagcccctgtccagagcccccattaatgaaaacgatcattgcagtagctgagggtgagttctcctgggctgtgctcgtatcattgtatcatcatatcattgtattctgggctcacagctccgtgagatggaggctgttattttcctagtcccacaggtgaggggatcgaggcttaggaagaagcagctggattttatgatatgtaaattacacctcaatcaagctgtttcagaagaaaaaaggggcagctgctcaaggtctcagaattatggagaggcacgggcaggatttgaactcagggctcgccaactcagccacccaaagctattgtcctgaggcctccaggggctatgaggtagagctatcttttttttttttttttttgagatggagtttcgctcttgtcgctgaggctggagtgcaatggagcaatctcagctcactgcaacctccgcccccccaggttcaagcaattctcctgcctcagcctcccgagtagctgggattacaggcacctgtcaccatgttcagctactttttgtctttttagagagacagggtttcaccatgttggtcaggctggtgttgaactcctgacctcaagtgatccacccgcctcagcctcccaaagtgctgggattccaggcgtgagccaccgcacccggccaagtagtgctgtctccaaggcctggcttgcagggcttcccagttccaaaggagcagaccgggcttccatggggccttggcacagcacacaggccatggcgagaacttgcttcccacacacctgagtgtgtccctgggcagccaagccaggactctctccctccccaagaccctggtccctgaaagatcctgaatacccccgagtgcctcccaacaggtgcttcgggctctttgaacagagtccagctgggcctctgaactcctgggccagatgtttctcccgcctgccaatgtcaagctgtctggaggacagcgctgcgggcggaaaacgccgctggagacactaatcctttcctgggctgggccacggaggatggagggagacaggctctgaagcaaatgccttcagggctggctttctcatggctctaattaagcccttgccaatttgggcctggcggcctcatcttcccactgaacatcatattaaagtcaattcatgtccaaagctccccgctcccagctggaaagtcttccgcacttgttagctggtagcttttccttttctttccccacagccaccgttgtgtataatcccttcaagaagcggaaaacagcagcgctcccctgtccctctgggtttgtcctttgaaatttgggcacagggcagttctttgccagccctgcctgcctgccttgctggctgtgtgtcccgttagtctacgggctgagcgttgtgtcactggttcatgctggggtccctggtgaaaatgggccaggccaggggtcaggaaggtagaagggcagtgatcagggaagcaggtcagatgctggggaaggctccggtccctggattgcggctggacaggaaggacaccttccaggacacttctggacacatgtaagatcttggccggaacacatgtcccacttcgcagccattagccagagacatcagctcagagaggtctgggcccagaggcgggacctggtctagctctgtccttcagtcagaacggggacggcacagggagtgtagaagggtctcgctgaagaatatgcagattctcaggcatgggttcacctctcatctatcgggctttaagtctgcatgtgccctccacaggctgaaatagtgtagatgctgcctatgtagtagatttggacccaattcctttggccagtgtagacagagcctctccttatagtgctgctgcttctaaggggcctgtggggtgcggggctgtgatgcctcagtatgtacccagcttccctcagcaccaccccctcgcataacttggtttcttctcttcttccccccaagagtggaccaggccatctacggctgcccctctctcgagcaggtggtcccaggtggcctcccgtgcagaaggtatgggggggcaaggcctgtgatgggcctgagaccccggggaagcgccctcttagactcgtaggcccctccctctgtagtggaagtagcaggtgtgcatggtggggacctgaggttggaggggggccgcaggaaccaactgagggcacgggtgtagaatgtcggtgcctggggagctctagggcacagtggtgagggagcggcctggtagagcaggtctaccagctctgcccccaagctcacctgcttcaagaggttccatgtggcacccccacgccaagcccttccaccagcactccctccgagggcttcggagtctggtagaggccccgcctcccacgacaggaacccccctctccagctgcccttgctcacaggacacctgggcagttgctggatcagagagtcagagggggcttcctgcaggagcgggggccatgagacctcggagggtggactgtggtgggtgaagggagaaggcagcacattccaggccgcagggccagccggggcaaaggcttggcagtgggatggcagggagcctgacaaagtggaaaatgtgtgggttaaaggagggagggcggggtcctggaagacactgacatcctcctgctacgtgggaggagacacagggctcatctgtagccatagacagacatgccaaggaaacgcgcaggcctgcccgactctccagaagggaaattgtccctggccccagctcaccaagcctgggtggggaattagggcctgaggtctagggaacaggtgagctgttccttccagctcacatgttcaaatttcctccagccccagctctgagcagcgagcagggctttgagcgccctctactggcaggaagctctggcgctggaagcatgtttagagagggtctgaggctcggttcctagaaacctggaggacctgggcctggtgtcctctgtggtgatggagacagagctggcgggagccatcgcttccctaccctgggccaaccagggcaccacagacccccagagggaagccaaggtagtgacgatcccgggacagtggcctgctcacccacagatagggcgttggggtcccagcgggattctgggcagtggaaggcaggtgccgtccgtgttcctggcttgacagcacttgcgagtgggactccagggacagcgaaggattcacttcggctggagcaggaagagtgtttcagaaaggaagggagatgccaaagtccttaaatgccaagtttagtctctgggtttgatgctccaggaagtttggagaggcggtggggagagcaagagacgggcgtggtgtgcaatgtgatgtcaatctatctaaaaacagtttggcttccaagaaggtcttagcagggcgcgggggtgtcaggggttacagaagtcatttggaggattaatccagccagatgtgtccatggtctcagagaggggaccaagggcagggctgatttgcaagcttgggatgtgctgtgtttccttcaggaaggggccccacctccctgggctcttcgaggagaggggctgtgtgatttgaggccagaggggcctctccctccctcacatctgagcaggcgacaaggctgcctgccctagagctggcccagggcggctcggaagcctttgctgggctcttccctgggcagtgggaccatgacagacgaaagaacctgtttctcatctctccaagctgtgggcacccctgccgctgcccctgcccctgccaagggctacaaacttttccagctcaagcccaaatctcctcaagtgatgcctattgaagaattccaaggtaagaggatggacctggggccccatcagccctccctgacacctgttccccatccgccgctggaaaaagacggtgcaggatagaggaccgatgcctggctccgaaaaccctcctggagtagctgggtcaaggttaaactgagtctctcttccctacaggcctccctccccaagggagctgggagcaggtatgagtcagaagccaacttgggcacagtgggcaggccacacagcaggcagagcagatgccagaaatagcccatcccggctcccctgggaggtgtggccctggggctcgtgttggttgaagcagaatctgggacacacgggtcaccgatgctgctctttgggacacttagaggatgcctcatctcctcattatctctggagggacaaagtgaagggggcaggactaggtggcccacaggtgggagtgcccaccatctctcctgggcacaggctgtttctctagtctcccatgcccttgaccactgggtcagtccctcatcccatcacaaaagggaagctgggtcctctagagatacacagatggtgtttcaagagggtggccgttgtccttccttgttcgggggcagccacattggctttcttgctggagggtgggtgggtgggtgagtactgtgtcccttcgtaggaacatcaagggatgcccccccattcttagggatggtgaccttcctcaccaaatcctccattgacaatgtgggattcacctccaatccctgagagccttgccccaggcagtcacgggcttgtctggtccttggagcggagctggttaggcaggggtcagcctgagaaccacgtaggggtggggtgcaggaggcggcaggacatggtggtggtggtccttggtatgaaaccatgtgcttccaggagcagcgagtcagaagccgggccaggaccagggggaggcatgcaggttcccagggctcctgctttaaagtggcactcactcttagcatcctgcaaaacaatcaaacttgcagaaagctcaggctaataagaaagggtctggcaggtgggcgttttcctcccagccatcttccaaagcagcatgggcaggagctcctggcccattgcatcttgtccagcgtccatccatgcattcatctacccgaggataccacggcgagcgccgtgaacccaggcgtcgccctcccccagtgcacagccaggtggcatgaccctgccctccttgcatgaatcactttctaatcaccccggcatgtgggcatccttcagcgagcgcttggccctggtgcccagccaggcattagcaggagctgcccactggccctccctggttccctgcccacagggccaggtgggaatccctgggctcagcctactcaggttctcctctgggctcaaagcagggaggcctctctcttcctgaatccgatggaagggtgggaggcctagggcaccttccggtaccttttccaaagatgccttcctccgtccctgcatgacctggggtgagtccttcctcgccctgtccctcagtttccctgaatgctcgctgaccattggtatttctcccacttggccggcccagactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattggtgagagggcacggacacggcacagggaacttgctggaatgcgtgcagggtgcactgccctgcgaggtggcctctggggccccctgcatcagaatcacctggggagactgtgggaattctaactccagggccctctccagttgagcatctctaaggacagaaagctccagaaactgctctattagtaacctacccttgcggttctccggtaagttttgcactggagttgcaaaacttaccagtggcccttccctctctgggcaactggaggggacactgacccttcctggctccaaagagctgtgactctggcaggtggcaggcactcagtggcagaggccactgagcatctgtctggggctggtgtgtgggggggtccccctccatagctcctttccagaaaggtggaggagcagcctatccctcctcctgcaggggcccagttgggggccaaaagatcgccttgctgcgtgcatttgtgcaagtcccttcccgttcctgggcctcagcttcctcattcatcaaattgggaggcagatcagatcaaaggttttcagctcttttttgtggctgaagcttttcttcaaatgctttaccagcccaggtccagctataaagctgctcttcacccctggtgggcacccagtctgctttcttccaagttctactcaaggactggcttttgggtagagaaggaagtccatcagggccctgggcctgggcaaagaccaaagccatgaccgccaaccaaaacgcaccagcctggaatggttgcccctgtcgtcagtagaggccaggtctcggcctcaggggctgtcccccaaccctgcccagccaggccccttgggacaccatcacccatcccccacccagcaggaggctctggctgcccagaggaggggctcctgcaaagctggagctgtcggtctgaattctggcggcagccttcagataattccatcaactctaagtgatcaaagccgctgacgtcacagggggccagctgcagggacagggcagggcctttggatccaattagaggtgcccacaccctggcaccctcctcctctccctggctctccctgcctccaccccgagagccagcactgagctgcaaggtttctcagggtggacgatattcaccctctcccacagagccccaaggcaaccaactgggcccaccccgggagcaggaataggctgttcctccactcccctgcaaaggagctatggaggggggccaccccacaacacagcagccccagacatgctcagtggcctctgctgagtttctgccacctgtcggagtcatagctctttggagatgggaaggacagcgacccctctagttgcccagagaggggaaggggctgacccaggccacaccagtgccagggcggggaaggtggggctgggacgtgtttgatcccaaggaaggaagccagagtcttctctccaggcctggccaccctgggaagtccccacctgccgtccagccgcgggctcacgtggacccagtgtggggagcatcccctggggagtgtggagatgctccctgcgaggccgggagagtgggggtccgagaagacggcgcccacacgtagccctgaccgcgcgcccgtgcccgtgtccgtccagagtgtaactgcaaccagataggctccgtgcacgaccggtgcaacgagaccggcttctgcgagtgccgcgagggcgcggcgggccccaagtgcgacgactgcctccccacgcactactggcgccagggctgctaccgtgagtgcgcgccgtcccccgtgggcggggcctgcggaaaggggacggggcaggaccgaggcagtgggcggggcctagtgggacggggcaggggcggtggactgggcctagcaagacggggcagggccggggaagtgggtggggcctagtgggacggggaagaggcggtgggcggggcctcgcgagacggggcagggccggggcagtgggtggggcctagtgagagcggggcagggttgggatagttggcaggggcctggtgagatggggccgacccgggggcggtggacggggcctagcgagacggagctggcaggtgggcggggacaggatgctgctgaggtccggggccgggccgaggggcgggtccaagagctcggggcggggcctgatgcgacctgaggcacggtggtgcctggtgggaactacgagaaagaccgagctggggttggttggaaaggtatttgcggggacagagggagggaggctgtccaagtcggcgttagccgcgggcacagggtgaaaggaggctccaggcgcgtggaacagcacgtgcacagctctggagactgcaggcgcgtctgaagaacagcaccgaggccagtggggcggggagagaggggcagcggtgggaggcagccgggggccagatctcgcccgggcgccgtcaccctccgaggggggacgtttcgcacccagcgcgcctggagcctcctacatccccggcccagacggcgcccccgggatctcgcacaccctgcttcgcaggagctcggaggttggcggggggaccgggccaccccccgtgctgaccgccccctccgcctgcagccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcctccacggcctgttttctttctgtgttggggacggtgggcaggtgtggggcttacagaggaatccacaacacagccttaaagaaacggtttccctactggggccaccatttccctgggcctttctgtggattccagcaggcagtgccccctccccgcaggcttggctggcagagttttccaccccgcggccaggctgcaggtgccccacctgttaggagcctccccacactgaaaggctgcctccctcctttcccaaaaaagaaatccggagtgtattggcccttttctacagaagtccaagggaaatgactcagggagaatcctagcagaggttgaatccaatgctctgatttatactgtgtctcggtggccacctccgatggatgtgtcatctcagacctgttgcagccggagcctcaagtccaatatcagatgaagctgaacccacaattcggccaccgcctccttccagagtttcagatggccaggtgggcagaggcgggcagtgcagagaccccagacgtgccggccctgtcctccctaccttctcaagattaggaaggggtgctggaggggacaggggcagcttgggagtggtgaggaagctcctagattcggggctcatcccctggggcctctgattcagaggatccagcagttctcccatctccgcttggtgtctccagccctggggccacacttccccctcggtccagcctcctgtccacctatgtttatttcagagcagtgccgggggtccggtcctggttgctaactgctgccactgctccacctgcaggtgctcccagcactggcttctgccaccacacctgttctttcccagctgcgaggtttagacctgggtccttcccttgagtccccaaagctaagctaagaccaagtggaacaaacttggccttggggacagcaggagattacaacacagaaaaggagggggaggcacaacgggacactgcataggactcacagtgtcccgagcccacacaccagcccctcctggcctcctctctctgctcccacccccagcaccctgctgacccggaagtgccttccgacaggccctgcatcctcctgcagctggcccatctctaccctcacattcttccttacgcacagaaccccactgcctgggacccaaagtgcccagataaaataaaacacctctctggggcttcttgtggataggagtggccaggggacacagctctgggcagtgagatgtaagcaggactgatgggtgggcttccagaaagttcttaaaagtcatcccttcctccacgccccacaaagcctcagttgtccaagtttgtggctctggtttttctctctcatccctccctctgctcttcagtcagcaggatggggaaggagccttcttgagacactgagcataacagtgtcaccctcaggatagtgaagggtggagccgggggtggaagttgcagagcctgggacacctgccttggctgcaacctctgcactgcttttatttatctacttatttttatagagttgaggtctcactatgttgcccaggctggtctcaaactcctaggctcaagtgagcctccggccttggcctcccgaagtgctgagattacaggcatgagccaccgcaccacctgcctgtcttactgtgtgagaaaaaaaataaacggtgatgtgattaaaacactagaatttgggttttctgttccatgcacactttccaagttcttggccctgcctgattggcatccgggccccctgagccctctaaggccagagagagactgaaacccacccttccttggccgcagccccccatggtgaccctcaagtcaccaggaagaggaatgtccatgactcaggccgaggagtccacctctgtccagaacaggactgcccctgccttctagtgagcacagggcagctgagcagaactcaccccagagaaacagcagcgctggccgcagtcggtaaacagcaggcatttcctcct

SEQ ID NO: 780 - DNA, 21696 bp, Homo sapiens
gatttaccataatttccctaaccattctgcaggataattcgaggacagagagaagaccccaaggaggaaggcagccctggttaccaaagctggcagatgggggttagctggaagccccagggctggtggacgcaggggccgctgtttccccacccagatccttgctctggaaggcggcccccaggggacccttcattcccactcagacagggacagaggcgggacagagccgagggaggagggctcagatgaagcacctggcaggactgagatatgagggaggccggatgcgaggagggagctctgcagcctgtggtgtccaggaggatttggggagtgtgaggtgagaaaacaaaaagcgtcacccctcccagtggaaggggagcatgaagagagaagaaaatgccagttacacatcctcaaaacaatctctgaatggacgagagccagtcagggggaaacggaagttgcagtgagccaagattgtgccacggcactccagcctgggtgacagagtgagactctgtctcaaaacacaaaaagatgccgcacaccccaggcgggacgggtgggcccaggtgccctgccctggtccaggcctctattcgcaggatctcactgatctctccctgcccaggcttttgtctcccagacaaaccagtctccatgaagcagccacagcgttataaaatatggcccagagcaggacacgcctaaccagtcaaaggcttgcagagtaaaatcccgcctccgtctcctggtctggcctcctccaccccccagcctcattgcagacctcacgggtggaacttctttcagccctagggctttcctcatgctcttgcctctttctagaaggttctccccttctggcccggcaactcttgatcctccttcaggtcttagtttaaaactgttcttcctggaaactgtggactcccgtgatgccttcttctttgcacaacccgtgggctcttttaacagttgaacactggaagaggtgtgtgattcgtattgttataattaatagactttatttttagagcagttttaagtttacagaaaattgagcagatagtacagaaagttcccatttccccacccccctgcacagtttcccctattttggagtatatgtgttacaatgatgagctaacactgatacagtgtcattcactagggcctgttatttacattaggactcactctgtgttggacacttcagtgggttttgccatatgcataatgccacatatctaccattgtggcatcataaagaatggtttcaccgccctaaaaatccctgtgtgccacctatttatcctccctccctgtcccctccaatcactgattttgttcattgtctccctgctagacccgaagcaccatcaggtcagggagccatctgctttgttgacattatactcactgttcccagctcagagcccctgccacataacaggtgcctgataaatatttttctttgcatattttaataaaaataggattctactaaacccattgctctgcaatttgctttttccaaatattgacaatatatcttggaaatcttcccatatcagaatatagagcacactctgtctctctttcactttttattatggagaatttccaacacaaaagaagatggtgtctgccatgatgaacctctgtgtacctctcacccgactgcagttaccaactagtgaatcttcttgtttcatctgtacctctgcccatcagataatttcatctgtaaatatttctatgtgtatctctctctgcttttttttttccttttgagatgtagtctcgctctgtctcccaggctggagtgcagtggtgcaatggctcactgcaacctctgcctcctgggttcaagcgattctcctgcctcagcctccccagtagctgggattacaggtgcaccatcacacttggctaattttgtatttttagtagagatggggtttcaccatgtcggacaggctggtcttgaactcctgacctcaagttatctgcctgccttggcctcccaaagtgctaggaatacaggcataaaccaccatggctggcccttttgttttgtcttgttttgtttttgtttttgttttgtttgtttttgttttgttttgttttgttttttttggagacagagtcttgctctgtctcccaggctggagtgcagtggtgcaaacatggcttgctacagccttgaactcctgggctcaagggatcctcctgccctagcctcttgagtagctaggactgcaggcatgtgccaccacactggctaatttttttattttctgtagaaacaggatcttactatgttacccagtctggcctcaaattcctgggctcaattgatcctcctgcgtcagcctcctaaagtgcttggattataggtgtgcaccaccacgcctagcctgtgtggttctctaaaagataaggactttaaaaaacataaccacaatatcatcatcacacctagtaaacattagtatctaatataggcaatgtccaaatttccagttatctcataaatatacgttccatttgtttgcgtgtttgattttacaggatgtttgaaccaaggaccagaggagcttcacttctgccattaattggtatgcttttgaggtttctcttgctctaggtccatcctttttccgtatcaattttttctccacgcaactcatctgttggaagaagtgggtcattactgccggagtttcctcgagtccagatcttgcggatggcatcccctggtgtcgttcagggtgatgctctgtcctctgtctttcctgtgcgctcacagctgggtctagaggcttgatctgattcaggttcagttgctttggcttcgggtgggggtgtgttcttctagagacgctcactgtctgctggcctctcagtgggaagttctgggctggtgcggctcagtgcctggagctatgcattcatcagggactgcaaattctctcgtgaaatgcttctataaaaagaagcttcccctcatcaactttcggttaccccgaggtacagtttatataggacaggcaggataaatgcttgattctttccctttatttaccagttttcagaataatgagtcgcctataaatatttgaatgaatggatgaataatacacctgtgaatgaactgacgggggtgtgggagttgggggttctatctgttgccctcaagggcgtggctgtgggccacaacctgacagcagaggtccagcctgaagccaggtgcctttctacacaatgaagtgcagcccatggccaagtctctgtctacaccaggtgctggcagcagcctctgtcacccatcaacccacatcagtcaaaggctagggtgatcagaagctgcattactaagaatctagcatctgggacaaggcagtatcatcactctccccaactgagatgtgaggaatccttgaaaccagcatcagagcagagaggagagccgcgcagtgactgcaggtgtggcctttggaacacggcgttgatctctctgcaggaaggggaatcaaggagtttctggcctaaaggttgggctggtggcctccagggtttcttcctgggcagcccaacaccctcctgggcccctcctgggaggcgctcctttccccagaggccaggccaggctgcccacaagctctctgacatctctgccctctcggtgtctccccaggtgcaagtgcaacctgcacgccaacctgtgctccatgcgcgagggcagcctgcagtgcgagtgcgagcacaacaccaccggccccgactgcggcaagtgcaagaagaatttccgcacccggtcctggcgggccggctcctacctgccgctgccccatggctctcccaacgcctgtacgtgccatgccccggggccacgagcccacatggctataatcttccctgcccgtcaatcccaggagctgtggatcatacacacgcacacaaacctgcacacaggcacatacgtgtgcacatgcatgcaaacgtgcacacagaaacatacgagcatgcatgcacaggcatgggcacacatatgaatgcaaaaacacgtgcatgcacagaaacacacgtgcgtgcatgcacccccacacacacaccttgttctacagctcccaaacgccaggtctcataacaagtccctctagcatacctgcatcctgctgaatgctaagctgcccttccagccctggtccacagggaaacccgagaggagctgctcagcagcattcctgcaacccttcgccttcttgaccctgaaggctggcaggtggcccccatgggatggcagggagtgatggggtgggacccccacttcaggtgaggggatcagtagcatcatccctgatcataagcatctctggggtgtttggagcgagccaccaaggccaagtgctgcgtgttcagcactcacctccatcctcagagcaacccctgggaactgagcttccgttatccctttttacagatgtgtcctctacggcctgcaccagagtccccccgcacgtgctctctgcccacccctctcctgtcctcgcccagccatgccagggagccatcctcagggcctgcccactcacatctgcatcatagacccccttctgaggaccacccacccgggcgcgctagcgtagtccacactgtctccatgaaatcagaatgccaggaagcccctgggctgcaagtggagaaggccacagactgcccctggggtgggctctccctgacccccaccactgccactttacggccgttctcaagtgtgtggttggtgtccgaggccctcctaggcactttgtgcatctcgcttcaccctcacacagccccgcagggtggagtccttattacggtcccttctccagatgagcagactgaggcccagcgaacctcggggccctcccaggtttcacagtgagttgcatgccaacgccagggcttagggcagctactggatctgatgctcagaccaggcctgggcagtggcctcctgcaccccatctgggcatcctccctcgacgggtgaaagatttatgtgactttaggctgatcaaagctgagagccacgtgcagaggccatgacaggcatgtcacgcgtgtgctacagcaggcggtgagacaggcctttgaaggggtgacttggcaggcacccgacagcactctcgggtcttcaaaggcacaaagagcactccgggggctgacagcccactccagccgctgcctcctcccagcttcctgtccccatctctttgtggtccaaaccctttcctgaggtctctctttagtggccgtcactctctccctgactcacaaatttgctgccctttcgtctgtcctgagggccgctctctcttccctcctctctgtctcagttctctccaccatcacaccctccttttttttttttcttaaagataagtctctcactctgtcgtccaggctggagtgcagtggcgcagtcatggctcactgtaacctcaacctcctgggcttgagcgatcctcccacttcagcctcccaagtagctgggactgcaggtgcacaccaccaggcccagctaattttcgtgtttttttcagagaaaaggttttgccatgttgcccaggctggtctcgagctcctgagctctagtaaccctcctgccttggcctcccaaagtgctgggattacaggcatgagccaccacgtctggccatgtctggcttttttcttccacttgccccctgcgcctggagggttctgcccatctctggccacctgagactcttacctgccagtcacacctaggaggatccactgtccccaccctcacccccagtcaccacctccagtctagccagcgatggatagacaggcctgtaggggctgggcagctgggtcttccttacttaggggagactcctgagctggccccacctcctgcttccctgggagtccccgggaattgcctttgaggcccccaagccccaggaaggaggggtttcttctggcatttgcagggtcacaggtgaggctggaggcgctgctgtcctcagcacccaagtctcctgccttctctggggtgccagcaggaaacagcccaaagagacacagaggctaattttgccctcaccctgcccctaccgtgacccctcctcagtaagtggcaccgacacccacggggccaagtgcaagtctgggggtcaccttgactggagaccctcctcccgccacgttctttgaacttccctccatccgctccaagtctctcccaatgccatcctcagccctgcagcagccctcactcccgatgccttcccacctcctcaccactctgcccccacctggccagcccatcaccctccagggcccaacttggagcccccaggacctccccgtgccctgcctgatgtcccgcctgtccccacagagcctcacttggtcaccacccagtcctggcccttgcttactgtggctgcaccccgaggtgtcctcagggtctagcaggtggctgcccagacatggaggtggaggaaggagtgggtggggatgggcttgtcctcccaggcctccctgcctgtcctgctggccacagccttggcttgcccaggagaagcccatgggccacacatcccactgccaatcccacagcgtcctttctcgggaacaccgtggggaaagctgtggcaccagctccttccttttgcaactctgatgaatctcacccagggatttcaaggcccctggtcacaccaggatcataggcctcccccatcccctggacacacagagacacacctggattcaggtcaggcctcgcccactctcggctatatttctccccaagccgtgtgtcctcagctgtagaatcaggaccataaggaagttccctcatagggttcttgtgaggacggcacgatttacgcaggggatgctgacaccgtgcctggcacgtgggacgcactccacccgcggcagccgctcccatggcttctcagtgagttttccagccacactgcacttcttagacaggaacactccatacgatgtccctgtcctgcactggagggcccaaaaatctgaaataagaggaggagtgcgtgtgaagctcccagtggagcgtttggcacctgtccagcatgtccccaagggcaagtcacggctctgagattcagtgtctccttctgcaaaatgggccaatagtggttcctccctcccagggctgaagtgaggatgaaatgggataatccacccccgtccccacaccctgcaggtcatcatgattgctagcagttgtgtggtggagcaggtgctcttgagggagcgacacctccaggtgctcccctgccctgctggcccctctgcagggaggtgacacccaggccccttcccctggggcagccagctcacgcccgtctctctcccacaggtgccactgcaggttcctttggcagtaagtacacgcctggggagggtggccagggcccccactgcacgagcctctttgcatgtcctggaaaaagctggagagaaaaaaggggcttcagtgtcccctctgggacttgggcctattcactccctcctctaattacaccccatctgcttctccacctctcccccctccacctccccccctccacccatccccacttcacatcatatgccatgtgtcatgtgtcattttgctgtggcctgtggcccagcaactctcaggctctcccaggagctccatcagtgctgctttggaaaacgggacaggactttttgcaggtctcttggcccctgggtgggctccctgctcctcctgccacccacgccacttctctcacctggatctgggagagcagtctctcctgccagtcaagagtggggtgaccttcccccaccaggggcagaatccaccccctagcctaaccatgggggcagcctccctctgggcagcctctgcagccagcttgtcccagggctctgctcgtccaggtcagctcaggtcccaggggagtcggaccagggaggggcatctgcaggaggtgggggtcctgagagttccccaggagggcgagggcgacatggcgcccacaggttatcagtaaatgtcatcgagactgtccccagacactcacagggtgccaggcacggtctctcctttcagccttgcaaacccctccccctgggaggtcgccatctgctctgcgaggcagcaggagaggactggccaatgtcaaagagccagccgggagcagaccccaaatctcagagatgcttctggggtgcaccgtcaccctccaccagggctctgtggggccccacatcccacccaagttgtccctcccggacccagggggcccctggctgggaagccagtgagccgagagggcgccagaaagaagctggaccctgcagggacgctggtctgcacagccgtcgtaagttgcttctctgtggtgtccccaccccggcaaccccccaaccctctcttgcttttcccatctctcaccaggcatcagcaggtcccagaaagaccccgaccccaaaggccctgtggccactgcggccaccacagccatgacaggggcccctactactcctgtcccctccacgtccactgcctgggcccccatggcgcccagcaccccacagcccacaggtgggtgccagggtacagcgacccctgtcatcccaccctctcctgcttctagcctgggtccctgcctctcttggggtgggagggtcggcagccctgggcagagagcaggggcttggctcttagaatagagacgctagaaccctagagctgggaggccacaggccaaaggggcttgaggacacctgggtcaacctgttcctgagcccagccaggggattcagggatcagttcagcttccaaagtcgtcttcctcctgcccttcaagccattgcttggaagggctcccagaccattgtggccagacggctgcaggaactgagaggaaaggtgctgggggcagcgaggccatcctgacatgcagccaaagactggccttatctcccaatggtgcttctgcctccgtggtccctggagccccgcccacaccctgtccccacctggcccccagggcctctctgtccttagcccctcagcagcacaccggtgggatggatggagcagggttagcccagaaagcaaatgtctctgatcagcagggcaaagggagcctctggagctgagtttggacaccgtgggctgctgggaatgtggaggctgtgtgtgtagtgcaaggccaggccagggccagacgtcctgccccctcaggggtctgccacagacaggcatggaaacctgattctcgctcccctccaacggagggattcacgtgtattcaaggctgggggtgctggagtgggcctctgctctcacctggactcacctggggagtatccctgcactctgtgcagtgcaggtgccaggggtctgaaaggatttatccttcccagagggcaccaggaagacgatgaccaaggggaattcttcctggtcccagccagggaggggtgctccaatagcctgccacaccctgtcccccgccaccctgcagggaggacctggtggggactcctggccccttgggtagtgccctggccctccatctctctgatccaaggagacctgccccactgatccttcccccttggggggtggcatttctaaagggcagagtcccctccatcagctcctgcctcggcctgttgctgggtggacactcaggctccccagacaggggcaaatgctgagagaaagacctcctccttcctaggccatccagagcagctcccctgggggcagcacaccccacctctttctacatccttccttttctgcaggaggcatttacaggaggcaggggctagccaaaagattggaggatttccgggaagcctcctgacccaggaatcctctttggggtggaagacatgggtcactctgagaattctggacttcagacataggttggcccagccacaagggacctgtgctttgctgctgagcctgtggtgggcagacagaagcaaaaacagtggtggtgggtgctgtgcctgtctccaaacaggggtttggctgggaggccagatactctccatatcacatgtgcaagtgcacacatgcacacacacacatgcatgcacacacacaggcatgcacacgcacatgtacacacacacacacacagaggaatccatttgcagagctgcttctgacttggtgccagggcagccgtgggaggctgggcagattgtgcaaagttgggaattaaagaggaaaagtcagaggccagagtgggaaatgcaggggaggtgagggtccccaggaccccctcagtgagcagaaggcacaccctccctctcggcaagacagtgctgctctgcaccctcagccctgtatcaagaagcaggacattaggggaggaggtggctccaatgtgacagccagtggcccctacagcccacatctaggggctcctccctcctcttcagcaactgaagcccctgtccagagcccccattaatgaaaacgatcattgcagtagctgagggtgagttctcctgggctgtgctcgtatcattgtatcatcatatcattgtattctgggctcacagctccgtgagatggaggctgttattttcctagtcccacaggtgaggggatcgaggcttaggaagaagcagctggattttatgatatgtaaattacacctcaatcaagctgtttcagaagaaaaaaggggcagctgctcaaggtctcagaattatggagaggcacgggcaggatttgaactcagggctcgccaactcagccacccaaagctattgtcctgaggcctccaggggctatgaggtagagctatcttttttttttttttttttgagatggagtttcgctcttgtcgctgaggctggagtgcaatggagcaatctcagctcactgcaacctccgcccccccaggttcaagcaattctcctgcctcagcctcccgagtagctgggattacaggcacctgtcaccatgttcagctactttttgtctttttagagagacagggtttcaccatgttggtcaggctggtgttgaactcctgacctcaagtgatccacccgcctcagcctcccaaagtgctgggattccaggcgtgagccaccgcacccggccaagtagtgctgtctccaaggcctggcttgcagggcttcccagttccaaaggagcagaccgggcttccatggggccttggcacagcacacaggccatggcgagaacttgcttcccacacacctgagtgtgtccctgggcagccaagccaggactctctccctccccaagaccctggtccctgaaagatcctgaatacccccgagtgcctcccaacaggtgcttcgggctctttgaacagagtccagctgggcctctgaactcctgggccagatgtttctcccgcctgccaatgtcaagctgtctggaggacagcgctgcgggcggaaaacgccgctggagacactaatcctttcctgggctgggccacggaggatggagggagacaggctctgaagcaaatgccttcagggctggctttctcatggctctaattaagcccttgccaatttgggcctggcggcctcatcttcccactgaacatcatattaaagtcaattcatgtccaaagctccccgctcccagctggaaagtcttccgcacttgttagctggtagcttttccttttctttccccacagccaccgttgtgtataatcccttcaagaagcggaaaacagcagcgctcccctgtccctctgggtttgtcctttgaaatttgggcacagggcagttctttgccagccctgcctgcctgccttgctggctgtgtgtcccgttagtctacgggctgagcgttgtgtcactggttcatgctggggtccctggtgaaaatgggccaggccaggggtcaggaaggtagaagggcagtgatcagggaagcaggtcagatgctggggaaggctccggtccctggattgcggctggacaggaaggacaccttccaggacacttctggacacatgtaagatcttggccggaacacatgtcccacttcgcagccattagccagagacatcagctcagagaggtctgggcccagaggcgggacctggtctagctctgtccttcagtcagaacggggacggcacagggagtgtagaagggtctcgctgaagaatatgcagattctcaggcatgggttcacctctcatctatcgggctttaagtctgcatgtgccctccacaggctgaaatagtgtagatgctgcctatgtagtagatttggacccaattcctttggccagtgtagacagagcctctccttatagtgctgctgcttctaaggggcctgtggggtgcggggctgtgatgcctcagtatgtacccagcttccctcagcaccaccccctcgcataacttggtttcttctcttcttccccccaagagtggaccaggccatctacggctgcccctctctcgagcaggtggtcccaggtggcctcccgtgcagaaggtatgggggggcaaggcctgtgatgggcctgagaccccggggaagcgccctcttagactcgtaggcccctccctctgtagtggaagtagcaggtgtgcatggtggggacctgaggttggaggggggccgcaggaaccaactgagggcacgggtgtagaatgtcggtgcctggggagctctagggcacagtggtgagggagcggcctggtagagcaggtctaccagctctgcccccaagctcacctgcttcaagaggttccatgtggcacccccacgccaagcccttccaccagcactccctccgagggcttcggagtctggtagaggccccgcctcccacgacaggaacccccctctccagctgcccttgctcacaggacacctgggcagttgctggatcagagagtcagagggggcttcctgcaggagcgggggccatgagacctcggagggtggactgtggtgggtgaagggagaaggcagcacattccaggccgcagggccagccggggcaaaggcttggcagtgggatggcagggagcctgacaaagtggaaaatgtgtgggttaaaggagggagggcggggtcctggaagacactgacatcctcctgctacgtgggaggagacacagggctcatctgtagccatagacagacatgccaaggaaacgcgcaggcctgcccgactctccagaagggaaattgtccctggccccagctcaccaagcctgggtggggaattagggcctgaggtctagggaacaggtgagctgttccttccagctcacatgttcaaatttcctccagccccagctctgagcagcgagcagggctttgagcgccctctactggcaggaagctctggcgctggaagcatgtttagagagggtctgaggctcggttcctagaaacctggaggacctgggcctggtgtcctctgtggtgatggagacagagctggcgggagccatcgcttccctaccctgggccaaccagggcaccacagacccccagagggaagccaaggtagtgacgatcccgggacagtggcctgctcacccacagatagggcgttggggtcccagcgggattctgggcagtggaaggcaggtgccgtccgtgttcctggcttgacagcacttgcgagtgggactccagggacagcgaaggattcacttcggctggagcaggaagagtgtttcagaaaggaagggagatgccaaagtccttaaatgccaagtttagtctctgggtttgatgctccaggaagtttggagaggcggtggggagagcaagagacgggcgtggtgtgcaatgtgatgtcaatctatctaaaaacagtttggcttccaagaaggtcttagcagggcgcgggggtgtcaggggttacagaagtcatttggaggattaatccagccagatgtgtccatggtctcagagaggggaccaagggcagggctgatttgcaagcttgggatgtgctgtgtttccttcaggaaggggccccacctccctgggctcttcgaggagaggggctgtgtgatttgaggccagaggggcctctccctccctcacatctgagcaggcgacaaggctgcctgccctagagctggcccagggcggctcggaagcctttgctgggctcttccctgggcagtgggaccatgacagacgaaagaacctgtttctcatctctccaagctgtgggcacccctgccgctgcccctgcccctgccaagggctacaaacttttccagctcaagcccaaatctcctcaagtgatgcctattgaagaattccaaggtaagaggatggacctggggccccatcagccctccctgacacctgttccccatccgccgctggaaaaagacggtgcaggatagaggaccgatgcctggctccgaaaaccctcctggagtagctgggtcaaggttaaactgagtctctcttccctacaggcctccctccccaagggagctgggagcaggtatgagtcagaagccaacttgggcacagtgggcaggccacacagcaggcagagcagatgccagaaatagcccatcccggctcccctgggaggtgtggccctggggctcgtgttggttgaagcagaatctgggacacacgggtcaccgatgctgctctttgggacacttagaggatgcctcatctcctcattatctctggagggacaaagtgaagggggcaggactaggtggcccacaggtgggagtgcccaccatctctcctgggcacaggctgtttctctagtctcccatgcccttgaccactgggtcagtccctcatcccatcacaaaagggaagctgggtcctctagagatacacagatggtgtttcaagagggtggccgttgtccttccttgttcgggggcagccacattggctttcttgctggagggtgggtgggtgggtgagtactgtgtcccttcgtaggaacatcaagggatgcccccccattcttagggatggtgaccttcctcaccaaatcctccattgacaatgtgggattcacctccaatccctgagagccttgccccaggcagtcacgggcttgtctggtccttggagcggagctggttaggcaggggtcagcctgagaaccacgtaggggtggggtgcaggaggcggcaggacatggtggtggtggtccttggtatgaaaccatgtgcttccaggagcagcgagtcagaagccgggccaggaccagggggaggcatgcaggttcccagggctcctgctttaaagtggcactcactcttagcatcctgcaaaacaatcaaacttgcagaaagctcaggctaataagaaagggtctggcaggtgggcgttttcctcccagccatcttccaaagcagcatgggcaggagctcctggcccattgcatcttgtccagcgtccatccatgcattcatctacccgaggataccacggcgagcgccgtgaacccaggcgtcgccctcccccagtgcacagccaggtggcatgaccctgccctccttgcatgaatcactttctaatcaccccggcatgtgggcatccttcagcgagcgcttggccctggtgcccagccaggcattagcaggagctgcccactggccctccctggttccctgcccacagggccaggtgggaatccctgggctcagcctactcaggttctcctctgggctcaaagcagggaggcctctctcttcctgaatccgatggaagggtgggaggcctagggcaccttccggtaccttttccaaagatgccttcctccgtccctgcatgacctggggtgagtccttcctcgccctgtccctcagtttccctgaatgctcgctgaccattggtatttctcccacttggccggcccagactgcgaatgctacggtcactccaaccgctgcagctacattgacttcctgaatgtggtgacctgcgtcagctgcaagcacaacacgcgaggtcagcactgccagcactgccggctgggctactaccgcaacggctcggcagagctggatgatgagaacgtctgcattggtgagagggcacggacacggcacagggaacttgctggaatgcgtgcagggtgcactgccctgcgaggtggcctctggggccccctgcatcagaatcacctggggagactgtgggaattctaactccagggccctctccagttgagcatctctaaggacagaaagctccagaaactgctctattagtaacctacccttgcggttctccggtaagttttgcactggagttgcaaaacttaccagtggcccttccctctctgggcaactggaggggacactgacccttcctggctccaaagagctgtgactctggcaggtggcaggcactcagtggcagaggccactgagcatctgtctggggctggtgtgtgggggggtccccctccatagctcctttccagaaaggtggaggagcagcctatccctcctcctgcaggggcccagttgggggccaaaagatcgccttgctgcgtgcatttgtgcaagtcccttcccgttcctgggcctcagcttcctcattcatcaaattgggaggcagatcagatcaaaggttttcagctcttttttgtggctgaagcttttcttcaaatgctttaccagcccaggtccagctataaagctgctcttcacccctggtgggcacccagtctgctttcttccaagttctactcaaggactggcttttgggtagagaaggaagtccatcagggccctgggcctgggcaaagaccaaagccatgaccgccaaccaaaacgcaccagcctggaatggttgcccctgtcgtcagtagaggccaggtctcggcctcaggggctgtcccccaaccctgcccagccaggccccttgggacaccatcacccatcccccacccagcaggaggctctggctgcccagaggaggggctcctgcaaagctggagctgtcggtctgaattctggcggcagccttcagataattccatcaactctaagtgatcaaagccgctgacgtcacagggggccagctgcagggacagggcagggcctttggatccaattagaggtgcccacaccctggcaccctcctcctctccctggctctccctgcctccaccccgagagccagcactgagctgcaaggtttctcagggtggacgatattcaccctctcccacagagccccaaggcaaccaactgggcccaccccgggagcaggaataggctgttcctccactcccctgcaaaggagctatggaggggggccaccccacaacacagcagccccagacatgctcagtggcctctgctgagtttctgccacctgtcggagtcatagctctttggagatgggaaggacagcgacccctctagttgcccagagaggggaaggggctgacccaggccacaccagtgccagggcggggaaggtggggctgggacgtgtttgatcccaaggaaggaagccagagtcttctctccaggcctggccaccctgggaagtccccacctgccgtccagccgcgggctcacgtggacccagtgtggggagcatcccctggggagtgtggagatgctccctgcgaggccgggagagtgggggtccgagaagacggcgcccacacgtagccctgaccgcgcgcccgtgcccgtgtccgtccagagtgtaactgcaaccagataggctccgtgcacgaccggtgcaacgagaccggcttctgcgagtgccgcgagggcgcggcgggccccaagtgcgacgactgcctccccacgcactactggcgccagggctgctaccgtgagtgcgcgccgtcccccgtgggcggggcctgcggaaaggggacggggcaggaccgaggcagtgggcggggcctagtgggacggggcaggggcggtggactgggcctagcaagacggggcagggccggggaagtgggtggggcctagtgggacggggaagaggcggtgggcggggcctcgcgagacggggcagggccggggcagtgggtggggcctagtgagagcggggcagggttgggatagttggcaggggcctggtgagatggggccgacccgggggcggtggacggggcctagcgagacggagctggcaggtgggcggggacaggatgctgctgaggtccggggccgggccgaggggcgggtccaagagctcggggcggggcctgatgcgacctgaggcacggtggtgcctggtgggaactacgagaaagaccgagctggggttggttggaaaggtatttgcggggacagagggagggaggctgtccaagtcggcgttagccgcgggcacagggtgaaaggaggctccaggcgcgtggaacagcacgtgcacagctctggagactgcaggcgcgtctgaagaacagcaccgaggccagtggggcggggagagaggggcagcggtgggaggcagccgggggccagatctcgcccgggcgccgtcaccctccgaggggggacgtttcgcacccagcgcgcctggagcctcctacatccccggcccagacggcgcccccgggatctcgcacaccctgcttcgcaggagctcggaggttggcggggggaccgggccaccccccgtgctgaccgccccctccgcctgcagccaacgtgtgcgacgacgaccagctgctgtgccagaacggaggcacctgcctgcagaaccagcgctgcgcctgcccgcgcggctacaccggcgtgcgctgcgagcagccccgctgcgaccccgccgacgatgacggcggtctggactgcgaccgcgcgcccggggccgccccgcgccccgccaccctgctcggctgcctgctgctgctggggctggccgcccgcctgggccgctgagccccgcccggaggacgctccccgcacccggaggccgggggtcccggggtcccggggcggggccggcgtccgaggccgggcggtgagaagggtgcggcccgaggtgctcccaggtgctactcagcagggccccccgcccggcccgcgctcccgcccgcactgccctccccccgcagcaggggcgccttgggactccggtccccgcgcctgcgatttggtttcgtttttcttttgtattatccgccgcccagttccttttttgtctttctctctctctctttttttttttttttttctggcggtgagccagagggtcgggagaaacgctgctcgccccacaccccgtcctgcctcccaccacacttacacacacgggactgtggccgacaccccctggcctgtgccaggctcacgggcggcggcggaccccgacctccagttgcctacaattccagtcgctgacttggtcctgttttctattctttatttttcctgcaacccaccagaccccaggcctcaccggaggcccggtgaccacggaactcaccgtctgggggaggaggagagaaggaaggggtggggggcctggaaacttcgttctgtagagaactatttttgtttgtattcactgtcccctgcaagggggacggggcgggagcactggtcaccgcgggggccgatggtggagaatccgaggagtaaagagtttgctcactgctgcctccacggcctgttttctttctgtgttggggacggtgggcaggtgtggggcttacagaggaatccacaacacagccttaaagaaacggtttccctactggggccaccatttccctgggcctttctgtggattccagcaggcagtgccccctccccgcaggcttggctggcagagttttccaccccgcggccaggctgcaggtgccccacctgttaggagcctccccacactgaaaggctgcctccctcctttcccaaaaaagaaatccggagtgtattggcccttttctacagaagtccaagggaaatgactcagggagaatcctagcagaggttgaatccaatgctctgatttatactgtgtctcggtggccacctccgatggatgtgtcatctcagacctgttgcagccggagcctcaagtccaatatcagatgaagctgaacccacaattcggccaccgcctccttccagagtttcagatggccaggtgggcagaggcgggcagtgcagagaccccagacgtgccggccctgtcctccctaccttctcaagattaggaaggggtgctggaggggacaggggcagcttgggagtggtgaggaagctcctagattcggggctcatcccctggggcctctgattcagaggatccagcagttctcccatctccgcttggtgtctccagccctggggccacacttccccctcggtccagcctcctgtccacctatgtttatttcagagcagtgccgggggtccggtcctggttgctaactgctgccactgctccacctgcaggtgctcccagcactggcttctgccaccacacctgttctttcccagctgcgaggtttagacctgggtccttcccttgagtccccaaagctaagctaagaccaagtggaacaaacttggccttggggacagcaggagattacaacacagaaaaggagggggaggcacaacgggacactgcataggactcacagtgtcccgagcccacacaccagcccctcctggcctcctctctctgctcccacccccagcaccctgctgacccggaagtgccttccgacaggccctgcatcctcctgcagctggcccatctctaccctcacattcttccttacgcacagaaccccactgcctgggacccaaagtgcccagataaaataaaacacctctctggggcttcttgtggataggagtggccaggggacacagctctgggcagtgagatgtaagcaggactgatgggtgggcttccagaaagttcttaaaagtcatcccttcctccacgccccacaaagcctcagttgtccaagtttgtggctctggtttttctctctcatccctccctctgctcttcagtcagcaggatggggaaggagccttcttgagacactgagcataacagtgtcaccctcaggatagtgaagggtggagccgggggtggaagttgcagagcctgggacacctgccttggctgcaacctctgcactgcttttatttatctacttatttttatagagttgaggtctcactatgttgcccaggctggtctcaaactcctaggctcaagtgagcctccggccttggcctcccgaagtgctgagattacaggcatgagccaccgcaccacctgcctgtcttactgtgtgagaaaaaaaataaacggtgatgtgattaaaacactagaatttgggttttctgttccatgcacactttccaagttcttggccctgcctgattggcatccgggccccctgagccctctaaggccagagagagactgaaacccacccttccttggccgcagccccccatggtgaccctcaagtcaccaggaagaggaatgtccatgactcaggccgaggagtccacctctgtccagaacaggactgcccctgccttctagtgagcacagggcagctgagcagaactcaccccagagaaacagcagcgctggccgcagtcggtaaacagcaggcatttcctcct

SEQ ID NO: 781 - DNA, 6258 bp, Homo sapiens
ctagttgaaacatatgtcagaaattgctacacaaaaccctaagactttttcctaccagtcaagatctgtactgctctccatcctgtcaagaattcttcccacaatgagtaggaccaagggttgcttaagcttcctttatttcatcccgtgctgctgctttgggttaccaatcctgtgagtttacttctacagtagcttttatttgtagcaaatttaacctattctaaggagtattgcttagttcacagtattaaaggatttgatgaacaattttatatctacctttcatttggtacacaactttatgtctaccttgcatttttgcatacttttattagcattaaatatcttattaacatttacttaaggctgagtgctgtggctcacacctgtaatcccaacactttggaaggccaaggccggaggatcgcttgagcccaggagttaaagaccagcctgggcaacagagagagaccgcatctctacaaaaaattttaaaaattagccaggcatggtggtgtgcacctgtggtcctagctactcaggaggctgaggtgaaaggatcacttgaccccgggaggttgaggcggcagtgagctgtagtcacgccagctgcactgcagccagggtgacagagaggaatctcaaaagttttttttttaacttagtcctcagagtatattaacaattatcataggtaactttattgagcgcttaatatatgctttgatatattgacttatttaaccttcctaactttctgggacatgtattagtctcatttataaatgaggaaattaaggtcagaaggtttaagcaatttgcgcacacagagctggtatgtagcagagccagcatttgaacccaggtagtctggcgtcatagcacagattttcagttattatgttgtgcttcattatgtcatctcacaaatttcatctgcctgtagaaagcaccgggctttgattagcattgttttatttccaagccagccacctacacctcatttaattggcattttcagtctatgattctccagcaagtttcatagtgtatccaagagactactttaaaatgccttcctaaaatcaagatacactgcctaaaacaccattcccaaagtattccacatacttttggataataaagggtaataactgcctccctcacctccaaaaaaaaggctctgttgtttaaaaaggcaaaaaagtttggcttcctgtggctcagtaggtctttatagtagttccctggccgaggcatttagtgtcctcgtgtcacttttcaagggagaacgacatataaatatagtatttccaaagcttgtttggccatagaactatttttcaagggacaattaaagggagtagtgtactgtgaaacacactgtaggaaaagttagttctctattttgtggacaattttctatttacatttcattttatttgcttatctattatgtcatctagcaattttagcagaaaagagaataagaatagactattccagttaccctttttttttttttttttttttgagatggagttttgctctgttgcccaggctggagtgcagtggtgccatcttggctcactgcaggctccacctcccgggttcatgccattctccttcctcagcctcctgagtcgctgggactacaggcacccaccaccatgcccggctaatttttttgtatttttagtagagacggagtttcaccgtgttagccaggatggtctcgatctcctgacctcatgatccgcccacctcagcctcccaaagtgctgggattacaggcgtgagccaccacgcccagccatcctttgcttgtttctaatcatcactcctgtctgcacaaactattcatttgttaatacattgaggaattttctgttaggcttaatggtctgtagtttttgttatttatgtaccatttgggggatttttttttttttttttgcaaagcctggctccatcacccaggctggagtgcagtggcgcaatctcggctcacttcaacctctgcctcccagattcaagcagttctcctgcctcagcctcccaagtagctggggttatgggtgcccaccaccacgcctggctaattttttgctatttttagtagagatggggcctcactatgttgcccaggctggtctcaaactcctggtctccagtgatccacctacctcggcctcccaaagtgctgggagtacaggtgtgagccaccatgcccagccatgggggatattttttaactctttgttgcactctgattttctgatacatccccagttgtccagacttcatctaggatgtagtaagtggttctgagttaatgtcttccaagtgctttctgtgtcctggagggtaattcctctaggcttgaacatttaaactcattcaagtgacttttattatatccatgtgtgtcttaggctggaatttccttttaatcatgttctaccctttccagtttaaagagcagcctctttgaaaaaggaaattgacactaaaaaataattgaagcattctttttcttttacccatttctctaaagacagtggataaagtccttccttcttcctgctttcaacataacaaaacatcttttggctagtctctgctctttttggctttagctttcctatttttttatggttctgaaccactttcttttggtcatttatctcttcctccatctttgatgtccctttaaaatcttattaaagagctcacagctgggcacggtggctcacacctgtaatcccagcactttgggaggccgaggcaggtggatcacttgaggtcaggagttcaagaccagcctgaccaacatggtgaaaccctgtctctactaaaaatacaaaaattagctgggtgtggtggtgcacgcttgtaatcccagccacttgggaggctaaggcaggataatcacttgaaccctggaggtggggtttgcggtgagccgagattgtgccactgcactccagcccgggcgacagaatgagactctgtcttactgtcccatacatgttacgaacttggaggagggagagatgaatgaaagcttgaatgacctcaaaaggccttatagggagaattagatctggtaggatagatgggatttacatagggagaagaactaggcaagggagccggggaaagctgaggtgggaatgttcaggaatggcaactagaatagtctgattagagtgaacattattctatagaaacagtaaacaaagcagttggagttggctctcgccattatttgtcaatgaaatttcagataaaggacctaaagctggcatttgtattgcaaagatgttgtaaaaatctaaatatcaatttgtatcaaagatatatatagatacatattttcataaatttgttaacaccttttttgttttgtgactagttcaggtaaatgctctgttgaatcttaagaatcaagtacatctctcttgcatatattaattctaagaagaatatgggaaccaggctatgaataatgacattctgacttattttaaaaaattgccatctccttgagtaaatgctcatctgatagtttttatatctcttattttcaggttggctcaaaaacagaagttgctgagtgcaaggagaaattcgccgcctccaaggaccccacggtcagtcagactttcatgttggatagggtgttcaaccctgaggggaaggctttaccaccaatgagaggattcaagtacaccagctggtctcccatgggttgcgatgctaatggcaggtgcctcttggcagcactgaccatggacaatcgcctgaccatccaggcaaatctcaacagactgcagtgggtccagctggttgacctgactgagatctatggagaacgtctttatgagaccagttacaggctctctaaaaatgaggccccggaaggaaatctcggggattttgctgagtttcagaggagacacagcatgcagaccccagtcagaatggagtggtcgggcatctgtaccacccagcaggtcaagcataacaacgaatgccgggacgttggcagtgtgctcctggctgtcctctttgaaaacggtaatatcgccgtgtggcagtttcagctgccgtttgtaggaaaagaatccatctcttcatgcaacacaattgagtcaggaatcacctctcccagtgtattgttttggtgggaatatgagcacaataatcgaaaaatgagtggccttattgtggggagtgcttttggacccataaaaattcttcctgtcaatctcaaagcagtcaaaggctatttcactttaaggcagcctgttatcttgtggaaagaaatggaccagttacctgtgcacagtatcaaatgtgtgccactttatcatccttaccagaagtgtagttgcagcttagtagtggctgcaagaggctcttatgtattttggtgtcttcttctgatctccaaagcagggctgaatgttcacaattcccatgtcacaggccttcactcactgccaattgtctccatgactgcagacaaacagaatggaacagtctatacttgctccagtgacggaaaggtgaggcagctgattcccattttcacagatgttgcattgaagtttgaacaccagttgattaaactctcagatgtgtttggctcagtgaggactcacgggatagcagtgagcccctgcggtgcatacctggccatcatcaccactgagggcatgatcaacggcctccaccctgttaacaaaaactaccaggtccaatttgttactctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtaggtgtttattaacaaaaactctgaaattgtaaagcctgctttcttcatgagaaagaaatgacctaaattgagttcctgaagctcaacttttgctttgacattttttaggtaatttatttgcttgaggtgcagggtaataaataggaagcgtggattaatgcagaggatgcattcatagcatataaagaatattttgattcttcttcacactggccttgttagatatgcaaagtttgcaggatgagctttccagactggattagctcagaggctgcatttagctgagtagtatgtgatgggcaatcatggctgtagaaatatggtgcccatgctccctgcccttcctcttttgcaaaagttttgtatgggaggggtgtagtgacatgttttccatttgatagaacttaaggatatcttcagatttagtcaagaaagacatataaagtaaacaaattattactcatgtctcatttttacaaaaactgggcacagtctttattttggtaacagaacaaacttacctagaatgtattctatagaatttaagttgcttaacagagcactagggttcccagtgcatattaccactcaaagcgttctgaggattcctacagaaaagaaactgatacctttgtgtagctcggtattactcagacttcttgatcagagaatctttcttgcagctaacagttgttaaaatcctgaagaacttgtgttccaagaaatatactgtgttctgaaatattcaaaaccacaaatatctgtactcctttttacttcaaagactgatacttactgactaaagtcttatttaaagtattaattgaaggca

SEQ ID NO: 782 - DNA, 1516 bp, Homo sapiens
caccctgttaacaaaaactaccaggtccaatttgttactctcaaaacctttgaagaggcagctgctcagctcctggaatcttcagttcaaaacctttttaagcaggtagatttaatagacctagtacgctggaagattttaaaagataaacatatccctcaatttttacaagaagctttggaaaaaaagattgaaagcagtggagtcacctatttttggcgttttaagcttttcctcctgaggattttatatcagtcaatgcagaaaaccccttcagaagccttgtggaaacccacccatgaggactcaaaaatcttactagtggattcgcctgggatgggcaatgctgacgatgaacagcaggaagaaggcacttcttccaaacaggtggtgaagcaaggcctgcaggagaggagcaaggaaggagatgtagaggagcccactgatgactcgctccccacgactggagatgctggaggccgtgagccaatggaagagaaactcctggaaatccaagggaaaatcgaagctgtggagatgcacttgaccagggaacacatgaagcgagtcttaggagaagtgtatctgcacacctggatcacagaaaacactagcatccccacccgcggactctgtaactttttaatgtctgatgaagagtatgatgacagaactgcacgggtaggtgtttattaacaaaaactctgaaattgtaaagcctgctttcttcatgagaaagaaatgacctaaattgagttcctgaagctcaacttttgctttgacattttttaggtaatttatttgcttgaggtgcagggtaataaataggaagcgtggattaatgcagaggatgcattcatagcatataaagaatattttgattcttcttcacactggccttgttagatatgcaaagtttgcaggatgagctttccagactggattagctcagaggctgcatttagctgagtagtatgtgatgggcaatcatggctgtagaaatatggtgcccatgctccctgcccttcctcttttgcaaaagttttgtatgggaggggtgtagtgacatgttttccatttgatagaacttaaggatatcttcagatttagtcaagaaagacatataaagtaaacaaattattactcatgtctcatttttacaaaaactgggcacagtctttattttggtaacagaacaaacttacctagaatgtattctatagaatttaagttgcttaacagagcactagggttcccagtgcatattaccactcaaagcgttctgaggattcctacagaaaagaaactgatacctttgtgtagctcggtattactcagacttcttgatcagagaatctttcttgcagctaacagttgttaaaatcctgaagaacttgtgttccaagaaatatactgtgttctgaaatattcaaaaccacaaatatctgtactcctttttacttcaaagactgatacttactgactaaagtcttatttaaagtattaattgaaggca

SEQ ID NO: 783 - DNA, 22107 bp, Homo sapiens
ggggtccatgtttcattaaagaatccaagcattcttatcttttggtgatacttgtagtgtggtcttgacttacgaaatgtatatgtgttgttttctacctttttcatgtttgacagtttttctttagaccagaacttcggattgcagctatttcttaagagttgctatttcattagccttatcaacatcctagagatctgtttgccctggggttttgagggctaagccctgagttgtaatgcattaactctgttctgtgcagtccttctaggactaaatacagcctgcagctaaatacatactgcttctccaaggctgctgctgtgctgatgtttctgtctgaactaccccagactccagtaccgtctgttaactccgtatctcggaggatctgcagaaggtccgcgttgaccctttgcaatccagtatgcactttcaggctcatctactaaataaatcctttcagcatggcttcgtttagttaggctcttagtatcccaattatgagcaattttattaaactaggagtatcagtgcctggtagttaagtacaggtgttttgggtttaaatctcgggtcagcctgagttcaaatctcagctccaacacttaatagccatgtaaacttactgtaattacctaacctctctaaagctcaatttctccatttgtaaaatgggaataatgattgttcttacatcatactattgctgtgaggcttaaatgagataagggttggttatttgaatgataaaaaaattgatattttgcttgaaagaaagtattccttttctacctgacaacttccaattcatatttcttttctcttttcttttccattctttttctttttctttttttcgacggcgttttgctcttgttgcccaggctggagtgcaatgggcagtctcggctcactggaatctccgcctcccagattcaagcaattgtcctgcctcagcctcccaagtagttgggaataaaggcatgtgccaccacactcagctaatttttttgtatttagtaggtttcaccatgttgggcaggctggtctcaaactcctggcctcaggtgatccaccctactcagcctcccaaagtgcttggattataggcgtgagccactgcgctaggctcatgtttcttaagaaacaaaaattcaggccataaatagttaagtctaacctctttccccagctgtttgtgttcttttatctttgtgagctttttcagtgaggagtttttttttttgttttttttttgaggcatgttcttactcagttgcccaagctggaattcaggggtgcaaacatagctcactgcagcctcaaccttctgggctcaggcgttcctctcacctcaacctcccaagtagctgggactagaggcacacaccagcacgccgggctaatttttgcactgtttgtagagacggggtattgctatgttgcccaagctggtctcaaactcctgggctcaaaagatcctgctacctcagcctcccaaagtgctaggattacaggcatgagccactgctcctggcccgttttctacctctgctataaaacaggtttgttgaagcgaattcaagacagagagtcttatttgctctccaagtcaatcataggtacccatgatgttgctaaatttagaaaaaatagctcatctacatgcatttattgagctctgatttgattagtatgatgctaaggttgccatcaggcaaatcacaatgtcattaaggcttagtgagatgtttttctcattcagggatggtaggaaaaatcgtcactggactggccacctctaatcaactcttggcatttctgcccagccttcgtgtgttgtccttattgctgggatccttgttgccaaacactttcccagctctaagttgttcaagatctctctgtcttgatcataataatgtcaatgctggttacaaatttttctcttgggtttacctctgcctgtccactgaggaaacggttaatggagttgctttcccatctgaattctttctggactctctccatttgcctttacattctgactcttctcgctctcttttccaagcctgaattcaataagcaaaagctgagatactgtaatttcctaaataacccaaagggaagatctggcataatttataaccactctgactgctgaatcaacttgcacttgctcttctctctaatggaactttgaagaataactgtaattgaatagtgcctccaccccatcttcagatttgactgaatcaagcctagatctggttatatctggtttttgtttgtttcatgttgtgtttgtgccccactgagtataaagcccaagtgtgggcttcatctggatgtattttcatctcacagagacattaattgaatctctgacaatagtcttgcctccgaggagtgctccaactctggctgcggtattaaaccaaggtagttcttggttgccttcaaaggtaacctcccatctgttgacagtgaactacggcaatgcaacgcttacagaatcattggaggagaggatccaaagcgtttacaattccctgctatgcaaagagtcattctgagtttttttaacctatgattgctctctgtaaatacctgggtgcacccagcaaggtgtagaggttaatgtttgctctctgacctttgaagacagatgcactgaatatgttgcagtttgcaatgggatccgtggcaagttaacagcagactgctccttcagctactgctgtttccaaaactctgcagtgtcacatcttgctcgcggctgcctcctcagaagtgcttctcagcttccattcagctccctgctgagttcctctgaagaactttgtactgtggcatatgacagcgacctgataacattatgataaactcctatgggtttgaactcagtcctattcaaattttctggtgcctagtggtcagcagtcttagacctggggagtaagaggtgtgtctgcagtgaatttagaggtgagaagaaagagggctggactcagatattgagtatcttagagcctacggaccatttcccaaagcctagaatagatttcagcgtaattctggtaatttacataaactaggatagacatgcaaaatatctggatatgttaggaaggagttaaaaagttctccacaccttttcctaccacctctgcagccatagaagccgaggggaaatgcacacacacacacacatacacactctggcagggaacctgttttgcaagttttgctggtaaaaagttctaggaagggggctggtggagaacagagtggaaaagaagtatcaattgaaggtttttcaagacctgagttttcaaggtaactttatcctgcagagagagacacgcatggccgctgtaggtttttcttccaccaattaagtgcattgttagacagggaggggcagattaacgaacgcctataattttgatcattgttttttgcaaaacagctcaggctttgaaaatgaagccatcgttcccggctaagtttctgccaacagcacaaattatactgtgcagagatccaaagcccctaagaaggtttcattaatgaacaatttcagacgattgtttaagtcttcgcctgacaggtaatgttggcatgtcggcaggtggggttagggtttccatggagatttatgatgtcatgcttgaaagagcatgtcaagacagccgatttaacaagtagctactcaaaaagtcctataggctacaagtaggttttatgcaaatgacgagagtttcactgggaaaaactgcaaaagaaaacagcccagacatggaggggggttttacctgacagctccgaaggaagaccctggagtccgttccagacaaaaacttccagaagaattagattttctgctttaactgccgcctcacctgtggagctctgggtacaggtaaatatgcggggtttttttcttccaagtttttgccaaaaattatttggaaacatttcgctctgtttctcggcattgttctcttggcaggaagaagtgaatcaataagcccagctttcccatagcaatgttcgtgctaaagggctgtttttaagggcttttttttttttttttattgaatgaactgagatttttgaatagagctgaaaacaagcgatgcattgtgcgttctgctgattgtgcccggtgaatactgctataaaagtgccacagataagggttagatggacaatctgaaaattgagatgctccatgtatttcttatttattcccagatgtgtgtgtgtgtgtgtgtgtgtttgtgtgtgtgtgtgtgtgtgttcttttactcttacgacaaacctgaaattgagactatgggtagttttgtattttcacattgtaaaaatgccaaaaataaaatccatggaatgttgcagaaataatctttgaatcaggtttatgaacattgcacttttttaaaagtatgtatctgatgcttttctcaccgaggcatttttcccagactagaaaaaaacagtcctgatagagacatccagtttttgagcttttagggaagcaggatttctaaattccaagaagatagataaagacttcttggaggaaggtggggtgtgggtgataaaggtagtttttaaagcatggtttaaaagaaaatactggtcacttgggagtatgagggttttttttgtttgcttcggctgccagtgaggataagtaaacagtcttgccagccatttggatgtgatagcaatcactggatgcggctgtggatctgtgagttagctgaaaggggttagttcagaggcatcagttgccctgtgagtagttagttccaccaagcttaaaaagaacacaaagaaagcctattgtttcttccacacagtgcatggcagcgtgtgaggttaaagcggagttcagaatcatcgaaagatacctgtgaaatgggaatttggacttttgaaactaaaactacttaggaataagtggataggctttcaaaatgttttaagaactgcctcatgtgtgagaatgagacctcctgaaattttgcagttagataatgtggattaatgccagaactcacattcatattaaattgttaccacagttattgcaaaacagtgagtgacaaagaactgtgcctccaacatcggaagttctgggcgttgagttctggcttcaccacttagtggctgtataactagaggaaagtaaattcatgtccttaggcctcagtcatcatgtccataaaatgggatgccagtagctagctgtgttgtgaggattaaataacaaaacagacgtagcacagttctaagcattcatgttccaaatgttaatgattgtttttattgactgctgaaatggcattggatatttagaaagtgtttttatattctttacttcctcttatcattacaagtaatgactagcagtcaagtaaggctagtagtctttttttttttaaaaaaaaaagacagggtctcactctgccacctaggctgaagtgcagtggcgcgatcttggctcactgcaacctctgcctcccggctaaagcaatcctcccacctcagcctcctgactactggtgcatgccactgtgccaggctaattttttgtatttttggtagagatggggtttcaccatgatgcccaggctggtctcaaactcctgggctcaagtgatctacccaccttggcctcccgaaatgctgggattacaggcttgagccactgcacccggccttggctagcagtctatttccactttacagatgcagaaactgtggctcagagagttactgggaaatacgacataataaactatcctatactgcctgcactttttctcattttaggaggcatagaaaaaaaatgaatgtgttattgaaataactcccagcagcagcaatgattctgtaaagtaattaaaatacaaaatgttaagtatgccaaaggagccagggtatttatatttttatattaattatgcttttgccacttttttctagacaggctacagaagtgatattaatttactttttactggtacctactgataggagctccagtactgcacagacttaaaattttaaattctacctgcctgaaatttttcttggccatacaagtagagtcggattttaatgttacaggtattttcggagtgagaacccaagtcaccaaggggctgtggttgctacagggtgcagaaggagcctaggagtcgaatatactgtcctttattccttctgtattctagacgttggcacttcctcccttgcctctatcccagacagaaacacagcccataattatatcctacatccattgtatgtaagagacaaatatgtttttcattgtgctatttttagccacagtgtttctagctggggaaaacactctcttcattccagggttttcttaacaatttttccagtttttccatgtcagactattcagaattattcaggttccacactcctgggagaaggctcttaatgaagtattgagtaggctcatcgagggggattctagagggattttggcatctgagctgctgagcctgaactcattctatgacagatgatgtctgtggtcccatgaattaggctgcattgaggactctcattcccagcactgtttgggggcactgggaaaaggttgagttaccttatcccaagggtagatctataaggagaaaagcaaatatttatttatttgttttaaatttctgcttttatttttagatataggaggtacatgtataggattgttgcatgggtatactggatccagataatgagcatagtacccaataggtagttttttaacccacatcccacctccatccccactctagtagtccccagtgtattttgttcccatgtttacatccatgtgtgctccatgtttagcccccacttgtaagtgagaacatgtggtattgggttttctatttctgcattaatttgctaggaaaatggtattcagctccatccatgttgctgccaaagaaatgatttcattcttttttatggctttatagaattccatggtgaacatgtaccacattttctttatccagtccaccattgacggacacctaggttgattccatgtctttgtggatagcacggtgatgaacatagaagtgcatgtgtcttctcggtataatgatctatattcccttgggtatatacccaataatggcattactgagtcaaatggtagttctgttttaagctctttgagaaatctccacactgccttccacggtggctgaactaatttcactcccaccagcaatgtataagcactccctttcctccacagcctcaccagcatgttattttttgactttttaataacaaccattctgaccggtgtgagatggtatctcattgtggttttgatttgcatatctctgatgattagtgacgtggagcattttttcatatgtttgttggcttcttgtatgtcttcttttcagaattgtctgtttatgtcttttgtccactttttaatggggttgttttttgcttgttgatttaagttctttacatattctggacattagacctttgttggatgcattctttgtgaatattttctcccattctgtaggttgtttgctctgttgatggtttcttttggtgtacagaagctcttcagtttaattaggtcccacttgacaatttttttattgttgcaattgaaagcaaatatttatttcattcaaagttttagtttcaaatatgaatcacaaagctgcaattttagggtagaaaagagttttgaactcaaacatggtgccaaaactccaaataggttttgagtcactgatgaaatgtttcttaaattttattttattttcttttagattcagggggtacatgtgcatgtttgtttcatgggtacattgcctactggtggggactgggcttctagtgcacccattattcaactagtgaacatcataacccataggtaatttttcaaccctcacccccttcccaccctccctccttttgcagtccccagggtccattatttccatctttatgttcatatataccaattgtttaactcccgcttaataagtgagaatatgcagtatttgttttttttgtttctgagctagttcacttaggataatggcctccagctccaaccatgttactacaaaagacgtgtttcattcttttttatggctgtgtagaatattcacatatatacaggaatatatatatatatatacacatctatgaatgtgtagaatattcatatgtatgaatacatacgaatgaatatatatgtgtgtttgtgtgtatatataggactatatatacacatctatgaatgtatacaatattcatatatatgaatatataagaatgaatatatatgagtttgtgtatgtatatatacatatagatcctgttttagaagcccagtgaagctttttattacacttaattgtcgtagcgttcagagattatctttgatcaataagtagcgatcgcattgagcagagcactttacacctagtgggttttagcaaaggcttgtaaatcagatgggctgcgtgcagtgactgaagaagtctcctgcctggattcggatcctgccttcattacttgctcgtagcacaggctttccactgaagagcatatgaagttttgttcatattccaaataaaatagagcatctgaatttccaatgcctcttgataaaggaattagtggtctttaagtattacattattctctttgaatgtcatttttggaattttcacagaaatgatttcttcagaaagaaaggcactgaaaatttaactggaagttcctctcggctggctaccggggaggtagagagcagagagttctcctgggtgggagggatttctagaagctctttacagctgaggcccttttcatcgctatttattaatttgacttgatcagaagcaatccagttttgaaggtgtagtttctaaaatctctttatttcaaagaaagtcatcctgaagaatggtgtcatcccagatgaccttgctttttctcttcagatgtctggccacagaagggatcagcaggtagaatgggaaggctgttttcatccttgggcattaattgggcttccctcttttctttctttcttttttttttttttttttttttgagacatgtcttactctgtcacccaggcgggagtgcagtggcgagatgtccgcttattgcaacctccgcctcccggattcaagtgattctcctgcctcagcctcccgagtagctgagattataggcatgtgctaccatgccctgctaatttttctaattttagtagagacagggttttgccgtgttacccaggctgatctcgaactcccggcctcaagtgatccgcctgcctcatcctctcaaagtgctgggatgacagacatgagccagtgcttccggccagcttatcctaacggcaggaagctttgatacttttacttcctgaccacagacttagtaggcagcaggaacagtcttcaacttcctggttgtataattacaagagccaatgtgaaatattatgcatttggagaagcccttctctagagctcttatagaaaaggaatgtacagccaagtttatgggaagcatgaggatggtgagtccaaagtcaaggtaggtgatagcattggtggccccttgcagcaccgggagtctatatggcggtctaacttcgcaccccctatttgtcacttcatagcactcttcactttcactccgtttcacttgctcatgattaagcaacaaacgtggtaatggtgtttcctactctgagtttcactagatttagtaaacgcacatgatcatgctggtcccgtcgaagtgacgataggagtcctcggagctgtggtctccgccctggctggttgcacctgctctgtgctctgctcagatcatacaagatggagagagcagagaccccatcagagagaggcttctgttggctgcagtgtgacactgtagacttgccagaaagggctctctttggacctactacttgccactcagaagcaaatgggctgcagcctcatacgtttttggagtgaataagagaactaagattctgatggacccttggtgattttctctcttcaatattatgaatgttcatgaatgcccctcagaaggtcacagggatgtcagatctcattttctccccttccccttccccttccttttcctttccgagacaaggtctctctttatcactcaggctggagtgtagtggtacaatcatgtctcactgcagcctcaacctcccgggctcaagcaatcctcctgcctctgtctcccaagtagctgggactgcaggcatgtaccatcacaccaactaattttttttttttttcttttaggtagagccagggtctcactttgttacttaggctggtctcagactcctgggctcaaacaatcctcccactttagtctccccaaaagtttagatcaaaggtgtcaaccactgcacctggccaggtctcattttcatagcagtcactggtagtaaggtaaatgtgctgcagataatcgtttggcctgtgttttggagggacctttttgttttttaattgtctctttgaattttgcacaaagaagggttgcacgggctccgttcatctttaacttattatttgcatccttttttatgataagttttaagactactgaagaaagcagctccggtaaagagcctcacaaaggccaattttcaatttctcccttgtgggctgtgtgtgtgtttatgacggtcagaagaagacagactctcatttaaaactattctctcttcaaagcaattataaagtggccccatcatagataaacttgaccccttttaattgctggttagattgcttcttttttctctccctgttgtgaacaggactgcagtgaccatccttgtatctgtgcatgtgggaacgaatctgaaggacaaatttctagaatgtcaagttggattgctagttttggaaggtattgcccaaactttttctcaaaaacactcagtttattctgtcgatatgaatgttgcaggggatattatggtacgttcagagaatacagttcactacagtgatgccaatgtgtgaaatacacttgacatgtgggtaggaacacataaccaagttatatttagtaaacaatctaccgagcagtagagttaatatgatcccatttattattttattttctaacaattactagtgatactttagtttggttcttgcttttctaaactgttaaccgtgaacatgtaactatttaaaacttatgctgggtttgctgggtcatgtctgtaatcccatcttggaagccaaggcaggaggatcagttgaggccaggagtttgagaccagcctggccaacatggcgaaacccgatctctactaaaaatataaaaattagctgcacacggtggtgcgcatctgcaattccagctacttaggaggctgaggcaggagaatcactggaacccgatggcggaggctgcagtgaacggagatcacaccactgcactccagcctaggtgacagagcaaggctctgtctcaaaaaaaaaaacaaccatatattattcattaaatgcatgttcatgcttacttaaccaacagtatggccctttggcttagtctcatagtctatctgacccttattttcttttcttttttttttttttcaaatgcccctttcattatgaaactcttttttaacttttaatttaagttcaggggtatgtgtgcagatttgttacataggtaaacttgtgtcatggggctttgttgtacagattgtttcatcacccaggtattattttattttcattttagttttttaaatttctttttagaggcggggtctcactgtgttttgcccaggctggtctcgaactcctcctggtctcaagcaatcctctcgcctctgcctccccaagtgttgggattataggcatgagctactgcactcagcccaccatttgttttaaaaagggtggatcctatttgtataaaaagccatgtgcattttctgtgtacttgtctacacattaatttccaggctgggcgtggtggctcacgcttgtaatcccagcactttgggaggccaaggggaggcagatcatgaggttaggagatcgaaaccatcctggctaacacggtgaaaccccgtctctactaaaaatacaaaaacaaaattagcagggtgttgtggcgggcgcctgtagtcccagctactcaggaggctgaggcaggagaatggcatgaacccgggaggtggagcttgcagtgagctgagattgcgccactgccctccagcctggacaacagagtgaggctccgtcttaaaggaaaaaaatttctggaatgatgtccaataaatcagagagagggactagaagactaatgaggacagaagcttttattcttaacacctatattttgctaccatttatattgtcatcatatgcatataacattttaacatttaaaaactagtttaaacagaaatggttgccctggaatgtggcctgtgttctttcaagggaggccagcagtttctacagtggctgagatggtaccttcatctcacacacctacgcaggagtgcatttgtgctttgatgtggttgtcccttgaagaaggaagcagttctctttttcttttttcccttttccattataggatcagtcacttcttggggcattagtagtctcatttccagtggcatcttcccttggcaaaaggaatcccagataggacctcatctttctaaacaaatgctgttttgggtcctaaccatcccatgtttgctttgaatatgtttaagttgcctggaattatcaacaaaagaattaaatttattgtaggtcagggcatcttttgactcattgtataaaacattcactttaaatgtataccgaaatgtcctttaggccgggcgcagtggctcatgcctgtaatcccagcactttgggaggccaaggcaggtggatcacctgaggtcaggagttcaagaccagcctggccaacatggtgaaatcccgtctctactaaaaatataaaaattagccgggcatggtggcgggtgcctgtaatcccagctactaggggggctgagacaggagaatcgcttgaacttgggaggcggaggttgcagtgagccgagatcactccactgccctccagcctgggcaacaaagcaagactccatctcaaaaaaaaaaaaaaaaaaaaaaaaaaatgtccctcatacctaaaccttacctcttgctaatttgctgagggttcattttagataaaaggtgtttaggttttcatattatgtttgtaactgtatagctatgattcagtttcctaaatgaaaaaagaaactgttttaatgtacagactatttagatttgaaaagactgtgagagctttttcttttatagcaagacaagtcaagaatagaaggcacactgcgagagggatgtcttttgaaagaaaagaaacactactttttatattctcaaatcactgaagaaagctttagacataatttcaaacactagctcctgtttaattcagatgcacagaatgcattaaaaccacgagtgtagtggacgtgatttatacattctcttagcacaaatcagtacctatcttcactgtaattagacttttcttcctttctccttctcaaaagctacttttgaaaccttatgttttccctggacatattttctgtacttcataaaatagctcagttctgcaactaactgcaaatatttgcaaaagggaacaaatgtaaaataaacgtcccctaatgcagtgtttggtgaagaaacatatgtctgacattagttggttaacctgaaaaatagtaagaaacaactctacttaggggaaagggggtagaattgagcccgtactgtgcaaatcaagagaaagctataatttacgcaatttttattaaagagaatacaagtgctgtaggcttggggtggtgctaggtcatatttaagcctaattgagctttttctatatcattagaaaaatgggccaagtttcctatattatagggtaaatacaacattttcttcctgcaaatattaaataccactggctttttaagacgtaaacatccaaatctcaaatgtctttattcatgccaatgcaatacaataaaaatattccccatatacacttaaatcactgcaagtaagccttagaatccccacaagtattattacttactatatctcagaaactttcacacacattatttcaaatatagttctcccaaaaaaaccctgcggagagatacctgtaaaccaaggctgagactagcctagacagttcgttctttagacaacaggagtggagatttgaacccagctattgtgactcaagcaagcctagggcatgtttctgagatctctaaggtgtgcgctgtgaaaccggtggctcattttatgggttggatttccaaacacgactatcacaatcatgccaggaatcaatgactgacttcttgcctccgtggcctgaagttctcctctgcacctcctacctttttgccatttcagtgatgcaccaaagggtggagttgaagaacatcagttttgctgctgcttgttggcaatactctcaaaaaggcgtggggagggagaggtgtaactcacccctgaagtcaagcctggagattacttgtcaggaatgtcaaaagcatttgttaagcaaccttcttcctggcattttaagaagaaagccgcatacatagatcaaatcccttccttcagaaacctgtactctctgaacagagccttggaattcagcctagagaaagaatacttggtggttcatagaacttggttcacaaaagagtgcttgctgcccacgcattttgcacaatgactcccaaacacacagaatgcacattggcaacaattttacgcgtgtttccaaaagtgctgactggaattgaagggacacatttggcactttttttttttgaaatggggtctctctctgtcacccaggctggagtgcagtggcgcaatctcggctcactgcaacctccacctcccaggttcaagcgattctcctgcttcagcctctggagtaactgggactacatgtgcctgccaccacgccttgctaattttttttttttttgtattgttaatagagacggagtttcgccatgatggccaagctggtctcaaactcctgacctcaagtgatctgcccaccccccgcccctcggcctcacaaagtgctgggattacaggcgtgagccactgtgcctggccacatttgtcaactttcattggtcaatgattgatgcaagccagaataagaatagattgggccgggtgcagtggctcacacctgtaatcccagcacttaaggaggtcgagagagcagattgcttgagaccagcaatctgagatcagcctgagcaacacaggaagaccctgtcttcacagaaaaatgaaaaaaattaggccaggtgctatggctcacacctgtaatcacagcactttgggaggctgaggtgggtggatcacctgaggtcaggggtttgagaccagcctgggcaacatgatgaaacctgtgtctactaaaaatacaaaaaatagctgggtgtggtggtgcacccctgtaatcctagctactcaggaggctgaggcatgagaatcacttgaacccaggaggcggaggttgcagtgagccgagatcacaccactgcactccagcctgggcgacagagtgagactatgtctcaaaaaaattaaattaaaattaaaattgagcctgatgtggtggcacatgcctgtagttccagctatgcaggaagttaagatgggaggatcccttgagcttgggagatcaaggctgcagtgagctgtgattgtaactactgcattctagcctaagaaacagaaagagacactgtctcaaaaaaaaaaaaaaaaaaaaaacaagaaaaaaaaagaaagaaaaaaacagatcagaggccctggcctggggtcagtttctccagaaaggcctgcacaatggagttttcatgtaaaaaatttcttacatcctgattttaaaaaatcagatgatcaggaaacattgagttccgattcctttgttacaacctccactaaagctaagtaacagctgctgtattaagatggggctccccctctccatcccacacctgcctcccttacatgcctaactcctgttgtaaatagggaccctaatctgatgtttttgtagtccctttcctaggggcactgtggggaggtggaaggaatttcacctttgttgttggacagacttagatttgagaactggttctactacttactgtttgtgtggtctgggacaagtcacttggtccaagtaagcttctgcatctgttaaaaaaaaaaaaaaaaaaaaaaaaggggcggggagctaagaattcctgcccagcaagttggtttgcagatcagaggcagtgtgtgagaagtacttaacccagcacctggcatatagtagatgttcaggacatcgtagcaggaataagggagacatctcacaaaacattttgtgagaaaggatcagtttctatctagtcaatgtcttaaacattcataggttgttcatggtgggagctgctcgaggaatcatcctagttttatggaggaggaatctgaagctggaggaattgtctccttcaagattacttagttaaaggcaaacaggttcatagccagtggctcttcaccaacccacaaaaaggcctcagattataattttgaagattaagtatatgaaagtgctatttgagtgattaagtgtaagcatcagatcattttgaactggtgagatggctcacacctggaattccagcactttgggaggcccaagagggaggattgtttgagcccaggagttcaagaccaacctgggcaacattgtgagagcctgtccctacaaaaaataaaaaaaaattagccaggcatgctggcacacacctgtggtcctagctactctagaagccgaggccaaaggattgcttgaggccagaaggttgagcctgaaatgagctctgattgcgccactgtgccacaagctgggcgacagcaagacactgtgtccaaaaaagaaagataattttgattagcacaaagatgggacagctacatgtgatcagatttggaaaaaaaaaataaccattcattcattcattcatttactcggcactgattgagtctagtttggacaggtattgccctagtctctgggatgacagcgagaggcaaaacacagacactcactgcctgcatagagctcagaatgtaatggtgggaaggcagaggaggaaacagatatacagataattttagatggagatacctgccatgaaggaagtagaggaaggccaggtgcagtggctcatgcttgtaatcccagcactttcccagcactttgggaggctgaggcagaaagatcgattgagcccgggagtttgagaccagcctgggtaatatagcgagaccccgcctctacaaataattaaaaaaaaaaaaaagaaataggattacctgaaaaggagccagtcttgcaaacagccgggcaaagagtgagcaagagttttttgggaagaggtgcacacagcaagtgctgagacccagaggaaggaaggggcttgtctgctgaaggacccaggtgccctgggagaggtagccagaggcgcttagtaagcttcaatcaggattttaatcttaatatagtgctgagggttttaagcagaagagtgatagaagagagttagcttttgtgcaagcactattattcatggaagtcccctttcgatggggtagtggggactcctcactaagctgtccttctatctctgtggctgtctcagagaagcactgtggaactccagggtgctacgtagctcaccacggtgacccccaatgcaggccacttacagaagcttgaagatctgtgatttgctcacccaggctcccatgccgagtgttcttgtcattaactcaaaagccaaatgctggtatttctgttcttacttgcttgattgtttgtttaccagttctcaacatcttcagtgtccacttggttactaaaatgtttactccttagcccagtgtgtaggcatgtgcctgtaatcccagctactcaggaggctgaggcagaagaatctcttgaacctgggaggtagagattgaagtgagccaagattgtgccactgcaatccagcctgggcaacacagcgggactctgtctccaaagaaaaaaaaaaaagaaaaggaaagaaaaaattatccaggcatagtggtactcacctgtagtcccagctgctcgggaggttgaagcgggaggatcacctgagcccaggaggttgaggctgcagtgagccatgatcaggccactgcactccagcctgggtgacagagtgagactctgtctcaaaaagaatataaaaataataaaaataaaataaaatgtttcctcttgatcacaaaaaaaaggatatagttctatgcaatcatgtctgaaacaggatacgtgtgtcatgcatccctgagttcgggttacctcaatgacatgaccatttacctaatctttgctttttcatctgctctcaattgaaaagaaagaaaccattaattatattgaaagatgctgacttgtaagcttctcccctctcctggctcaggtcagttgctcagaatgcacccagcaaagattggctgaacaaagacagggagatgttgtgagtcccactgatgcccttaacaccgggcattgttcaacttggggtcatttgtgaaaatgatgggaatgcaacttcctcactttacagatgagaaaacagcctcagagaaatgctgggatatgggatatgagttggtctcatagcctgtgagtgccagagccagctcgaatccaagtttctgactcacagtgactcttatccagcaggacgtattcttcagaggccatgtgttgaaaacagttaggtgggttgggggctgcaggccataccattaggaaatggggggcatgtcctctgggtggttcctaagcatttggatgttacagccctgcctttctttattctgttgttctagaagctccaacctggtatgcttttaaggcagatatggccacaaatgaagcacattcacatgactgcactgcctttctggatgaaacaatttgaccaaacactggtgttgagacagttggtgatttgggctttgccacgtggtgggaatgacacaataaatatattttgatatgaattaggtaaagatctgtctctaaccttgggctatatgtgaacattaactgcccattggatactggggaactataaatgtctccgtccaactctgttcaactctaatttttttttttttttgagacggagtcttactctgtcacccaggctggagtgcaatgacgtaatcttggctcacagcaacctctgcctcctgggttcaagtgattctcctgcctcagcctcccaagtagctgggattacaggagcccgccaccatgcccagctaatttttgtattttttagtagacacagggtttcaccatgttggccaggctggtctcgaactcctgacctcaagccatccacctccctcggcttcccagagtgctgggattacaggcatgagccatgacacccggcctgtaattttctttaaagactgccactgggtggaacccactgggcccagtgagaactacggaaaagagacccattcttgccctcattgttagtgtccacatccggatttacctaaaccccacccaggtggcatttgcatagtaatgaaaaaccggtattttctagctgtgaatcacacttcaaatcctgagcggctgactgtcaggggtgcgtcaggcctgcttgctgggagaatggacgagctggttgtggagcgggcgggtcccgccacccgtgggctcagcactggactgctcccagaacattaaaggtctggctgatgttccatgccacatctggacatgaagacccatgtctgcccttctgtagaagggccaaagaagaaaggaggcatcacatgtttctgctgtggggggcccttccgagcagcagacaggagcaaggtacaggagtggcctgattctggggtttccctgccccccctggggtccctaaactgctgtgtgatatgtttctaactatctggacagctcacccaagagtcagttgttcccagtcgcttcttgctgaggataagccaaaagagggccgggggccaatctggtttctttcaagtgaaattatgcttctcaagcagagaatgattgcccacagcagttaaaccttgtttaatggtaattaaattgcttttcttcactttgaaaaatctcttaattttctgtacaaaggcaggaagcatttttctttgattctacaggatgtttctaagtatggtgtaatcagttcatcttaccttgccgggctctgaaagaatgagtgtgtgggatcagatttagaaatgcctcaaaggttagaaagccgagtgctgccgattaactcaagctcagatgaccaaaaaaaaaaaaaaaaaaaaaaagctgcttttcccctcacttctccctctggttctgcctcagtactttgcttaggagtttctaaaagcaggcacagttgcctgcggggctggtgtgtgtcaccttcgcaaagtgcagatgaggtctggcatgtcccatcttgttcctgcctgactacaactctgcacacagacagtgttgatctggcttggagcccatagtggcaatccttggagtggaggcagcagagatctcagttcttcctagtgcttgagaagttaactaactgtctttcccatgaggaaaatgttttgagactgtagaagcagagaagagacttcgccaaagcccatagaaaataaaaagcaaaccctcaagcatgaaaatccctggccctggagtaagtgcaggtgataaggcttgctatctgatgcctcattccatgtctctggcttcccattgcctaaattaagatgtcctgaaagaaaccttgggaaaaaaaaagcacagtccccacatttgaagtagaaatagaattaaggagaaattgtgattttcctgaaggaacagaaccaacactggttttcaaaagccttagttttacattttagtagaaactgttagcagtaggaggatttgctttgtgtgtgtgtgtgtctgtctgctttgccttattttggttctgaccataccactgctatctcagtcttagaggctgattttgtggcccagagtgtttcgttcagatatctttgtgttgaggtgatattgagccagcagccaaagaaatgcatggccaagatatggaatatctggtcaacagagaataacaacaaagtgggacgcatcataaggtcataggtcagtgaaaacagctgctagccatttatatgcaggagagaaagaaggcccagggagttggaaagactgaaggtattttggactgagcagagcaaagggatttggggacatataaatgtatgaaacaagatggtcaggaaaacaatttttttcaaaggtagcatgaatagagtgaggtaaggaaacccatggccatggtactggtggcctaatgggaaaaggcagtgtaatgacttctacatggagacttcagttctgcccctcgtactgttgaagaatattctgtccagagaggctcttcagtttctacctggttttctaatggctttaaaaaactttggtgtattgggggaatggaaacaaagatatttactagagaagtgtttggcaaaaagtgccaagcttattcctgagaaaggatggaacggcgtggggggtggagggagggttggaaccatactccaaattcccctgaggcccacacgtgttcaccagacatctgtggggagcccggatgagatgtggggcccttcccctttctcattttcttttttacttttagatcctggatcaaaatgagtccttgattccctcatcccatcccaggac
